United States Patent 12,642,819 (COMPOSITIONS AND METHODS FOR TREATING INFLAMMATORY BOWEL DISEASE) - sequence listing, part 92

SEQ ID NO: 47 - DNA, 2652849 bp, Lactobacillus casei (residues 1-1,326,425 of 2,652,849)
ggttgtattggccttcctgaagatagttcttaaaagatactagacaggttcttaagtctttgactaactcttttagctgttgtccagtgtctccgttcgagtagccccaaaaattcagcgtggcatcaggaaatgctttttgaacttgttgccaagcacggatcaaaacatcctgctgcttttccggtgctaaccgagcgaccatgatcactgaatttttctttcggtcttgccaaggtacatgcggcttttccaaaattttctgatccgtcactgcgccgggaatttcatacacagttggatcagtagcgccatatcgagcaacaaattcgtcacgttgccatggtgtcaaggcgataatgccgttccaccgttttcgattaccaatcatgtactgataattaaagttgaggtctgaagttaaaatgtcatcgtcatcgttaagatggttgttatgcagatgcatgaccttatagatggccgtatccatgctctgcaccgcataggctaactcaaaggtgcgatcgacaataatcgtattggctgtatgcgttgacaggttgatctgatcaaggaagaagcttgttaatgcttcaaagtctgcgaactcataatcatggccatggtaattaagcaacctttgtagggtggtttcttcttccccttgaggactcgtcatacgataacgttgatacacggccatcccacttggagctagaatctgctctgacacaagtttggtgccgaaagagaaaaattgttcgagtgccgcaaaaccgcgggtgtcgtaccacaccattctgacaagacggccattgctgccaaaatattgcacccagttaagccgctcgtcatcagccccacgttttgcaataatcatgatttgcttgcctttttctttgacatgaagcttttcgacaccttcaggttcatactcgtaaccgtctggcaactgcagatcttcaatcgtgaaattccgagcctcgtatgtcattgtgccttgaaagaaatcaaacaaattaacaaaatcatcatcatcaatacccgcatcacgggtgatctcgtgcaagttcaaagcaaactgacgtgtaacgattcttgcaggcacctcatgatgcttaaacaaacgcaaccgttttacctgtgcgtgttcgatacccgatttattaaagttgataccatcatttaagaaaaaaaacatcgtgccacctccgcgagtgtattaagaatttagcaattgcagtcctatctgatgtgtgattccggttaacaacgtttcaaaggaaagatcatctaacgcaatgacatcgtgaatccagttttgatatcggttaaccacgtcgacaagatcatcatttgcctcaagtcgataaaatgtaggaatgatctgatactccgcctctttgtcacccagcatcgcctgaaaaagtggcgattgtccgtcaaccaccaaagcatcattggcagtagccgctcgccgtctaaaccaccaaagcagtagttcaacgtctgatttaaaagcgttggccagcgcattcttgtcatcacgcaggccgataagctgcaatcgattgtctcgatactctttggtcatcatgacggcatgtgtccgatcaaaacggtaaaactcttcataacgtacattgttgccatcctcgacatactgtgttgcgatgacgttgttattcgtattcatgacatcaatttttataagcgtattgtgatcgaaataattaacctgtttaacgctcccgtcttcacggtgactaactgtgatctttaagtcattgttgatccaagtgtccaccatcccataccctgattgcgtccacccttcagaaaagagccgattattcaacgcataactagtcccagtgagctggcggcccttgaaattcaatgccaaatcgttatacaaatcctgatgcgcaatatggccgatgtctgggacggataacacagggtgaaaatcttctgcatccgctactgtggaggtcagtatattcagatttggaatgacaccgcggaacagtccggccagatctttcaacccatcaaaaacctcatcatcgtttggcgataacgtccctgcatacaagaagtatcgacgacgatcgtctggaataaatgctggcattagatttttttcatcgtattgcgttagttcgcgctgacgtcgatcaatgactcgctgtatctgctgaagtcgcaccgacacttgccgtcgctgggtagttaatttttgctgtctttcttgttgctcagacacttcgctacgttcgtgattggctttgtccgtgagaccgtttctttgctcgctgatcgcgtgcaatcgccgatccaactcatccgcttgtttgtgcctatcctctaatttggcttgaactttcgtttgtaaggagcgcactacttggtcttccgtctcgattttttcgcgtaaatactgtaaagcgttcgcttctcgggcagattgatcaatcgcacttaagaggttatcttcttccttcaatgctcgcatgtgatcaattaacacctgtcttcgggccttgttgcgactcaaataatgtgcattttgatcaaggcgttcttggtactttgctgattgccgtgtcagaagattcgttgtttgacgattggcagattgctctaacttcagacgagcctcttcggcatcaagcgctgccaatttattttgggtgctaaccgaatctggttgttgttctagaaagactgtgattttgtcgagttcctgattcaggccttctagctgcatctgcgttctttttcgctcgctatccagaagctccaattgtttgagttgtccacttttcaacgccattagcatctgatcaaaaagaatcagtgcccgatgcactcgccgtttggcttgcgctacccggttgttgacaaattgcaacgattcgttattgttagatgtgccatatgaagaggccaatttaatctcgttaatctgatcaataacatcaggcgtgattgtgttcgactgtgcatcgttcagcacttccctattaccaccaatacttgacttcaagtccatcaaaccacccccaaagttgtttatcgcaaacacgaaaaagccatcaaatatccgcatattttgagtaaaagcatatttttataatcacgtagaattttccctgaacgaacattagcagagtttatatacgtaaaaaaatatgtctcacaaaatcttctaataacctaatatgcttttgagaataacgcatcaaaaatcgaattacaactatttagcccccgcacatcaacgtttctagcgtgaactttttgatcaaaaattcaattttaaataaattattttcctcaattttcaagtcaagtgcaacgatgataacgaattcttgatagtggtcggttgtattggccttcctgaagatagttcttaaaagatactagacaggttcttaaatgctaagtaccgagttgagaaagatcacaaagatattggtgtcataatcccacttgatgatgaggaactgaaacctttaatgactaaagccttgagacgctactttaacgccctgagaagcaatgagaagcacatcaagaatgttgagaactacttatacggcaccatgcaaaacctatttggcgtttggtggaataaacaagcggctagagaatatgcggccaaacaccccgaagaagaaaagtcggccgacaacgataacagtgggttgtactactagtcctaaaaggctacaaaatcctttctaagcggttttaagacttactaatctatttatacttaagttagatttaaatggcttaaacagaagaataggggcttttaaatgagtgccagagctaaccaggctaaccagctcaaaagttcagcctttagatcaacgccaagctcaagtgattggaggccagggctttatctattgataaggtactcaaaaggtagtatagtggtagtagtaaaataaaggagatgagacaatcatggcagttaaggaaaagaaacgggtccaagtcaagattgataaagatttggccgatgataccgaagcagttttaagcgaattgggcttaaatccaaccacggccattaacatgttttacaagcggattgttgctaatggtgctttaccttttaatgcgtctttaagcgaagaagaaagagctaatttacgctttttaaaggcgaccgaagggacaccagtcaccgagttcaaagacgctaaagaggtcgctgattggctcaacgatccagatgaggactaatgacttagtcagcctatacgttagttttgtagaaactaacggtggcaagtctcggccaattttaattcgtcgggtatcagaacagacgttcgaggcttttaaaattactagtcagtatgaaaagaagtcggcttatatcaagcaacaatattatccgatttaagattggcaatccgctgggttgaagaaacgttcctgggtcgatcttggtaatatttatcgctttcccaaagccggtttaaactttaaagaaatcggtcatttaagtaagctagatcaaaataaaatttcagattttatgcttgacctaaaatcaaaaagaagaggtaagggtcaaaagataattcaacagcgatcaagtaaaaggaagcacaaagaaagtaaagcagagcttacacaaagaattcaaaaacagttaaaagactttgctaaacacaatccagaaattaagccaaaaaacaatcctgaaaataaaaacgatcggcctagttattaggttgatcgttttttaatttatccggtttatgggcgttaacatagtcagcaaatgtttttaaaagttcttcggtttgttcgaccgagaggttattagcttgaaagtacttttctaataaagcccctttttgaattaatcggcgagaacgggctttgcgggcttgccgattttcatagtatttagattgccgtaatttaaaatcctcccgctcaattttttgttttaaacgcgcttgctgctcgactagtttttcatattgattaggcatggaatttccccatctcgtatggctaatgatctacggactttacctttaaaagttcagaaaattgcttagctaaaagcttaatctgatcgttagacaaattagcataatctaaattggcttgactgatgatttgtttacctagccgttgttcaatcttaattttttcgtccttaattttttgattaagggcttttaatttggcttcttgtttttctaagttactttgagacataacgatccctccaatcatattagaaataatcaccgaaactatatcatataagagaatattaagtcaaagtataaaatttgaaatagcgaagcggaaggcatacactaaaagtaaattcaggagaatcagaaggccgagtgaaatgaggtaaatgcgcacttacacatagaattaattctatgttgtgctaacccccaaaatcctgtattagaagtcgccgatggcgacaacaaagtcaagcccatagaatcaaagtaaagaggtgactaacatggcaatatttcatatgagttttagtaatattagtgctggtaaaggacgcagtgccattgccagtgccgcttatcgaagtggtgaaaaattatttgataatcaagaaggccgccactatttttatgcccgatcgtttatgccagaaagctttattttaactcccgaaaatgcaccagaatgggccagtaatcgagaacaattatggaatgaagttgaaaagaaagatcgtaaatcaaactcacggtatgcaaaagaatttaacgtggctttaccgatagaattaagtgaatccgaacagaaagaattactgacaaaatatgtgcaagaaaattttgtcgatcaaggtatggtagctgacgtagcaattcatcgcgatcacccagacaatccacatgcacatgtgatgttaaccaatcgcccatttaaccccgatggtagttggggattaaaagcaaagacgcagtacattaaagatgaaaatggcaagcaacttttaaccaaaagcgggtttccaaaacaaagaaaaatttggttggttgattgggataaaaaggaaaaaattaatgagtggcggtataattgggcaacaagtgttaatcagttcttagcacaaaaaaatattccggatcggattagtgagaaatcgtttgtcgatcaagggattcgagagacacctacccaacacgaaggcattaacagccaaagaaaaaatcgaaaagcatttaatcaacaagttagagcgcaaagaaacgctcaagctaaatatcataatcttgacgaaaagataagaaataatgaacattttgacgcactaactgacgtgctatcgttctctgaaaaacacacaattagtcatctaagtcagcaattgaaaacctatgtcgatttagaacatttagatgataaacagcgcatgctgtttaattggaaaaacagcttattaatcaaacatgccattggtgaagatgtaaccaagcaactgctgactattgaccagcaaacgacatcactagcacaagctaaccagttgttaaataaagtggtggaacgagcaacgaaaaagctttatccggaacttaattttgaacagacaaccgcagctgaacgacgggaactgattaaagaaactaatagtgaacaaacgatttttaagggtagcgaattggcagaacggttagcggatattcgaagtgacttattaacccagcaattattgacgtttaccaagcggccatataccagctggcagttagttaatcagcaggcccaaacaattgagaagcaattaaccacggtgctagccaaacatggtcaccagttagaagatttgaagcatactgatcggggcatgctagccgcttatgaacctaacgaactcgaattcatttctaaagcggtgaaagatttacgggtcatgcgggaagttaaagccgtggtgcaaacccaatacgacagcattctaacgactgcttttccggacagtgacctcgataagctagagacgattgataaggagcaaatctataccgctgtggtttactatgacccagaattaaagccattaagcgccgatgatcttagtcaattgcaacagcagccaccggtagtctttactagtcagcaacaccaagctggtttgaattacctgttaggtaaaatggaattaaaagatattcagaaccaccgattacaacgggtcttaaaacatgatggcacccggcaactgtttatcggcgaatgtggccaagatcctaagttggatcacaaacaaattgaaatggtgcaaacccgtttgaaacaacagacaacgcggtttgatcaatataagcaggctcaagttaaagactatcgggccattaattaccacccaactagcccgaaaaattacctgatgaatattttggacgaagccttaataaccattttatatgcgaagaatacggactatctaagaaagcagcaactacgtagactaaaggagaatgagtgggaaatgacgaaaaagcaacggcaacaccaaactcgaaaccggcatgaagatgggggcatgcacttgtaatcacaaaattagcgactggttaattggtatgaatggtagcccataatgtattttatattgataaaaattagagcgtgctcgattagttacgtatagctgccagccttgtgtatggtctatcaaagagaccaggtaaacaaaacctttaagccgaaaccctattttgaactaagtgcggaaattttagctaatggtagattgtaaaattaatccgaacgctgttcggacaaaaaagatcagcttccgaccactatcaagaattcgttatcatcgttgcacttgacttgaaaattgaggcaaaaataaaatccattatattgcggttgttgagccatattagacgagaagaaggccttttgttccacgtggaaccaaacgaaaaggtcgctttataacgcaaagcgaccaactatatagtgaataataatttttttaaatcctgcaacatgttgaaagctcaagtgtgccagcctcagaacagacttggctgttttaccaagttgcctcatctaactgttagcaagctaataccaacgcccagtaggaccacggcgacaaccgattgaacaccgagttgccaaggtttaaaatttttagcgcgccattctgcaaaaatgacgagcagtgttaccagcaaagcaacaacgaccatgatcagaagctgaataaccagactatccatgtgtacacctctaaacctctaagtcgaaatacgggttgatcttcttttgaatgttgtgaatttgaatcaagtcgatctgtgggaagagtcgatagatgaatccggcaaagttatcacggtgatatttgtaattcatccgggccatccgatgctgccgattttcgtcggtaatctcccagacttctaaattataatccgcatttttgacgatactgatataagtatgttgattgatccaaaccaccggatgcattgtcgattgttctaacatgagagacccctccatcagcagattttgcgctgttgtacgattattgatcggtgtttcgaccacgcccaaataacgcacagcatgctttgagtatagcagaaaatttgcgctgccgcggtcttgactttaattggccaacacggtatagcaagtgttacaaaccttaatatgacagtgtttttgcacctaaaattaaatttttaagttcacagttcacacttattattatgggaacatacgtttgcaaagtcaaccgaaatttagcggaaaatgctgttggataagcgccataaaaaaagcacaccaataggctaatattgatgtgtttttacgcattaaaaattaaatcaagttaaaatgtgcaagtgcatttggaataccgttttcgcgataatcgtccgtttgataatccgcaacagccgcaacttttggataagcgttccccatcgcaattccggtgtcagctgcttgcaacaacggaatatcattataaccgtcgccaaatgcgtaagttggcagaccacgtaaggatggctgatttaacaggatggccatgccactgcctttggaaatgccatgattgacaacatcaaacgtataatgcgagttgcggtagaacgtcatttctgggaaatcttggatgaattgtttcccaatctggtcacctgcatcggtccatggtacaaacattaacatcatacagattgcttcatgctcgtagaaagatggcttgaccggcggcggtgcttgccgcacctgcgcatagttatcggttgtgagctgattatggccggtcagcgccgatgcttcactgttgtacatggcaacttgaatgtcttgtgctgcactcgtattgagaaaacgggtgagttgcggctcgccaatcacactttgaaaaatgtgatcgccgtcaagaaaaatgtcaccaccattagcagcaattgcactgcggaccccggttgctgccataatgtcagccagttcgtagtaatttctgccagtcgcaatgaccggcagaatctggttggcttcaagggctttgagcgcagcaacattttcgggtggcacctgtttgtcatcattgagcagcgtttgatctaaatcaaaaaaaacgacagctttgtacataatttcctccgttactaaatattgtgatggcctcattctaccatggaatacgcacggcagagggcaagaaatcgaaacgcttacaggaaaagacggatactactggggtgaaagggattcacacgcttgtcagcccggaaacctgcttgcaaggagcgcggggtcatgaccaaaacccggtcatcacagccaaggctgcttacacgccgttttctaactgggttaagctacacttccataaaaaaacaggccgatgagcatcggcctgtttcatctcagctgattgaaagaaatagcttatttcttgctcagtttgcttgcagctgctttgtccaagatgacaacaacatctgaatgcttttgcagtgcggacgctggcacatcgttggtgacagggccttcaatcatttttttaacagcatctgccttgttttcgccaaaggctaacagcaaaatcttcttgctcttcaagattgagccgatccccatggagtaggcgtagcgaggtacgtcatcttcacttgcaaagaaccgggcgttagcgtcaatggtgctttgggtcagcggtactttgcgggttcctgcgtcaaatggtgagccgggttcgttgaagccaatgtgaccgttacggccaatgccaagtacttggatttcgatcggatggtcggcgattactttgttgtaacgcgtggtttcttcttcaggatccttagccaagccgtttggaacaaaggtttccttgaatggctttttgtcgaagaggttactctgcatgaagtaacggtagctttggtcattgtcaggagccaacccaacatattcatccaagttaatggaagtcatgttgctgaaatcaacatcactattaaccattgctttgtacatggtgactggtgtgctgccggtagccaagccaagcactttggcaccgttatccataccttgcttgatcaaatcaaatgcgtacttgcctgcttctgtatcgttatcaaaaatttttacatccatcattgatatccccctatctggtctagtccaatgtagcatcaaaaaacctccatgtcaatagtggtctataccgtaatgctgaaaattttgattttctgtgtttatgctgagtcgatagggcgtcaggcacaactgacatatagtagataacaacatcagataacagcgtcctcagtatgatgcgagcaaaaaagtggacagcgatagcgttttccataacttgtgaaacagttaacgtacactgttatggttttaaaccagatgctttccttagtaaactgttagctggggattcaacctgaatgtttggcacagacaactgtgccaaagaagcttttgtcagcgattacatgaagcggttacaataatacttgtaaataagggaaaggagtgtgtttgccttgggtgcaaaaacagcaaacaagccggcagcagaaaaaaagaaatttaatctgaaagccggtatgcaatcattcggaaccaagctttctggcatggtgttgccaaacatcggtgcctttattgcttggggtcttattacagccatcttccttaaaggtggttggtatccaaacgctcagctcgcaaaaatgatttcgccaatggtaacttatctgttaccattactgatcgctttttcaggcggttcgatggtggcaggtcatcgtggcggcgttgttggtgcgattgctgccatgggggtcatcgtcggtactgatgtgccaatgtttattggcgcaatggtgatgggtccacttggtggctggtgtattaagaagtgggacgaccgttttcaagataagatcaaacaaggctttgaaatgttggtcaacaactttagtgccggcattattgggatgttgctagcaatcgttggcttcttcctaatgggtccaattatctctaccttgactaacggcatggcaactggggttgattggattatcaatcacgggttgttgtgggtagcaaacgtctttattgaacccgcaaagattttgttcctaaataatgcgatcaatcaggggattttgacaccgcttgggattcaggcggcagccgaacatggtaagtcaatcctgttcttactggaacctgatccaggtccaggccttggtgttttgttagcatttgcgctgtttggtaagggatctgctaaaggttccgcaccttccgccatcatcattcacttccttggcgggattcacgaaatctatttcccatatgttttgatgaagccagcactgttcctgtctgttatggctggtggtgttactgggacgacacttttctccatcttcaatgttggtttgaagagctcaccatctccaggttctatcttcgcattattcgcaatgtcaccggttaacattgggaattatattggtttaattgttggtgtcacaggtgctacacttgtttctttcctgatctcggctgtcattttacgccgcgataagagcgcaagcggtgacgaattagccgaaagcgaagccaaaatgaagtccatgaaggctgaagctaagggtcagcaaaatgttgcggcagctaaagatgtgatgtcagccgccaagggcattaagcagattatctttgcttgcgatgccggcatgggttccagtgccatgggtgcttccatcttgcgcgacaaggtaaagaaggcaggtctggatctttcggttaccaacacagcaatcagtaacctgcaagacaagccaggactgctggttgtgacacaagaagaattagctgatcgggctaaggacaagacacctgatgccgctcatattgcggttgataatttcctgaacagtccgaagtatgatgaaatcatcgcaagcttgaaggctgaagcagttggcggtactgacgaggcaataccagcaagtgagacgtctaaagctaaacaagaaacaccggaagacgaattaaaggaacttgatctcgataagattaccgaagttgacttcctgcatcatgatcaaaacattggttccgcaaccatggcacaggcaacattccgtgctgaattacggaaactgaataaagacgtgaaagttcgtaatgtcgcaatcggcgagattgatgacaaggacaatgtgctgattattgcttcgaaagaaacagcacgtcgcgttaaattgcagtttgccaatgttcaggtctacaccgttgatggcctcttgaacgcaacgaactatgataagcttattgagaagatgaaataagttcggtcggtgttgcggccgcttgaggcgaaaaatatgttcctaacgaatcgtgaacaggaaatgatcagactcatgatgagtcagcccgccggtgttagccgagatgagctggaacggcagctgggtgtcagccgtcggaccatttaccgtgagctttcgcaattggaaagtgacatcgccacaatcggtttaaaactcgataaaggcactggcagcacgtatcggttggtcggggataccaatgatttggctaccttaaccgcgactttggcaaaacaggatcaggtggtgacatttgatcctagccaacgacaaagtgctttaacattacggttgctgaatgccaacggtccggaaacaatgacggcgttagcggcagcggttgacgtgagtgtcaccaccattaagcaagatctggatattcttgaacccgctttgaatgaatatcatctgcaattaaatcgccaaaaagctgccggtatctggattgatggtgcggaaggcgatattcgccgagtattggtaggcgtgttgaatgctgagattaatccgtacgttttcttccgctttctccgtgatcctcagcagacattcgatccagtcacacattattttgttgaacgattaccgcaggaagagttactggcggcaaacgcggctttgctgcgcatcaaggcgttggcggatctcagcgacaaccagcgcaaagcggtgttactgacagtagcagttaatacccgccgattgcgagaagatcagcatgttgaagcgcaacgccatttcgaccaggaacggcttttccaggaccaacaattggctctcgagtttctggcggagatggactccgcgattcgccagaaagtccgcgttggcgattatcagtttcttgccgtggagctcagtaccattcgcggtggcttggctggagaaccagttgatccgtttgatttaacggttaaccttgaagtgcaggaattgattcgtgaagttgccagatcatttcccgggaaattttccgggaatacgcagctttactcatcgctgttggctcatgtccagcgaaccgctggcggtgattggctgccaggcgtcacgatgacgaatccagtgctggctcatctgcgcgacgattatcctgaactttaccacgcagttcaacaagcggctgacgatgttgttggtcgcggtgtctttactggaaatgcgctcgggtatctggtgttgtactttgcttcagtcttggaccatacccacaccgaagtgccagcagctgtcttgctgattacgagcgatggcccggggaccggcagtctgattgctgggaagctacgtgtacaggtgccggaaattcgagagatcaagatcattcaggttagtgatctgccgaaccagaatctggcacattacggtttgattcttgcgacgatgccattgccgggattcaagcatcagtatcttgtcatcacaccaatcttggcgcgtgatgagattactgaaatcagacggttattgcaacaggtcaagccgaaagaagcgatccagcaaagacaaccgtcattagatcagactgtgacggcgtttgaaagtctcaaaaccatggtattagcagctgatgacatgttacagcacttcgctgtgacagagatcaccgaagcggtgacaacctcaggagccacaatcgatgccatgctagcacatttaccagacgtggtggcagaagcgccggtcgtcaaagacgccttgctaaagcgactagaattagcgccagttgggattcccgataccggactcgctatgatccataccagtagtcagggtgtgacagtgccttacatcggcgcattcgatttaaaaacgccgctgtcgcttccagccatggatatgggcacgatcatgttgcatcgggtattgctacttttgacaccgaatccagttgctcaggaaacactaacgctattgagcgctgtcagcgcaaagctgattgcgtcaacaacgaatttacaactttttgaaaaagggcattatagccagttgtatcaaatcatcacagaagtatttatgaatgaaatcaaaaaaattgatcgaaggtgacatgatgaaaggactagacgttaaaacgatcaaacttggtcaggaagcaaagaccaaggaagaagccattcgtcaggccggccaactcttggtcgacaatggtaatgtcgaaccagcttatattgattcgatgcttgatcggaatcgcgatgtttctgtgtatatgggtaacttcattgctattccccacggcactgaggccgggatgaaatatattaagtcgacggctatttcgattgtgcaatatccatggggtgttgactggtcggatgatccggctgatgagaacttggtcacggttgtttttgggattgctggcttaaatggcgaacatctcaaattgttgtcgcaaattgcgctttattgcagtgatgttgaaaatgttcagaaacttgccgacgcccaaacgccggaggaaatcgtcaatttactgaaggaagttgaataaattatgatggaagcagtacattttggtgcaggtaatattggtcgcggatttatcggtgaaacacttgccgctaacggtttcaaaatcaattttgtcgatgttaacgagacgatcatcaatgcgttaaaccaacgcggcgaatatacgatcaccttagcagcgcccggtgagaagaagattcatgtggacaatgttgacgggttgaacaatgccaaggatcccgaggcagttgtgaaggcaattgcgcaggctgatctggtgaccaccgccattggtccgaagattctgccaatcattgcaccgctaattgcccaaggcttgcaggcacgtgatgcagctaacaatcatcaggcattagatgtgattgcatgtgaaaatatgatcggtggctctcagtcacttaagaagagtgtctacgagcatctcgatgacgccggcaagacctttgctgatacgtacgttggcttccctaatgccgcggttgatcgaatcgtgccacaacaaaagcacgatgatcccttggccgttagtgttgaagatttcaaggaatgggttgttgacgagagtcagatgaagaacaaggatctgaaactcaagactgtagactatgtgcccgatttggaaccttatatcgaacggaaactcttctccgtcaacactggtcacgctaccacggcttacaccggcaagtaccttggctacacgacaattggcgacgccatcaaggatcctaaagtcttcaatcaggcaaagggtgcgctggccgaaacccgttcgttgttgttgtcagagttcaagaattttgacgaaaaagacctcgaaaactatcaaaatcgggtgttgcaacgtttccagaatccgtacatctcagatgatatttctcgagttgcccggacaccaatccgcaaactaggctacgacgaacgctttattcgcccaattcgcgaattgaaggaacgcggtttgaattacagcgttttgatggacaccgttggcatgatgttccattatgttgaacctaatgatgccgaagctgtgaagttgcaagcgatgctgaaggatcagccgctggtggatgtcatcaaagaagtgaccggtttgaaagatgctggcttgattgatgaagtcgaagctagcgttacgtccaaagatcgttaatagataaggttaattcatacgattagactgtcagttgactcactggcagtctttttgcgttaagatgggattaatcttttaatgcgatttgaacatggtgaaatggaggccttggtaatggcagatgatgacattttagcaaaaattcaggcaggctgggcgcagacggcagcgcgcgataaggcacgctatgcggatgaacgggtgccagaggatgtccactgggaaacggaataccggtatgaaaactctgctgacccgcagcagaccttgaacttatattatccggcaaaacgccgcaatgcgacgttgccaactgtgattgatgttcatggcggcggctggttttatggcgatcgcaatctcaaccgaaattattgccgctatttggcgagtcaaggttatgcggtgatgggcatgggttatcgcttgctgccagatgtcgatgtgcgcgggcagattcaagacatctttgctagcttacgttggttgtcgcattttggcccgcagcgcggctttgatctcgatcatgttctattgaccggtgactcggcaggcggccatctagcgtcactagtggcctgcattcagcaaagcgaagagctgcaagaactttttggcgttgatcgggttaatttcaatttcactttggtggccttggtgtgtccagtcgctgaacctggcaaactgccagaagccgctggtgatatgagcgatatggccgctttttatcttgataagctgagcggtggcgatgctgcattggctgaccaccttaacttttctcaagttgccaaagacctcaagttgccgccattcatgctgattggcggccaaaatgacagcttctatttgcaaagtcaagctttgctagaagtgtttgctgccgataaggtgacctatacgaccaaattgtggccagccagcgccggtccgcacctcaagcacgtttttaatgttcagcattgggaatggccggaaagtatcgagacaaatttggccatgttgcgtcaattcgatgtgctcagtaaacaacgcgatgaggctgaagcagatgatgaggacgacctctagactgtgctgcgcgtttttgattagacattaaaatggaccgtttgaatggtgttgatcattcagacgatccatttttgtgatggttacaaagcggcagttagaaaaagatatctagaaaacgtttgacgtgtgcctgataagcttccgggttgatccagtagctttccgcgtgcgcagcgcccggaacgatccagagggctttaggacccgcagaagccgcataattttgccgacccattttcgttggcacatagacatcttccgcaccgtgaataaccaatagtggcaagtggttacgggtgagtgcttggcggacgttgacaacgcgtagaggataacctaaccggcgatagttaagaaaacttgccagtggaaccaacggcattggtggcaggtgaaactgctttttcagtaagtaggccaactcggtttcaacatcggtgtagccgcagtcttcaatgacagccttcacttgttttggcaaactgggttcgcctgccaccaacgaaactgtggcaccacccatgctggtaccaaacaacagcagttgactgtctgcaccgattcgatcaatgatacgttgcagccaacccaaataatccagccgatccagccagccgaaactaatgtattggccatccgattcaccatgcccgcgatcatccggtagcaggacattgaagcttagatcgtaaaacatgtgggcaaagttgctcatcgtaatcccagtacctttgtaaccgtggcccacaatcaccgcttttttactgccgggatgcggcaaccaaagagcttcaagtcgttgattatccggggctgtcatatgccatgcctcaatattggcctgactttctacccagtggacatggcgataatatgaagccgcatacttttgcatcgaacgccgcgcgtctggaatatagttaatgcggcgaaatgcatattgataaaagctttcggcggtcgctaacgtgccagccgataataacagtggggttgcaaggccgatcaaatggctttgtttcatgactcagtgcctcccatttccaagtcttgcagtcagggcaaagcacggcggagaccggggtgccgcctgctggagcgctgcttatgaatctgcaaatgttatgatattactttaccgcattggataatcagtcgcaatttcttgccttttctcgtataatgacggtgcagaccgttaaatacgaaaaagggagaaatcgatgcacgaattaaaattattcagtcttaatgggaaccggccattagctgaaaagattgcggaagaggtcgggctaccgctgtcgccagctcgcgtgaatcattttgctgatggggaagttcaaattgaactaccggaaagtgttcgtggcgctgatgtatatgtgatccagtcggtctctgatccggttaatgagaacttcatggaacttatgatcatggttgatgcgttgcggcgggcgagtgctcaccatattaatgtcgtgattccttattatggctacgcacgggctgatcgcaaggcgcgctcccgtgagccaatcacagccaaacttgttgctaacatgctggagatggatggcgttaatcggatcattgctgttgaacttcatgcggatcagattcaaggctttttcgatatcccagttgaccatctcaaggcccaccacttgatcggcgattacttcaagaagctagatcttggcgataatgtcgttgtcatcgcgcctgatcacagtggtaccaaacaagcgcgggcattggctgaagaattacatacgccaattgctattgttgataagcgcgatcaagaacacatcggggttatcggggacgttgccggcatgcacgccatcgtgattgatgacctaatcgataccggcgatcgcatcgtggactcttacaaagccctgagtgaagcaggtgcacttgatgtctacgcggcagccacccacggcgtattctcccgtggcgctgttgatcgcatcaagcatctgggactcaagcgggtcgtcatcactgataccattaagctcgatcctaagcacaaattcgaaggcttagatcagatctcggtcggtccaatgcttggcaaggcgatcaaactgatcaacagcaatcaatccattcatgttttgttctagaataagttagtgaaataaggcggcgatggccgtctttttttgtgagcgcgagcaggagcgcatttaaaccggagcgtaagtggccttgaagccaaatgcccaagttttggtcattcgacttcaaggtctttacatgcaaggcgaatgcgagcacattatcacgaaataatagcgtgaacaaccactcgtcaaatgaccatcagcaaattgccagtaaccgacgaaatcgctgcttaaccgcttgatgacacaatgcagcagtcagctttttgtcacattttttgaaaaaagatttgcaaaacacttgcgccagtaaggggtacatgatattatatttaagtcgtgaagcgcgacagacataagcagcatgggtggttagctcagctggcagagcaacggactcttaatccgtgggtccagggttcgatcccctgaccacccagaatataaagacatttggtccgaaaacgttgaagtttaagcgttttcgggctttttgtcgttcttcggtattctaacaaagttcgtgttttaaactggtcgatttcgaccagtttaaaaagcagtccattcaaatcttatttaagaaaggcagcagcagaagtagcatgattcaataagcaaggtgctagtattaactaaaagacaaccaataggaggcaatgaacaaaatggtgaaacgactactaagtgccagtacaagcgaagtcatgacgtttgatgggcagcagcttaaggaaagcatcaaggctagcgaagggcggattatcgttagtgaaaatatcgtgacgcaagagaatttggacagtattaccacagccgaaattgctgcagcatttggcgctgatatgattctttgcaatcgccttgatgttgatgatcccaaaatttttggcctatatcctggtgaaagagatttatacagcgcgcctaagcatgacggcaaagagagcatcacgagactgcgaaaactggttggccgaccaattggaattaatattgaaccgattggcgacaatcccaaaatgatggaaaatcaaattgccattttgccaggatgcactgccagtgaggcggtcatcaaaaaagccgaagaaatgggttttcagttcatggtgctgaccggtaatccgggtactggcgttacaaatgaagcgaccattcgcagtattgcgttagccaagaagtattttaccggcctaattattgcagggaaaatgcatgcttctggtgttgacgaaccgctcatgacggaagagacggcgaaaaagtttattgaagcaggtgcagatgtgattttggcgccggcggttggatcaattccgggatttgatgaagctgacttgaaggcggttgtgaaagttgttcatcgcttgggtggtttggtgatgagtgcgattggcacgagtcaagaaggcagcggcagtcatgtgttgcaggagatggcgattcgaaataaaatctgtaacgttgatatgcagcatgtgggcgattctgcatggggattcgaatcacctgtcgataacttatacgcagtcagcaaggcgatccgtggcgagcggcacaccgtacagagaatggcgaggtccattaatcggtaacgataacaacatgttgttaaaataaccagcagagctttcagccggttatttttgtgacttttacaaaccagcaagctgcgtcattcacctcgtctgcgggtgtcggtggcgtagatgacgctgccgatcaatgcaacgatcacggcaatcagccaagtcagccatgtagcactggtcattagatagccgatcagcaataaggcaaatcccattaaaagtggcgccattggtaggtgaataccagcgggtagggttggatcatgccgtaatttgaaccatgctaggatggtcgtgatgtattgaagaaaggcactaaatacgattaggttgactaaaaataggtagctgccagataccactagcattgcggcaataccgattgtcaaccaaatagcgacaaatggggcaccacttttgttggttcgcccgaatactgctggtagcaaagttttttcggttgctaatgaagccatttcgattggcgtatcgaaagaaacggcgacagcaacacccagaatggagatgagcatacctaatatcgccaccgtttttccgatgctaccaacaactgtggcgaacgctgccgcgactggtaaggtttcagcagtcagattggtgctgagaataacgatcgtcgtcatttgagccatgccatagatggcaataacgatcaacatgaccaccatgagggcgcgtgggagtgttttttctggatttttcattttgttcgcggcaactggcaggaatgaaaagccggtaaacatatagaatgctgtcgagaaagctgtgcgaaaatctgatgagactgcttgcggctggcttacgtgcaggccgtgtgtactgatgaaatagccaccggcagcaatcaccgcgatgagaatgatgatcttcaaggcactggagatattatcgatgaacgtgaggatatttggtccgattaaattaatggcgattaaagcagcaatgatcactaaggccacgctaatatagacgcctcgttgcttgacaacgggtattaatccgcccaatgcagtgagaaaagcggccaattcagccgctatggtaatcacgcccagaaaccatccaaaccaacctgtttgaaagccgacaaaagcgccaaaagcgccaaaagcgccaaaagcgccaaaagcgccaaaagcgcgatttgaatagacccacgcaccgccatcatcgtctattttagaggcgagcatagcgtaactcagtgcaattaacgttgtactgagtccagccaaaacaatcgcgctgacactacccaagccagcttcttgataaagtgtgcctggcaacaaaaagataccagatccaatgatgccattgatcccaagcagaatgacacttgcaaaggataaggttttgttcgtaccgcggtgacgcccggatggttttcgcatcgtagtcattccttcattgctttagtgagtgttttagtcgttaggcaaggaacgggtgagctaattaattcttatttctggcactaaacggtacactgtggaagctaccacacgtcaatttgaaaggttgatgtgtattcgcaaacaccaaatgataagccatattttaacagaaaggttttgaataagaatgcaaagagacttgggcagttacgattacgtacaacgggtttataacgaaaacatgcgactggcggcgtataaacttccgcagactgccgcagatggcgacgtcactttcatcgatgatgggttgatcaagctaaccatgcagatcgctgatggccgggttttgaaaatcaaaattgtgacaacaaatccacgctcctcggtttacatgcaggtttttgaaggattcgaattcggatttaatgcagtcagcacatggattcaaaattatgaggatacgaccagcacgcatggcccatcgcgagggatcgtgaagggcatgttagctgattacaatacaacggccgataatgtgttgacggtgagtttgacacgagtttctggaaaggcactagaataaggttcttgaatcagtgcctgttgctctttgataaagagaatgaaaggcttcttattatcctaaaagagtagcaaccttcgacgtgacttggtacgctttagctaaaggagctgatcaagttgaaaacatacgccgataaacaagccttgctggacacgatcaaagagcgctatgcaaattttagggcggaatttaccgatatccccgaagaaaagcgccaattgttggtcgaaggggttgataagacaccgtcagaaatgctgtcataccaattgggttggctcaacttgttgctgagctgggatcgcaatgaagttgctgggattgaggttgaaacgcccgcaccgggctataaatggaataacctaggtggtttatatcaatctttctataagaagtatggtcaacaaagccttcaagaccaacttgctgcgcttgatctgctggtcaaggagttgtgtacttggatcgagacgttatcacaatcggagcttttcgatgcaggcgttcggaggtgggctacgaccaaggcgcaatggccgttgtggaagtggattcacatcaatagtgttgcgccgtttacaaattttcgaccgaaaattcgtaaatggaaaaaattagcactgtaaacctattaggaacactttttgttggcatcaaacaggtaaggtggagggaaaaaagacgacaatgactcgtgccgagctgtgttattgaaatcgcttttcaatcatgctaagttaatggttacaggtgttattgatcctgttttaatcgaatttagctggcaatgaatttcttgatcaaatgcttcttcaagaaaaatacttgttttttaagtatctattgcctaggtgaatattttcgatcgggaaggaagaagaacatgaaaataacatttattggtgttggcgatatgggcagccatatggtgccacatttggccaaggctggctatgacgtcacagtttgggataaagtgcccgccaagatggcggcagtagcgggcgatcacgttcgcacggcaacttcactggaagatgctgtgacagcgtccaaggtcattatcacatcggtcatgtcagacgatgtgccagcacttcatattgggaccactgaaactccgggtattgtgcattatttgcagccccagtttacaattcaagtgcaacaccctgacgactagaccataaaggccatgcaggcccggttagaaaccggagcataagcggcctcaagcctaaatggctgggctttgggaggtccttatgtgcaggtttctgggcctgcgaacgcgttttgaagcgactacacgcgagcggcttagccgttttgtttttgttgggcgtccctacatcagctctcaacgatcccaaccagtttgttgttggatgcattgctggtcgacccagaacgtctggtatacttgaaacagaaaaaatcggtcaaacaacgagactatgggagatcataccaacatgaacattaagatcattggcgtaggtaaattaaaggaaaagtattttcgcgacggcattgctgaatacctaaagcgcatggataagttcgctaaggttaagatcgttgaagttgccgatgaaaaagccccagagaatctctccgaggctgagatggctgatgtgaaagctaaagaaggcgaccgcatcttaggcaaaattaaggataaggaatgggttattgctttggcgattgaaggcaagcagcggccatccgaagttttcgcgaaagaaatcgccgatcttggaacctatgggcattccgacattactttcgtgatcggtgggtcgctgggcttgtcgcctgcagtcatgaaacgtgccaatgatactttgagttttggcaagttgaccatgccgcaccaattgatgcgcttagtcttgatggaacagatttatcgggcctttatgattaatattggcagtccgtatcataaataggacggcttttcgcaagggttagcgcaggaagaatgccgtgatgtatagccaatataaaactgactggcgagaggacaacacatgtcaatttataaacatatattattaaaatgtatgcactcatataaaggagtggtacatatcctctttaacatattgagaatgggggagttaaacaatacgtggtcataaaggcaatcggtttatataaccgttatgctggttgatttataaaacctgttaaatcagcatctaagttttattgcttttagggattgaagcgtttttgcaaactaaaagcttgatttacggatataagattcatagagctacattaatcggtgcgacaggagtatatattatatgtatgttatagacctatctcttaaaagtgataggtctttttgtgtttatcaaaaaggataaacctttctgctttaccgcatcgattgtgcattgatgtgaagcagcgggtgtggacgcaaatttaatgctacgtgcgcaaaatagagcaataagaactagaggggataggtattaatcatgcgaagtaaacaggacaatgaagtagtgaaactgcttttagcttatgcgccaaggacgataacggttaaggagttaggatatgaaggtttaatcattggttgtggtgaagtcgatccgttgactataccggtaagcgtcagagacaagcttccgcaacttgtgtatgtctccatgtggagtcaacccatatctaatggtgggatggttgggtacgtgattacagatgcaaccgatcagcactatgtggcaagtggcattttagatggtgaattgttggtatgggaagccgtggacagtgaagaatgaaacggatgtctgtctaagttgtcaaagtggcagattgagaatggtgaaatgacgaagggcggaatctaaatgataccagtcaggcatagcaactccggaaagtttttggtaaagatagccttgttggtaattcaaacagtagcgggggcaatgcttaaggaagttgggcgcagaagttgatgctggtctacacgtaactcttcaggtgtgacacattttaatcaacatggagcttctggtaatgtttagtgttggtcaagcttatttgaatacagttacgacgttggaaatcgttttaagggaagggtgttcgatatgagttttggtgaagtagtcaaagtagttggaaaaagcgtatttgaaattgtaaaaggcgcattggtcgatgctgaaaaatcaatgtacacagattcaaagaagcgagctatacaagcagaaaagttgaagtcagtttcgacaaatgtattggcgacgcttcgggttagatatataaaaaacgataatcggccgggagtcagtgccgttgattctgaggcagatcgtcgtggggaacgcgtacagatgatggaacagtataacaagcgcatgcagaactagtcgggaaacagtaacattctcggaattataggtagacccatatatgtcgatggatctgttttttatatcatcgataatgcgtcaatgtcaaacaactgcgaaatgtgtcgtcacatgccgcggacaggcatgttgtgatgtgtcacacgtttttaaagcaatctactatttggtaacttaaagctaagtggaacattcacaaagtatgggggtaatagagtgagagaaatacagtacacggcatttcacccgtcgtatcgaacgttatacgacttagttggtgaagatgcgatgatcaagatatatcaagaatttaagggaacacagcttcagctaccaatgcgattgtatgatagaacagcagttgcagcggagttgaatgggaaatctgtggatgcaaggatgatgaagaaatattcccccagtttacaattcaagtgcaacaccctgacgactagaccataaaggccatgtttgcacggctgagccccatctggcctacgattgctccgccttggcactgggacctttaaatctcaatgaattatacatagaagggccaacaattctggggcaaaaattgttggtctttttcaatggatgtgaatgatgtcttaacatctttgcatcttttgccgagaataaatcatgagtatcccaatggttgatttgacgatggctaagttaacaaccgctcgatatacttacccatattgagccgctacaatgataagtgaaaagagggaacaagatggaaattaatgtcggtgctgtgatcagtgctaatcgtaagcaaaaaggcatcacccagcaagctttggcagattttgtcggtgtttccaaagcctcggtttcaaaatgggagacagggcaaagctatccggatattacgttgttgccgattctggccgcttattttgacgttagcatcgacaagttgatggcttatgatgcgcaactgagcagcacggaaattcgtcgcatctatacgtcaatgaagcaggcctttgaaactcaaccgggagacgcggtactgaaatcaattcgcaacttgattcggcggtattacgcctgctatccatttttgctacaaatgggactgctgattttgaatcattacgatcttttaccaggagcgtcaccgaccgcgaaaataaccgaatatgtgaatgaagcccgcctgttgtttgtccgtgtgcggcaaaatagccaagaggcgcagttaacggccaaggcggtcgaactggaaggctacagtctgctgttgctccaacgacccgatgatgtgttagcgttgctgggcgaatatgtgccagaacaactgcctgcagacagtttaatcgccggtgcttttcagcaaaaaggcgacttgcagcatgccattgcgaccagtcaaagcggcttgatgcaggacttgagcatcatcatgagtcaactgactaattacatgaccttgctaaatgatgatcctaaccgattggctgcgacgtatcaacgtgggcaagcgattgccaaggcttttgatctggcaaagcttaacccggcagtctggctcaatttccaactagctgccttgaatggctttgcacaacaggataaaacggatgaagccgtggcccttttgcaggagttcacgcatgttttgacggcaaccaaaatgccattgacgctgcatggcgatgcttactttgatgccattgagccttggctagaacaactggacctaggtagccaatcaccgcgggttagtggtcaagccaaacaggttctggctgatttcgtcttgcaaaacccggcattggctaagatcagaacactgccagcagtgcaaccgttgttggctgagttaaagcaagtgagcggacatcgctagaactcgtatgtacgggcattcagagcctaaataatttaaatcaaagcaaaccttggaggaaagaaaatgaataccaattggcaactctttgcagactactggccatttttagtgccactgatcattttagaatttggcttgatgatcgccgcggtgattcatatcctgcgccatcagcattatcggttcggcaatcgtctattgtggctgttgctcgtgattttcattcagatcattggtccgattgtgtactttgtctttggacgggaggatgaaaattgaacatcctaactttgcaacatgtcagcaagcattttggtagcaagcaagtgctgcaagatctgaatctgactgtgccggctgggtcgatttatggctttgttggcgaaaatggtgccgggaaaaccacgactatgaaattgattctaggcttggatcaagccagcgccggagccattgaagtcgctggtcagcctgtgcattttggtgaaacggagacgaatcggcagacagggtatctgcctgatgtgccggctttttatgggtacatgacggcaccagaatacttgaaattatgcggtcagctgacaggtttgcgcggcgctgaattgcagtcgcgggtggctgccatgttgatccaagtcggcttggtagatgccaagcaccgtatcagtggcttttcgcgggggatgcgccagcgcttggggattgcgcaggccttgctcaacaccccgaaactcttgatttgtgatgaaccgaccagcgcgcttgatccacagggtcgcacggattttttacagttattggctagtctgcgtggtcagactacgattctgttttcaacgcatattctgagtgatgtggagcggatttgcgaccatgtcgggattctacatcatggccgtctacaagtgagtgcgccattggatgatctgaagcaacagtatgctaaaaaccagattgccttgtcgtttgcgacgactgcccaagcgcaacaagccgcgcatttgttggcaaccttgcagcagcagggccagctgacgcaccttgagcaacaaaaaaacagtcttcaagcagcatacaccggtacctatgctgccgcggctgatcgcgtcctcaccatgttacttgaagctaaactcattccgatcacgcttgcccagcaagaagccaatttggaacagatcttcatggaggtgacgcgatgaacgcagccattattttcaccaaaaaagaactacttgaaagctggcggactcaccgcttgttgattttgacggttattttcctcattttcggcattttgagtccgctgatcgccaaactcatgccggaactgttaaaaggcggtctgggtggcattaaggtggcggtccctaagccgacttcgctggatgcatggacccaatattacaagaacatcacccagatgggcatttacgtgttcgccctcatgcttggcggttgtgtcagtcaggagattcaacaaggcacactcgttaatttggtcaccaaaggcttgccgcgctggacggtcattgttggcaaagcgattgtcgggatgttgctctggatctggatcaccagcctcgcctttttggtaacgtgggcttacaccgcgtactactttcctgatacgcgcagcccgcatgtggtactcgcgttcttaccattattagtctttggcttattcttcctcagcctgatcgtgtttggctccacactagcaacgaataattatggcggtttgctgctgacgattgtggtgatggcactgttgtatttggcacaaatggtcaaaagttggcaacatgctaatccggttgccctcattggcgacaatatgaaaatccttgtcaacagtgatgcgctaacgaaattgatgccggccatggtcattgctgtcgttgccgccgttgttttatttttcgcggcgatcaagctgctggatcgaaaaaagctttaaaaaattagccgagtttttgttgattaaactcaaacttcaacaaaaatatcggttatttttgggctatgatcaaacgatttatgaaaaagcagaagtcgtgttcacatgcgcaaacgttataacactcaggcttaccgtcgttatcgtcaagatgaatcgtgaacaaccaaataatgcaaaacacactatatagtgtatgcagtcgataattaaccacaaaatttagtggataacccgttacttttcctgctgagtcttgtatactagatacattgttacaagcacttcaagttaacgtaatgggggattagccatgatcgaattttatacgcaaatcaagaaacgagacgggcgcattgttgattttgatgcatccaagatcagcactgcaatcacgaaggcggcagaaagtgtggcaaaactggcaccgagtgacgtgctgacgatcgatcacttgacggatacggtcacggctaagattcgcgatcgctaccacgatgacgtggaaatcgcagagatccaaacagtggttgagcagaccttgatcgctgcagaaaagtataactgggctgaagcgtatactgagtatcgcttgaagcgtgatttagcccgcaaacagaagcaagatgttaattataacgtctcgcgcctagtgaatcgcgacgaaagcgttgttaacgaaaatgccaataaggacagccgggtcttttcaacccagcgggatctaactgcaggcgcagtggccaaggcaatcggcctgaaaatgctgcctcctgctgttgccaacgcgcatttacgtggcgatattcattggcatgatcttgactacaccccgtttatggccgaaaccaactgttgtctgattgattttgactacatgttgaaccatggcttcagcattggcaatgccgaagttgaaccggcccattcgattcaagttgctgtgacgcaaatgacccagatcatcgctaatgtggcttccagtcaatacggcggctgctccagcgatcgaacagatcaggtcttggcgccattcgccgagaaaaactatcaaaaacatttgcgtgaattcggcagtgtgattgatgatccggctaagctggaagcactggctgtgaagcagactaagaaggatatttatggtgccttgcaaactttggagtatcaggtgaacaccctttattccacccaaggccagacgccatttgtcacagtcggcttcggtttggggaccagttggattgaacgcgagatccaaaaagacatcctgaaaatccgaattctaggtctgggtaaagaacggcggacagccatcttcccgaaattggtctttactttgaaacgcggtttgaacctgaaaccagaagatccaaactatgatatcaaacaattggcgatcgaatgtgccaccaaacggatgtatcccgatgtcgtttcctatgacaccatcaaacgattgaccggttccttcaaagcaccaatgggctgccgtagcttcctgcagggttggactgatcccaagaccggcaaagaagtgaacgctgggcggatgaatcttggtgttatcaccgtcaacttgccgcggattgcaatggaagccaatggcgacaaggcgaaattctggaagatttttgaagaacggatgcgcatctgtaaggaaggcctgctctataaggttgaacgcaccaaacaagcaacgccagaaagcgcaccgatcctctacaagtatggggcttttggtcacaagctggctgacaccgacagcattgatgatcttttcaaaaatgggcgggcaactgtttcactaggttatattggtttatatgaagtcggtactgttttctacggctctgcatgggaaaagaatcccgatgccaaggcattctcagtttcaatcgtgaaggttttggacgatcactgcaaggcttgggaaaaacaatatggctaccacttctcggtttatggcacgccaagcgaatcgctaactgacaccttctgccgagcagatacgaagaaattcggtatcgtgaaggacattacggacaaggaatactataccaacagtttccactacgatgtgcgcaaatcaccgaccccatttgagaaacttgattttgaaaaggattatccgcaatacagtgccggtggcttcatccattattgtgaatacccgaacctgaagcagaacccaaaggcactggaagccgtttgggactatgcgtatgacaagatcggctatctcggcaccaacacgccaatcgatcaatgcttcaagtgcgggttcaaaggtgagttcaccgcaacggccaaaggctatcaatgcccggaatgcggtaaccatgatccagccacttgcgatgtcgtcaagcgcctttgtggctacctcggcaacccgaacaagcggccaatggttcacggtcgtcaggaagaaattattcaccggaagaaacatatcacgtttagcctgaatcaagtggctaatcggcgagacaagtaagccttagcaaatgctcaggttgggatagtcgcgtaacgaaaaaaatcgtccttcgtgggcgatttttttcgtggttttgtatcatgaaccttcctcgaatattagactttaacctatcgtattttgagctagacggtttttattctgttagggcgcgtgtacaattcaaatcaaaagttgtgtctaaatgaagcatgttcctgtggtgacagagtggaggtgcgccatggtagccgagatttttaccgccaaacaatggcaaacagcagagctacggagagggtctatcgtgggtgatcttttgcgaggatttagcgagcatgttgatgacgtggccatactggtttagtcatgaggatcgtaacgaagccactgagcgttatcaacagcacttgaagatcaacatcttgaaccgtgataaggacgacacctgtcagtaaaaagatcaaaccgagcacagaaaaaccaccagcaatcaaccgtcgactcaaaatcgaccagtcagcaaaaatatccaccgattttggactgatcatatcactaaaaagaaacagaaccgccacataaggccaccaaatcagctgtgcgagccattgtggaaagaatccaaataaggttgtggctgccatccctgacatcatggcaacagccgtcgtcatgaccgccatgatcatttgatgacgacttattttgctatcttggatcagtttttcgtttagttttggatcgtcaagaatcaacgtatcaagagagacctcaaatatccgggcaatacgcgtcaccatttctagatctggcaaattgcggtcattttcccaattggagacggtgtggcgggaaacgtgaagctgttccgctaagttagcctgcgtcatctggtgtgccatgcggatctgatgaagctgctttgaaaaattcatgctactcacctcgcttgggcttattgtggcaaagatggaaggcggtggcaaggtagcgggctggataagaaggcgcgttattcgagacagggtcattacccgggaaatagtgctggaagaagtcgggcaaacgaacccatattcgttcttttagctttcggtataaaccgttggcgagaaatagtatcctatgattttaagaattgcaacctttacgtaagggtgtattctattgtggttgatataattgatgaatatcattaattacataataagtgtttcgctggttgtttaaaaaagactttgaatttagttagatgaataaggagacggtcaaatgacacttgatatgaatgttatggctttctggcaaaataagttaaaggctatcggtccgcggctaacagctactgacagtcacgccaaatttattgagttattgcaagacgaaattaagaatcttggttttaacactatcgaatttccttttaaaattaatagatgtcttcaaagtagctgttctcttgagaatgattcaacaaaagaaaagataccaaatttaggaccagttccatattctggaatcaccaaagaaatgggtgtgaaaggagaaattagattctttcaatcaaaacacgatgtgaagatgaagggtaaagtggtcgttattaaagtgaaaaactttacgatccctaagcttttattaatgcatcaggttgccaagtaccctcggcatactcacattggatttagcataagacacccattagttgcagccacattgaccttaggtaaaattcaagccgccaaagataatggtgcagtcggcgttattctggtttggaaacacatcagtgaggatctcgctaaccgcgaagttctaccttttactaatagttatctggggattccttctgtttgggtatatcaaacccagctggaagccttgaagcgatgtcgtgatagaaaggaaccagtaagaacctgtctagtatcctttaagaactatcttcaggaaggccaatacaaccatttgaagactgctgttaaggtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttctcaagggatttgcaagactgatggtggactttccgggtccggttcgatcagtgacggttgatcacggtaaagagttttcctgcgatcaggcgcttacaaagcgctatcggataccggtttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctagggctgtgttgtttccacggctgagccccatctggcctacgattgctccgccttggcgctaggatttttaaattttccctgactatctatgaaaaacaaagacgactgattttccgcaattgaaaatcagtcgtcttttgtttggcaatggtgaacgttgaaacatcttaacttttcagcgccgcttgtggcgcatgaaggtggcgtagtgcagtaggcaggctaacagaacaaagaagattaccacgaagctgacatagcgccaccagaagttggtggcgatgccaggtaaaagtaactgaatgcccatcgtcgccagcgccatcatagcaatcatgccgaataataagaagtatcgtttcacggtttcatcatcctttttcttaaatatacctaatttttcaccgagttggtgggcttgattgacctttgccagtggcagtgaggtcatcccccaagtatgcggtaaaaccagttcggttattttatggacacctgctgctgtcatggctttatcaatcgcaaccaaggtcgcatcggtttggtgcgtgaacgtattgtccaagccggtggcaaaacaactggtgacactgacataatgcttgtccttgaattgcccaggcaaggtgtcacctttatgagtcattcgcgtcatgcgatggcgcatacagtccagcagttgcttaaattgaccagcgacagtgccaaaataggttggtgtacctaatacccaaacatcagcagcttttaatttggcttcgagtttatccagcgttggatttgtggtctcaggtttgtcaggatgaatttgatattgattcaaatcgacaaactcagttgtggctggcgctgcaacgccggccagcacttctttgactaagctggcggtgaggccattagcatcctgaccaccgtatattcccaaaattttcatcaaatacttgcgcctttctatgttatgtttttacatgacgtcacacttaactctaaaaaacatttgtgaatttcgcaacttagttttgttgaagaagccgactttcgcgatggccagcactttttgagttgatttgcgaattgaatcaccaaatcaagcgttttgttggcaaaaattgaaccgaatcattatgctgttctcagttatgtaaacagcgggagattaacgctgtttgcgtgttcaagaaggagcagattaaaatgacaggaatcatattgccagaagagacgcgagtggattttgtcgcgcttaaagtggcgaatttgacgttggtgagtcaatggtatcagcaggttgcgcggttagatctgctacggcaaaatgggtcaacgatttatttaggcacccggcttaatcaacaggttttagtggtgttgcatcaaattacagggctgcaggcacaacagccggtgactggcttggatcattttgccattttgttaccgaatccaggtgccttaggtgcggcttatcgcattgtggctaagaatcaaactgtaacgaccgcctttcagacaggttatcgggaaggcttcattgcccatgatcctgaaggcaacggggtcgctttcaccattgatcgcgcgattgaacagtatcaagaagaacggcaatataactgggaagacgaaacgcttcagtcgattgacccggcaaccattggcgaacatgccgctcgggaatatgatcgattgccatctggtacgacgattggttatgtccaatttcgggtgtccgatttaccagcgacaagtcattatcttgaacagggattgggttttcgcgaaaagactagccatgatccaaatgaggtttttttagcggcaggggattatcggcaccacattggcattaacttaagactggatgctaagttggcgttgccgacgccggatatgtatggtttggattatgtgagttttatcttgccagatcagcacgctatggaaaacattttgatgaaccttgatgcggcaggtttaacggattacgattataataaagacaatcaatttttgatgattgctggtcctaatcgcctaacgctgtggtttcgggtggcgtgattcgtgataatggtcagtacatcagagagaaggccagcatggattttcaagcagtgacggatgaactgaagacatggacaaaagcccgggtaatgccgggttttagtgtggcattattgacgggtaaaacggtgcagacggcggtcagtggcgaggcacagtggttcccgcaacctgcgcctttgcagccgcatatgctgtacgacgtggcatctttgacgaaggtgataggaactaccacggtgttcttgcaagcatgggaccaaggcttggtttcgccggatatgccgctacaccgattcttgccagatttcccacacacaaccacttttcgacaggcactcacgcatacttcaggactggaaggctatattccgcaccgtaatgccttgccagccccggcgctgaaacaggcgttgatgacgcaactgactgttaccgaagaagtggatcgtcaagtggtttatcgcgacgtgaatttgttgctggttggctgggctttggaacaggtatatcatcagccaattcaaacactcatcacgcggcaagtgatacagccactagccttaccgcaagctacttttcaacctgattcacaacaatgcgttccaacaacgtatagtccggcagtcgggttgcggcaaggcgttgtccatgatcccaagagcgccattcttggtaagcatagcggtgcagctggcttatttgcttcgttggccgacctagtaactttcaccgaatacttttttggcaaccgccaatcagcaagctggcccgcgcatgcggctgatctcacacaggattggacaaagcatcacttaggccgaagtctcggatgggacttgcggcgcgatggtcaaggccgactatggctttatcatactggctatacgggcactttttggctgattcaacctgatgatcaattggcattggttatcttgaccaatcgggttcacccccaaccaaatccggcttttttggcaaagcgggatgctttgatagcccgatttttaagtgatttcaaaacaatgcctgctgtataactgataaagttttgagacatgatttatagttgcaaaaaaagacgagcgattgttcgtagtatttggagtgcggaaaaccgttcgtctttcattttgttatagacaatctgctgttgaatttaaagatcccagtgccaaggcggagcaatcgtaggccagagggggcccagctgtgcaaacaacacagcgactgatctagttaggcgacttcgaaaccggtttttgggctcgaagcgccgtcactgctctagctacgcgtcgccaccccatctggccggagattgcgctttagcgcaaaaaacacctgcaattagctggcatttggcgttcattattttggcgttagccaaagccgcttcgtggaatcgaaccacgtgaaccaatagcggcgctgatcaaacattgcaacgtctcgcacattttgataagctgttcgagcgttaacacctaaaaaggacgtgccttagggcacgtcctttgctgtttattgatacgttcgagttcttgtcgttcttcttctcgtgagtaacggccgctcaccacacaagctgcatacaacgtcactatcagtaacccaaaagcgactccggctgcaatgagcaaaatacttgctaacatgacttcaccttttccttaaaactcttcgatgttggcaaaaaccctgctttggtcagggtagtttccgtagcgatgagtcttctaataagggcagaaggcctttcattcgttacttcacacaaaaattgcaactgccttcgttcctctggtgtcatagtgatctgataccggtgattgttctgtttaattgtcataatgacccccaacataaaagtgacgtcactccttcaataatttgttgaagagtgacgtcactttacattctattaattatttgtttaccgttataggctttttgtggattgtttggaaaaattaactgcatcctttaagctcaatccagcagtgaaaaccggtacttccttagctggtacttttacttcctgccctgtacgtaaattacggccttttctagccgctcgctttcttacctcaaaattaccgaatttcatgagtttaactttttcccggttttccaatgcactagcaatttccagatgatataggttaaccagcaaattgacagtggtggcgggtagtcgaacccctgcttccttcgctgagagttgtatacgatgcacaaattctttttgattgacgacagctccgctgctgctcttcttgtttaccatattgctttcctcctttctacattgattctatctgctactgactcatcgcattttgtaactaagtaaaaggcctatcaatagcaatagactgcagacgaacgaggcagattgaatggcaatggattctttcaaatagaaaatgccaatcagaatcagtgcgagttcaacaattgctacgataacaataaagacgcgattcaattgaccagcctttgtcattggcttatttctgacggtgatccaaataatgacgcctattaataccatcgataccacattaaaaatagtaagcatttttgaaaacctccaactctttcaataatctcacaattcattagcacttaaaatggtaaaagaagtataatgcatcaaccctgctttttagtgcggtttatgccaaagctgctggtgggaatcgaacccacctatgcgccagcagcaacataaaaaccccgaccgagttaggtagcagtcagggctctttggagatgattaaatgaaaaaagtttgacacagcgcgtgacctgttttccgccaagtctctggtgtccgtttatagcaccggtttcctaagaaggatggttctagttgttcaacgctttgctgatcggcgcttgcgcagttttaaaatagcaaatttttttgcgactgccaagaattttgctctattttgaaaagttttttcgtcaaaaaaagattctgcgttgctgtctgtaattgcgcccacctttatgctgcctacatcaacatcaaaaacctcggctagtcttgggaaccagtcgaggcatggagtaaagaatgaaaaaaagacttgacacagcgcgtgacctgttttccgccaggtctctggtgttcgtctacggcgccggtttattaggaatggatcgtaatcgttagtcatttatcatttagtttccggcacttgcgcaccttcaaaatagcacaaaaaccgctccctttccaaagctattacaaaaaaataagattcgctcctttccaaaatcaaacgcaatgttgccggtaggaattgaacccacgcaagccaccaggggcaacagaacccccacccgaaagtggaggagaaaccattatgcttgacgcttcttataaatcttgaaacctgcaaaccctgaaacaagtgctactaaagcaacacccaaagcagcgagtacgttatcatgcgcatcaccggtttgtggcatctttgcctgataagcaactggcttcggtgccggtgtgcttggcgtgcttggtgtaacaggcgttactggtgtttccggcgtctttggtgttgtgacatggacggtttgtcctttgtcattcaaatctgcatgagaagcaatcttcttgttacccaaatacagatcttcaaagacaaccacatcgtgaccaccgagttcggaaccatcaaaagcaaaatgaaccgtaacgtcttgaacactgaccttggcaacaaaagttgttttggctatgactggcttgccattgacgatcagggcctttccggtagccttatcgtacagctgacccttgacggtgtaagtcttgcctacaattaaaccagtggcgtgaacgacatcatcaattgtcatttgcttattcgcatcaactgattttcgaccgttgctggttgcggttgtgtgaaccatgacattttcggcattgacagctgtgtaggaaaagacctggccgtcattagctaacgtaataccatcctgctggaaacttcccgtatagccagccaacgacttggtttctttcagcaagtacgtccggttagcgacaatgttaaattgtgcattgccatccttatccgtaacagccgtttgcttgttaccaagattgtccgttagggtaaattcaacaccagctaaggctttgccattctggtcaactttgtggactttaaccgtgcctttttcaagggtgttcttggcagtgtattcgaatgtttgaccatctttagtcaaggtaatgccggtctgcttaaagctgccttggtagcctgccggggtcttggtttcttcaagcgtgtaagtgcgattggcaagcacttggaattgtgcaatcccatccttgtcagtaactgcggtcaatttgccacccaggttgtccgtcaaagtaaattcggcaccagctaaagctttgccatcctgatcgactttgtggactttaaccgtgcctttgttgatctggtttttaaccgtgtattcgaaggtctggccatcctgtttgagggtaatgccaacttgcttgaagctaccttgataccccgctggggtcttggtttcttcaagggaataagtgcgagcaccaaagattgagaactgagcattcccggtctgatcagttgtcacagactgtttattacccagatcatcagtcaaagtaaactcggcaccggcaagtgcttgaccatcctgatcaactttattgactttgatcaaaccagctgcacgtgtccacttagccttattaccagctaatagtggcttgaccacacctgtgactagtgaaatgctgtcctgatacttttgtgcagcatcattgtaaacgaccggtacaatggctttgatgttcccgttaatgtcaaacgtcagatcaccagttggggtgctgtctggaatcaacagtgagaatgcctgaccgattgtaacggtgttattggcgatcgcattgccattggcatcaacaaccttcatgccagcaacctggttcttgaagtttaagattgcggtaccggcccgattgctctgaacggtgtaagtgaacttgtgataaccttgcacgtcagttgccccttgtgctgctagggtcatggtcgtgttggcagtatcactattgttcatcacattgttgtaaaccttggttgcggctgctttaacccggttcactgcggcttcaccatatggtgcataaataccaccggcaaaatcgcctgattgtgatgcctgccaaacaatctggttccagctaaagttaccagctaaaatccaagaaaccgtttgggttgcgtaccaagcttcctgatcagtcaagccggaaatcccccagtaaccttgatcagatgcggggtgattattgaaaccatatttaaataaccggtactgcgcatccgaaccaagtgcacccttattgccggtttgtccaatcggcattggccgttcagattccaggcaataggcataattaccaagcgagtccttaaaggaatcagaaatcatgtagttcaagctgccatcagcttgccgcaccatcatgtaacccgcaccatcagtatttgcggcgaatgcaccttgactgaatgtcatggacgcaggcacgtcagtatccgccgccgcagatacatggttgagttggccgcctacaagtcccagcgcgactgcgccggtaaacaaggccgtctttagccatttatgttgcattatttctccttctttctattagttgatgattcaaatccttgctctgcttcaacaccagctcacatcagcaccacctcccaaaggcacaaaaaaacagccaatctagtcgattgactgttctaaagtcatttgaatttagtgaaaccttaccggacagctactgccatacctgtcacattaaaggcattttcaaaggtaccagcattgatccaacgggcgccaaagactggatcaacaacgtgataggcgccatctttgaagccatcaacgttgacaacatgaccattccaaacggcacgaccccaggacatttgcttaaattctggtacctcataatcataggtgatccacgcgacaactgagttaccattggtaatctggcgtttgatgccagccgttccttgaccactgatattaaccgctttagagccatatttagccgcccattgaacgactggtgttgccatcatgccttgataagtaccgtcaacattatggcgccattcaccggagtaaccgtcataaggattattgtcagctgatagtggcatactctgaacgaactgactcagattctgtgtcgtataacccttgtacagcagcccttcaagaagtgaagaaccttcacacaacatcgtattgccttgattaacaaatggcgctcctagcaccttctgagtcacgaccggttctgacggtgttgaaggtgtcgatggctttgatgagcttgagcttgattcctgactgcttgacgacgatgaaggcgtcactgcactagagctcgtgctgcttgatgaattggcattcgttgatcctgattccttgctgctggaagatgctgacgaagcacccgaattcgtggcctgcgatgacgatgaagcaactgaactggcgggttctgacggtgtggtcgttgaactttgttcattcgtcgcagaactagccgtctgacctgccgcctgcgtgacttttgaaccagaaacggttgttcctactgacttggcaggatcaaccttgtcctgttgctgaatggttgattgcccggtcactgtcccatcaggtgccatcatggtggcagtggctgttcccgcttgcgaccagtccaaggtcaacgttgcgcccgtcatgatgaagcttggattagcaacaccatttaactgggctaacttggcaaccgtgatgttggttcgttgtgagatcgcccacaacgtatcgccccattggatggtataaaccttctggcctttagaaatttggatctctgccggtttacgcgctgtccaggtcgcagcttgcacgggactagcggctagcactaaaccacttaggacggttgctgcaacggtactcatactaacaagtttggtcattttcattttaaatatctccttttgatttgattggaaccccgtcatagaaagtatgtttgatgcttactattagtgatcacgcccccttacatagtgacgccagccataccaacaaagtgcgatgacggcaattaggatgacgaaatggatcggcatcaggttcacaagtcgtcctcctattcgccacgcaaaaccacgaaatagataattgataaacgtatgtagcaaacctgtctcatgggttggtcgccatctactgaccaaagttgcaacttgattcaccctctcagctcctttctgacaacaaaaaaagcggtcatcgttaataacgtatgactgctttcattgattcgatattaagaaatagcgacagcaaacttcatgtaagaatatgccgcattaaaagcacctttactgatccagtaagtgccgttttcagggtcaacgatgtgcaaggaatcaccgttgtaaccatcgacggtcaccacatgggcattatcaataccactgccccagtcataatgatgccattgtgggctctgataattgagggtgacccaagcaacgactggattttctgcggcaatttgactgatgataccgtcgagactactaccgctgatatttgacccaccgccgaaacccgcaacccatggggtgaaagcacttgggaagatggactgatatacgccgtcaacaacagcataaggtgtaccaccaaatccttggtaaggattgccattcgatgcgattggcattgttctgaggaaactagctaaactcataccactggcatggcctttataatgcaaggcttccagcgcactagccgcttcacaaccttctggcgcaccagcagcttcctggctgatgaaggaaacacccagcactttgctggtacttggttgtgcactattactggaaccactattgctactagtttggccttgaggcgcactcgcatttgcagtactgctggatgccgctgttgctggttgactacttgtgcttgcagcctgactggaggaagctgctgtctgggccacggctaattgcgaatcaccggcagtagcttgttttttagcctgcgcggcttgctgatcgttaggcaggttcttgatcgcttcgtctaatttgggtaagtatttatccttaaatgctttgataccaacagcattaatagcatcgcgagcctgatcaattttcgtctgatctggatcgccagtcgtggctgctttaacaagtgcgactgctttgacttcgcgatcaagcaatgttgcctcgtccttaatagtcgcagcaaacttagctttgtgcgcttgtaaataagtaaaatcattgttgaatgcttaaattttgaaatcctcgtctttcaacagctgatccttaccaagctcaacattcaaggtatcttgaactgagaagattttcttggccgcgtgtagctgttgttgatcgattttgaaagtcttctgttgtgctttcgacaagtcgccccgcaacttatacactttatccttttgcttattagctttagtcaagctctcttcgctgagctgcttagcaggcatctcatacttgctgtctgcgtaaagatttcgaatctgcttggtcagacgcgtcaattgcggttgtcccacagtttttggtgctgacgctttagcctgattaccacatccggttaaaagtaacccagacactaaaatgattccagccgtttttccatcattttcatttggtaaatcctcctgattgatcagattcttatgcgcgccgcttatagcaaattgctatcaatgacaaggactcttggtgctacttcctgttgtaaggtttgcttttctttttcaattaaagcatcacgaaagtaactagattgtgaagcgttgatcttagccgtcagcttgtcgatattgtttttggtatccacgatgttctgatgaccttgccaaacattgtcggcaatggcggttgcaccggccccaaacataagtcctgctaaaacagttactgtaaatgtcaattttttatgcatgattttttctccttaatcgatctcttctgcttcaatctcaacacgtggttgatcgctgtaccatttgccaacatggatttcgactatttggttgtcgtcttcccacaaaataccggtaagcgcatctgatacagacttgtagtagttgtctacatccggcttaactgttggcctaactttgccttctttttttcgccttattaaggccttacttccagacttttggagcggacggtatatttccattgccacccttattgggccgcttagaggctcaatatttagttctgacgccacgctcttaacgtgctgcttgtagtttcttgatttagtcgggtcgtaagcatgacccattcgcgtgaacctcggccgtccttgtgggactgggttaccaggtatcgttagccttatcacgctggcttcacgtccttatgctcaatcatgcttttgcctcctcaaaatttttgttctggtaaactcacgtttagcttttgcaagtatcctcgccaaatatcgtatgtgttttggcagtaagctcgcgttactggatcagtttcttttgtcggtaaatatgcactagtttccccataatattctgactcagccgtctctaacgcatcgaccaatgtcacgtacgcccattgataccaaaacttcttcatatccgcatcggcttgttgcgccttttttaaatattccatggcttcatcaagctgcagaatgatgaacagcgagtattgataatgtccctcctgcatgtactcattgaactctttaagtgtcatagttggataatccatttcaatacgccaccttaaactgcaacgttggtgcaaaaaagttaaagccaatgctgccaagtgctccttcacgatttttagcaattgttaaagtcacagtacggatatctgatttttcattctgccggtcactgttccaaaggaatccaaccgcattgctatcttgttcaattgatcccgactctcgtaaatctgagagtaccggttgcttgtcctgacgattctcaacacctcgtgataattgactaagcaaaacaattgggataccaagctcgttggtcagcactttgaattgacgggtgatctcttcgatttgcagacggcgatcggcttggctacgaacaccaatcagcccgagatagtcaacaatcgcaagatagcctttatctgcatcagcggctctctgccgcattgttttgacaatctgcggtaattccacctgcttgtcgtaaagctgcaagtgatagtctttaaggacgtttcctgccttttcaacctcaaccttctcggcatcgcttagacttttctgcgggttgatgaatttaccagcactgatgccagtcttgcaggccaacaagcggttgtagttttctgcatttgacatttcaagtgaaaacatatcaactgtcaattccggttgctgtttcaaagcctcaacgatgagattaaccgcgaatgctgatttaccgacaccagggcgcgcaccaatcgtcaacaaacgtcctggcatcaaaccaccgcccagaatattgttaagagtgaagtacgttttaatcccattgtcagtagcaccgtgtatcattttgtcctccatggccgctgccaaatctgcaatgctactttcagttaccgtctgactggcagcagtagcattctgtgaggcaaccatcatcgcggtaagattgtcctcgcttggttcttccgagtacgcttgtgctgcttcaatgagctgactacggaaatagtcccgttttagcttgcctacccaccaatcaaagcgtgaggtgccaaaatcgctggtcataatgtattgccaatctgttactgacatcacgccaggatgagctgtagcaaaaccatcctgcaattccagcgtatcgacgtcacctggcaacttgttcatgtaggcaactactgcagcgtattgctggctgttaaaccatttaggatcaatccattcagacttgatgagttccggcttcgtatataagccatacatgacatgcggttcaggattgctagggtcataaagctttttcgtcaagcttgttgcctcccttcatcgtattcagcaatgtaacgtttagcatcttctggattgattggaataccctgcgcttggatttcttcaagcactcggtcagggctgttgtagtcgatatacattgcaatagcagttttcttgggatcgaacttaggctttcgagcttcctgctcatctcgttcttcctttacgacctcaaggtaatcgttccatgcctcttggttgaagaaagtgctaccgtctttgacaaaccgcttctctgtgcctttgctcttgattagctgtcgataagccacaatgccatcctgaatttgtctgttagtagcagggttcttctttctactcattgctcgtttgtaagcagctagtgctggcttcttgccgatcttctttggatacagtttccaaagcttttcaaagtcactctctaacgtgctggatgcacgtgtgtttttattaatacttgtattattctcttgcccgtttttgggcatagggtatacccgtttttggctataggtattaccatttttgggcatagggtctgtacgaattttgatataccttttttcaatttctttggtaccgtctttgtatttgacatgacgttcaatatatccgctgtcttctaaagcacgtagccatctttgtatagtggtttgacctacctcgtacaaagtcataaagtattgatcgctcgcccaacaagagccgctcttactgctgagtgccgtgatttcgctgtacagaagctttgctccttgtggtagctgtttgtcatagcgcacacctgctggaatgatggcatagtaactagggctttcattcatgatcgacaccgtctttgttgaagtattgatcggcaatattttggcgaacatccattaagtctgcttcgaatttgatcatgtcgagtgatgtttggcgacttcgagaccgcgggctttgcgggctcgaagcgccgtctccgctctagcttcgcgtcgcaagccccgtctggccggagattgcagagtttggcacggcaaggaagttttagcctagcaccttcccacgattattcggaatttaatgaatcacaagtcctatgagtgaattaatcttagaatgttttatcgacaaattggaatgaggcgacatcatcaggaagatcaaattcaaaaaatattttttaagaaataagattatcaaggcgtctgttatagcacagaaggcgactagtgtttctcaagtgacgcaagctttttcgtcaaaaatggtacacccgttttgatactgttttttaagaaacttaatttcaatgtcaattattcttacgcaaatacttgaaatacagtttcatatggcggcataattgacttgattcatgacatcctattagggaggggaaagatcatgtcaatatctgcttttgcacttattttattgacgatctatgtgggcattgcacaacttgatgcattgtctgttaagatcggattattctcgccagtgtttggcggggcggtaactggtctagttataggtgatctcaaaaccggcttgattgtcggcgcaacgctgcaattagccacattgggagttgcaacgtatggcggtgcaaccgttcctgactttctttctggatccatcatgggcagtgcctttgcgatcatgtcaggtcggggcgcggcttatggaattggcttggccattccaatcggcttactgctgacacaaatggatattttggcgcggatgacgaacacgattttccaacatcacgctgaccgcttagctgaaaaaggcgactataaaggggttgagcgcaataacctttacgggattattccgtggacagtttcacgaatgctaccggttttcgttggtttgttctttggctccgcggttgttaaagcgatcaacgcttggatcccagcatggttgatggttggtttgaaaacagccggaattatcttaccagcgatggggatcgcgatcctgatgcggtatttgccactcaaacgctattttccatatttcattcttggatttgtcttaatggcttatttcacgaaaacattctccttgctgggcacagcgctggttggcttcgtcttcgcggcactacatgttttagatgccaacgaccgcaagcgcaacgaatcgaataaccacggcccaagcaaccataacaatggcggcagcaacggcggcgatgattccgatgaggaggtcgagatcgatgtctgaactgaaattaaataagataactaaaaaagatctcaagcagattttcattcaaaacgtgttgggtctgcaattgggatggaactacgaaaaaatgcaaggtcttggctatgcctactctgtcatgccagctttgaaacggttgtataaagacgatcctaagaaaatgaaacaagccctgaacatggaaatgggcttctttaacaccacgccgcaaatggcacacttaattgtcggcgcggatgttgctttgcaggatcagttgggaatgaacgatgagaatgaaaaagcgatcactggtctgaaaactggcttgatgggtccgttcgctggcgtcggtgatacgattttcgtggcaatttacaatgcgattatctattcgatcaccgcatatctggctttgtcgaatcaaccaatcgggttactcattccggtcattggttgcttggtcattttatgggttcgctggaaattgttccaagttggcttgtcacaagggacccggctggcaacaacctttgctgatagcatggcgactttcacggaaggtgcttctatccttgggttaacggttgttggcgcgatgattccggcggttatcaactacaagcttgacctgacctacaaagtcggcaaggtcacgatgaatgtgcaagacatgcttgataaaatcatgccagcactgattccactagcaattgccttgttctcatactggattctgggtcgcaagcatatgaactcaacgcgactaatttttgtcctgattctgatcgggatggtgttgggcaatctgggcgccatcttcggctggatcggtagtttagtttaaaatcatgataggcgaaaaacacgggcgcgatgatatcggcccgtgttgtttgaaaggaagattctaatgacaattgtggcagcacgtgttgacgaacggatgattcacggccaagtagcgatggtctggacgaacacagttggcgctaaccgcttaatggtggttaacgatgaggtggtacgcgatgagatggcgattcaaggtttgaaaatcgcccgaccagcagggaaaaaactagcaattagctccgttgccaaagccatcgagaatttgcagaatggcaaatttgcagatgatcaagtctttgtcattactcgaaatattcccgatatggcgaagttgattgatggcggcgtaccaatcaaggcctttaatgttggcaacttgtcggaaaaaccaggcactaagaaaatcaagccttccgttgccgtatcaccagacgatattgcgattattcggcgcttattgaaacagggagtcaccatcactgcgcaaatggttcccaacgaaagtgcaacgtccatcgcaacttttattgataaggccgaatgaagacaatcttagagacgttgcagtcgcgtctgtcgcaattaagtccggtgaatcaagctttggctcgtcatgttataaccgatcctgagacttttatcgcacagacaacagcgcagattgcccacgcaagcggggtatcggccgcatctgtcattcggtttgttcgtcaatttgagtttgccgacctgcagtcgtttaaactagctctcgcacgggaaaagacgttacctgcagaggtgatgccacttgatccgctggttcaggatgacgacgacttgtcgaccatgatgcataaattaagccagactgcgattgccgcagtgcgtgatttgcctgatgagttggatcaatctgccgtgcagtcagccattacaacgctgcgacaggcacgtcatatttatctggtgggagtcagtgcttccgcactagttgctcaggatctttatttgaagttgattcgcgctgggtacgtggccatttttgaccacgacacccacacggcagtggagcgcgcttattatacgacaccggccgatgctatggtcgttttttcatacagcggtttgactaaagaggtcgtattggcggctcagcaagcgcggcgaaaccaaacgccggtaattgcagtgacacgacacgagccgagtccgttgcgtgaagcggcaagttgcgtgattgccttgccgccgacagaaccgttgttgcgaatcggtgcggtgacctcaatgttcacggagacttatgtcgcgaacattctttttcttggggtcgttcaaggtgagatcaaaaaaactgagcagaattatcgcgcaacgtcacaattgacaagtgagttaaagattcgaggggaaaaatatgtcaatcgcagacttaatgaccgagcaaagaaatccggccagcacacacatcgacacaatgacaacgcctgatttggtggcgttgattaatgctgaagatgcaaaaattgcaccagcaatcgccaaagaaaatagccacattgccgcggcaatcgatgctgccgggcaacgatataatcgtggcggccggttgatttatgccggggcgggcacctctggtcgtttgggagttttggatgcagctgaactcgtaccaacttatggtattccgccagagcgggcagtcgggctaattgctggtggcatgtcggccatgttcaagtcggttgaaggcgcggaagattctgcggagctagccgagcatgatctcaaaagactgaatttgaacgccaatgacacggttatcgggattgccgcatctggccggacgccgtatgcgatcggagctttagcatttgcgcaacaaaccaaagcgcttgcgatttcggtggcctgtgtccctaacagtgtcttggcacaacatgcggatatcgccattgccccagttgttggcccggaagtgattaccggatcaacacgcatgaaagctgggactgcgcaaaagatggttctgaatatgttgtcgacaggggtcatgattcgcgccgggaaggtttttgaaaacttaatggttgatgttttgccaaccaatgccaagttggttgatcgcgcagaacgcattattgcggccacaaccggcgttgatcaaatccaagctgcaaccttgctgaaaacagcgggatataaggtcccagtcgcaattgtgatggctaaaaccgagctggatgccgccgatgcaatgcaggtcttggcggatcatgatggtgttatcagtgcagttttggcggcttgggaggccaagcatgggcacaaataagcaaacagcttttctgccaacggttaaccaagcgataactgatggcgcggttttcggcgtgtcgtatagtctgcttggcccgcaagaaaatgcctttcatgtgatcggctaccaaggtgccggggatgaccggctgccgttgttgccgcaagcgcggtatgatctggcgtcgttgacaaaagttgtcggcacgaccacccgactgctgcagttgcttatagccggcaagttagaattaacccaacccattggctcgttggtcagcggtttgcgctacccacaactgacgattgaacaactcatgctgcatcgcagtggcttgccagcagatgtccctgatgcccatgcactcgatcaagcagggctgattcatgccgtcaaaacaatggctgctgtcgctgcgccagacactgagacgatttattcggatttgaactacatcatactcggttgggcgattgctgcactcgatggtgatttggcaacaagcctgacgcaacatatttttgcaccactgggcatgcatgcgaccggttatcgaccgcaacacgtggctgcagccgattttgtgccaaccgaaaacgcgcctgctcgcggtggcatcattcgtgggacagttcacgaccacaaagcctttttactagatggggttagtggtcatgcagggttgttcgccacgcttgcggatctgactattttcacacggttgttggctggtctgcccgtgacaaatggcgatcaagttctgccaccagcggcgtttgtgcagcttgaccgcttttgtaaaggcggtcggacactcggctggcgctgttgggcgcaaggacgtcatcaatactggcacactgggtttacagggacatcaatagcatttgatcgtgatacccagcgcggatttgtctgtttgaccaatcgaatctatcctagccgcgccaatcgtgcatggttggcggttaggcgccagttattaacccaatttttcgaggtggcgacttcatggccggattagaaccaattattcaaaaaatacagttacggccgatcagtttaccgctggtgcggcctttcacaacagcgatgcataccgtgacggcagcggatgctgttcaagttgacgttttactgacaaatggcacagttggtcatggcgccggcacccccaacgcggtggtgacaggtgatacgatgtcgaccttgcaggaaaacttgcagacacaggtgataccggcactcattggccgtgacattcgagactggaatagtttgctgacgcggcttcatgccagcacatcggagcaacccgccattgcagcggttgaattggcactttatgatttgcgtgcaaagcaggttagcatcccgctgacagcgttgctcggtggtcaacagcgaacggtcacgactgacatgacgattgggattcaagcgctgcccgatatggtgagcgaagcgaaggcatttgtttccctaagctttaaggctttaaaaatcaaagtcggtggtggtcgattggcagatgatttggagcgcgtcaaaacgattgccaaagctgcaggccctgatattcgcctgcgtctcgatgccaatcaagcatggacaactgatcaagccaaggttgcggtgaccgaactggcggctttgcagttaccgatagattttattgaacagccagttgctgcgcgcaattacgaaggcttggcaacgttgactgctatgcgacagttaccaatcatggcggatgagagtgtctttgggtttcaagatgcgctggcattactcagtcgccacgcagtcaatcacatcaatatcaaactaatgaaaacaggcggtttggcggaggctgcgaagatcgatgcagcttgcgcgtcttttggcgtgacgatcatggttgggtgtatgatcgaaagtaacctgagtctggtgccggcgattgcgtttgccgcggttcatgataatgttacgttcacagatttggacgcggtctacatggtcaaaaagcagcaaacaggcattcaaacgaacggaccacagcttacaattggagatcctatgcatgacgcctgataaactcgtgacacggcttgatcaagtgaatcagaactttgacgaaaaacacgccttgttggttgctgatacccggcatgtgctgtttggcgcgcaggttgatcaaccatttcccgctgctagtttgatcaaactgggcattgccgcctttgtaaaggaaaaagcggcagatgatcccagccaactcgagcggcaagtgacgcttccggaatcggtcggcggggcaggtattttacgtttcatgtcaccacaagcttggcgtgtgcgtgatttgctgacgttgatgctcacggtatcggataatctggctaccaatgcgctattaaccacgtatgggctgccgaccattgcagcgtggctaactcggcattatcctggtatccaactacggcgacccttgatgcaatcaacctttgatggcgataatatgatcaccgcaagcgctgcctggcaactattgcgcgctttgttaacgtcggacggcaacgaaccggcagcggatatctgtgcccaagccctgcggcatcagcaaaaccgcaccaatctgctgttagcgccgaccatggaaaacttcgtcggttggctagccggtaaaactggcgagttgcctcattgcgaacatgatgcggcctgttttgccgctgaaggtgagcgcttgtatgcggtggtgctgacacaatttgattatgatcggcagacggctatgcaatttagtcaacaggttgggcaccttattgtgcaagcttttcaggaaaaacgggatcggtttttgtgaggttgagtgatttataaaggtgttaatgattttggaaggacaattttacgcgggatacaaaagatgttagacaggattttctttgccgtgccaaactccgcaatctccggccagctggggtggcgacgcgaagctagagcggagacggcgcttcgagcccaaaaaacggtctcgaagtcgcctaacaacatcagctccaaggcccgtcgctgtgttgtttgcacggctgagccccatctggcctacgattgctccgcccgctcgagaaatattgcttggataatctggcatgacaaactcctcagtcggttttccacaattctaccagattcagcagatactagacaggttctaagacggtcgcgtggatgtttgttagtccggatcagaaagaagctttgctgttcaccttcgttattttaggtgcagttcaaccagaactgcatattacgaagttagcgggattagaccctcagcagacctacgttgagaccgacacaaacaaaatgtacggtggcgatgaattgatgcaactaggactctacacgactcccgttcaaactagtgactatacggcgcaggtacattacttcaaggataaggattaagctcagccattaaacatattaaaacttaatcatcgttaatctaaaagaacgctctggcaaataacctgccggagcgttcttttgaaatcaaattaatttttagaaatgaatgttaaagctgaagtcaatgtcttgatcagcgaggatatgatatggggcttctacgtccgttccccaactatcaatgccaccgaccccacgaacggcaccgtagattgataagaccgttcgccgtgctaatggtaattcttccatgtgtgttgcgttttctagttcagcagcggtatagggaaggcagctgaaggcgaatggtgcatcggcttggctaaatgtcaaactgaatggtgtgttgtcgtggtcagcgttattttgtgttgttgatcgcgttactgtcacttgttcagtttgcatgtgcatgccgcattcttgtgggaccaagtatggtgtgactggcagactgtcaacgtggaattgcccgtgtgttgcgccagccagccggtcaggataagtctcaccggacaaaccggtatagtcgaagccggtcgcggtagtcggcatgataaaccgcagaccaaatgcgggtagctctggcaaatcagactgaccgctataatgggtggcgatattgatctgaccgtctgctgtcaccgtataagtcactgtgacgatggtactaggaacggtcgtggtaacgaagtggtaagccagagagactttcgtggcgatttcgtgatccgtgtatttgttattgagtggcgcgattggtaacggtgtgactggttggtcgtcaaccgtcaattcgatatcttgacaagttgagaacttatcggccgcgtaccactgtgcggatttgactgaaaagccgctaccgtgatcattatcggttgtcgcccgccaaaagatgggcgtgggtgtacgatagagccactctttatcgttgacgacgagtgattcaagtccgccacgttcgtagctaaagaggtagtggaaattagccccctgtagtcctaaactcccgtcgccgtaaataacgtgtagttgattatttgtgtaagccataataatatttcacctcttgcattgctggttttggtgtccggtcggcaaacattaagccgtcaccggagaattcataatcggagtggcggtcgtcgaaatcaccgccataccggagcacgtcttggtcggtgattgggtcatgaacgaagagtgcttgatcaataaagtcccaaataaagccaccttgatacattggatacttgtcgatcaaatcattatatgattgcataccgcccagagaattccccatgtcatgcatatattcacaatctaggaaaggtttggttgggttatcttccaagtaagctacaatattttggggcttttcgtacatccgactttcaacatcagaaatgcgatcttttaattctggtgtgtagacaacgccttcgtagtggacgagtcgtgaatcatcgtgttctttataaaaagcctgcatcgccgcgatatcttcgccagcatacgattcattgccaagtgaccaaaaaatgatcgatgggtggtttttaaaccattcgtagtttgaacgggcccggtcgatcaccgctgctaaccagtgtggattatcgccaggaacattgtaagaaggctcgatagcccccatcttttgccatgacccgtgcgattcgaggttgttttcggccattaggtagataccggcctcgtcacataattgataccaaggtaattgatcaggataatggcaggtccgatcggcattgatattgttagctaacatggtttggatatcagcgcgcatatcagccatactgataacgcgaccggtgtgggcgttccattcgtgccggttaactccgttgatcaccaaccgtttattgttgacgtaaatgactttgtcatcgcgcagctcgaccgtccggaacccaaactgatatgggacgacttccaagagttggtgatcagcatcgtaaacttcaattgtcaattgatagagatacggcgtttgtggtgaccacaagtgcagttggtcgaataacatagtatcaaaggttacactgccactaccggtttgcgtttgactcgtcagtactcgcccgtcatggtctttaacggtcagcgctaaagtggctggttcgccggttactttagtagtgatgttgagctcaccacttttgagattggcatttggaactggtcggatgtccaaatcagtaatatggctagcaggctccgccagtatattgacgtcacggaaaataccagagaaacggaacatatcttggtcttcaataaaggcagcagtactgcgtttgtagacccgaaccgctaaaacgttaccttggtcctgaatatacggcgtcaaatcaaattctgaaggggtgaaactatcttcagcgtagccaataaaatggccatttaaccagacgtacagggcttcttctaccccttggaactgaatgataatacgttgccctttaaaagcatcgtcgagatcgaaggttttgaggtacgagccgacggtgttgtccgcagcgtcgctgaataggcctggtgttaattgatcttgattgagggtatacggtgggcgacggtaaattttaccttcccatgggtatagcgtgttaatgtattgaatttgaccatagccggctagttcaatatgaccgggaacttgaatcgtatcaaagtcggttgcatcgaaatcgggttgataaaaatcaactgggcgttcagccggtgtcttggcgaagttaaaacgccaagcgccattgagactcttgatgaagcgactacccgttttgaattctgctgtgtcgtgataataatggtgatcactatgtgcaggtaattggttgacccggaagacttctgggtcatctaaccattgaagattagcttgcatgaggaagctcctttcaaagttacataaataaaaaaacgcttacaattatcataaaacaaaatattaaatttatatatgtcattatagttaaattttaactaaatgacaacgactactgacaacgacaacgggcgataagaagaatttgaatcgataacgtgataaatttgtaaaacgttaccaaatcttgttctaaaggtcttttggggtgttgacaacaatcaaaaaaatcattatagtcaaacctgataaaattttagtaaaactatttaaggagggatttttcataaatactagcgacttaaaacaggagtttaccaaagcctttgataccaagccagaacgggtctttttctcacctggtcgaatcaacttgatcggtgaacatgctgattataacgggggtcatgttttcccatgtgcgattacaatcgggacatatggtgtttatgcaccccggacagatacgacagtgcggatgtactcagctaatattccagatgatgggatcgtcacgtttgatgtcaacgacctttcatatgacaaagccgctggttggacaaattatcctaagaagctgtccaagatctatgatttttgatatacttctatgtaaaaagcgagtttaagctatgaaaaattatcccagcaatattactcggcaacaatttgaattaattcgaccagctttagaaaattttcgtaagcgaactaagcctcgaaaatatgacctctacgaggtcttctgtgcggtcctatatgtcttgaaaaccggttgccaatggcgtcaagttcccggtgatttcccagaatggcggtcagtttacaactattacaaaatttggtcaactaaagctgaacctacggctgattctttattggaacaagttttaaaaaaattgtcattgctcggcgaacttaccaaggacgttcagctttaacttcctttattatcgttgacgctcagagcgtcaaaaacaccgctactgctgaaaacaaaggttacgacgctggtaagaaaatctcggggattaagcgccatctggcagttgatatcaatggctttccgcaggccattcacatgacgcgagcgaacgtctctgatcgagacggggccagtgcaatgatcgctttacatgccatgcatttacgccaggttcaaaatgtcttagaacctgtctagtatctgctgaatctggtagaattgcgattatgatttattacggtcatgagggggggatggaagaaaaagatgccgttattaagtggacttctagtttgccacaaaaggactgggaagtgacttcttatgcacctcttaaccaaattcatacgccaccgattttagtgttaatcgaaaaaagagtaaaatagagatatgcttaattttttaagtaaaaaattattttaaagaggtaaatataaacatgcaaggagttcttctcgcgcttgttccaatttttgcttggggttctatcggagttgtagctaataaaattggtggtgatgctaatcaacaaacacttggaatgactttgggcgcttttgtttttgcacttattgttttcttattccgcatgccaacgttgacatggcaaattttcttaattggatttattggtggattgttttggtcaattggacaatttggtcagtttaattcaatgaaatacatgggtgtttcagtagcgagtccactttcatcaggaagtcaattagtaattggtggattgcttggggtttttgctttccacgaatggacaaaacaaattcaatttattcttggatttactgcgatggctgttttgatagttgggttctatttctcagctaaacgtgacccagaaaatgcagttgttgaagaaggacgtaattatactaaaggattgattgctttaacttactcaactttgggatatgttatctatgttattctttttaataacttagcagtactttggttcaatgttcattttgatacactgacaattatcttgccaatgtcagttggaatgatctttggagcacttgtgatgggtcgtttcaaaattaaaatggaaaaatatgtttatcaaaatatgattaatggagcaatgtttggtgtaggtaatatctttatgcttatggctgcaagcgctgctggtaacgcgattgccttttcattctcacaattaggtgttatcatttcaactattggaggaattctcttccttggtgaaaagaaaaccaaaaaagaattggtttatgttggaattgggattgttctgttcgtaacaggtgcaattttacttgcaattgtaaaatctaaaggataataaaaaagctatcagtaaattgacggctttttttgtgagttaattttctgacaagttttctgtcagtaaaattttagagtttttcattaacgaaattcacaaaatgattccaaaaaacctttggagcactactgcgagggacagttttcttggcaaccaatggaatttgttctgctgtacaatttggaagatagcctaagaacctgtctagtatcttttaagaactatcttcaggaaggccaatacaaccctttcggataaatcaattctcttatgtttctgtccgaaattctagtacagacccgttggcgtagagccgtaaaaaaagacgaccagcaatggccgtctttagggttaaataaggttcatgacgattttaagattctgctttgccttttggttccaagcggcgctccaagaagcccagtaccaaatcagagatgatcgccattaacgcggttggcaatgcgccggcaaggatgatggcgccgccgttggttgcgttggtgccgcgaacaatgatgtcgcccagaccaccggcaccgacgaaggcaccaatggcggtgatcccaatggccacgaccagcgcgttgcgaatgccggccataatgacagacatgctcaaaggaatttcaaccatgtacagcgattgccaacgggtcatgcccatgcctttagccgcatccatcaagttcttgtcgacattttgcatgcctgtgtaagtattcttgatgatcggcagcagcgagtagaggaaaacagtcacgatgacggtattcacacccagcccgagaccaagcatgatgatcgataacatcgccagactaggaattgtctgaatgacgttagcgatgccaatcaccgtgctacttaatgtccggtgccgcgcaattgccagcccgatcggaatcccgatgatggcggcgattaacaccccataaattgagatcagaaaatggcgagcaaactgactcagcacatacgagccattattggcaagatagtaccagaattgctgccaggtatccatgttggccattagtcgtcacttcctttgaaatagttgtgtttggcaagaaacttttgcgcgaccacgttcggttcaagcagttgatcatcgacttgataattcagctcttgcatcgtcttcaggttgattttgccatctaaccgatgtaacagcggcttgagtttcgggtattttttcaaaaagctgttgttgacgacgagcgaacattgataaggtgggaagaactttttgtcatccttcagcactttcaagttgtaactgcgaatgcggccgtctgttgagtaacctaagaccgtctgcatcttgttggcttcgaccgcatcgtaaaccagtccgatctgcatcgggtagactcgtttgaaatcgaacccatacattttggtgaagtcgctataaccatcgcctttgcggttcatccaactggaatctacgcccgcgttgtaacgcgaagcgactttcttcaaatcggaaatggtgctcaacccgtcctttttggcttcctgttgggtcaccatgaaagcataagtgtcggaaaaaccataagacgggtaccaagtctggtcgtaacgctttttgaattcgcgcttaacaatcgccgtagcttcggcaggatccttgacgggattcatgcctaaggtaccggtaatgtcggtcccagtgtaacgggtagcactgatgtcagcatcgttacgaatcatcgcttgatgcaccacggtaccagaacccaggttgttgaccaaagtcgttttgtagcctagttcatgattaatgagttcggcaataatatttgccatgatctgcgattcagtactggtttgcgaagcgatccgcacagtaccgtcattaccagagccgcccagtccgggaaagccgcagccgcctaatagcaagacggggatgaggaacagcgataggagcatttttctgaatgtcttcatctcgccacctcctaggcctgttcgcttactggggtcagccgatgttctagccggcccagcagccaatcaaccaagagtgccaagatggtaaccggaatcgtcccgccaatgattaagtctggctggaagaggttcaagccgttgaaaatgagatccccaaggccgccagcaccgatgtacgatgcgagggttgcccaagcgatgacataaatggcggataggcgcacaccggccatgatgaccggcatcgccagcggcacttcgacttgccgaattgattgcaaggccgtcatgcccatgcctttagcagcatcaatcaaaaccggatcgacatcttccatgccaatataagtattacgcagaatcggtagcagcgagtagatgaacagcgccacaatggccggcaacttgccgatcccaaaaattggaatcattaaggccaacaacgccagcgatggcaccgtttgtaacatgctggctagaccgatgacaactttcgctgttttaggaaaacgtgtcagcacaatgcccagcggcacggctaccagcacgccaagacccagtgcgatggcggaaatgtagagctgctcccaagtcttggtgattagctcgctgccatgtgcgtttagaaatgcgaacatggtcacacctccttaggcgtgtcactgttagcaggcgcttccgaagcagcagttgctgaagcggtattttcggtatcgctatcagcttggtcactgtcgttatcgtcagatttgtcatcgttgtcgccccagatagtgtcataaacaacatcgactaaagctgctcgggtgacaatgccgacaagtttcttttcatgatcaacaacagggacatatttaagcccgcgtttgagaatgcgatcagcggtatcacgcaacagtgagtctttattcacatagaaaatactgtttttaatgatatcgccaacactagtggcactttgataacgtgtctcaagggattcaagatcaatgaaacctttaagatgattctcgtcatctgtgaccagcagcgtatcaacgcggcgtttgcgcatcagcagaatcgcttcggccagtgatttgcctggtgtgatggcggctgggtttttaagcatgatttgttcaacggtggtgacatcggcccgcgcttgaacaagtcggtcttgcccgacaagattttcgacgaatttgttggccggatgggttaagagttctgtcggtgtcgagttttgaataatatgcccatgatccatgaccacgattttagttgcgagtttcaaagcttcgtccatgtcatgggtgacaaagaccacggttttaccgagtttttcttgcaaattcttaatcagttcctgcaaagcttcacgagtgatggggtccaaggcgccatatggttcgtccatcagaatcagatcctgattggctgctaacgcgcggataaccccgatacgctgttgttgaccgccagaaagttcggaaggatagcgatcaagatagtcttctggaagttcaactaaatcgagcagttccttggctttttcccggcgtttttcttcgggccactttaacagctttggcacgatggtgatattttcatagatcgtcatgtgtggcatgaggccgatattctggatgacataaccgatttgccgacgtagtttaacggcatcgattttatgaatgtctttgccgttaaacaggatctggccgccgctgggctccagcattcggttgatcatccgcatggtcgttgtcttcccggaaccagacgtcccgatgagacagacaaaatcccccttatggatctcaaggttgatatgttcgaccgcgacatttccgcctcgataaactttctcaacgtccttaaataggaccattggttgttcttctggcatctgacgcgtcctcctttatttgaatacttctatattaccacatggggttaatcagattttaatacatttgggaacgggtgtttgcaggagtgctttgttagctagctcatttaaagtgatcagaggatttagcggaactaaaaaaatccacctctcggaaaaaggatgggtcataattcccgtactggactgatgattcattagattccgaataatctgggaaagatttaagctaaagaatccttcgccgtgccaaactccgcaatctccggccagatggggctggcgatgcggagctagagcggagacggcgcttcgagcccaaaaaccagcctcgaagtcgcctaacaacatcagctccaagcccggtcgctgtgttgtttgcacgcggcgcttcgagcccaaaaaccggtctcgaagtcgcctaacaacatcagcgacaagcccagtcgctgtgttgtttgcatggctgagccccatctggcctacgacagctccgccttggcactggtgtcttcataccccatcaaattattcatgaaacagaaaagtcaaacaacttatgatatttttcgcaatactacccaatacggatagttattcgcccttattcgtcagttataagttatgttcctgcatgtcacacagaaaaaccgccacctattttcaaagtgacggtttgcagatattggattaaaaatctttacttaacagcttctgccacagcagcctgaacagcctgttgctcagattgaatcaggctgacgcgactggcaatcacactggtgtccatagtgatctcccgcgtcagacccggtgtttgcagctttggttcaaagaaggccttgaactccgtcaatcgttcaggcgtgcggaaaacgccagcgatcacagtgatataggtcgtgaattccatatcgccgccaacggttttttcaagccactgccattcattgcgaatccagtcccacgcagcttgttcgccagcatggttattcaaaacaccgcggaaccatgaccgtagatcctgtggcttgatcgtgtcggcatcctcaaacttatcaaccaatttggcaatttgcgttggatcagttgtactggtcaacgcagccagaatatcagctttataactggaatctgtcgtttgcgtgtaggctttcagcagctgatcaaataagtctgcattgccaaaatgcttcacttcattttccaaaacgaacatccggatgtcagctggcaaagcaaccaattgtgcttgattagctgtaaacaactcatgtccttgcgcaatcgcgtctggattcttagcatataacgccatgctcaggatgtatggacgggtcaactgatcatcaatgctttcatcagctttcggggtccatccaaggcgatcaagctgaccagcactgagcttgtcaaagaatgcctgtaactgcttttcagcgtctgaatcaggtactacaaacttcttcaagtcgccagctacgcggaacaaagcatccatgacaatcgcgctgtggctcgcagcaaaccgcggcagcaatggcacaatattgccgtatgaattcttacgaccctcagctagcagccgcaggtcttggataatctgccgctggtcaatcgcattcagctgatccacattggctagaatatcggtcatcaattgttcatcgtactgaacaatgaaatgcgagttgttgccaacattgacgcggaatggtttgccattttccttgcgtaattgcgcatagtcgccaagcgtaacctttttctcggcaaagatttggggtgccacagcatagttgctattcagcgggatctgccactggcggccgacatctttgccagcaccaatgaagaattgctgttgcgacaaggtcagcttgccgtccaccacagctgcagtgacaactggatagcccggttgctccaaccatgactgcataattttgccaacgtccagatgcgacgccttacctaatgccgtccataaatcagcaccggctgcgttgccaaacttgtgagcttcaaagtaagcttttaagccagcccgaagcgcatcgtcgccaatcagtgctcgcaccatgacaagcatccgcgcaccttttgcataaacaatggcgctatcaaacaaggaatcgatttcggcgggatcttccacctgcacgtgaaccgattgcacgccatctgttgcatcacgttgcaaggccattggtgcttcaagggtttggaaagcttcccaaatatgccaatcaggctgcaaggcatccactgcgacatattccatcatgttggcgaaactttcattcaaccacaaatcatcccaccacttcatggttaccaaatcgccaaaccattgatgggccaattcgtgcgcaatcaccgttgccacacgttgcttggtttcgagggaggtattgtccggatcaatcgtcagcaacgcttcacgataggtgaccaatccccagttttccatcgcgccagccgaaaagtccggtagtgccaactgccaagaatgcggcaatgggtatggggtttgatagaagtcttcatagaattcaatcgaccgcttggcaatgtccaaagcaaagtctaactcgtttggtttgtgggccttggtagcaaaaacgccaatcttcacaccgctcttagtcgtggtttgtttattttgcagatcgccaaaagcaaacgcgatcagataagtcgacatccgcacggtggtgtcaaagtaatgcacaccattttcttcgcgaatttccggcatattgctgatgatcgtctcacccggctgttcgtcgaatttgatagccaaatcaaatgtcgccttggcctcaggttcatcaacgcttggaaaagcctgacgggcagcggttgtctcaaattgtgtcccaataatctgctttttgactccatcaacttcgtaataagacggatagatccccatcatggtatccgtcaatgatgccgtgtagtcaatcgtcagcgtcacctttccggattggggcaaagtgatgcgaatcgcttctgcaggatcatcaatcgtaaacggtacatcctgaccatcggcctgaagggcactcaccttcagatacttttgatgaagggcgatcgcggtttgcttcgcctcaccagtaatcgttgttttcccggtaatcgttttgtttgcccggttaatagccaagtaaagctcataatgtgccggttgaaatgcctgataaaaatgcgttgcttcagtcataatttcctcctcgaattgtaagattacgctcattatacgccaagccagacggttacggggttgccaagtatcgaaaagctcacggtgttggttgaaatcgacagacttatttcttttcgccaaaaatcggctcagcgacttaaaaaaattacatgcgtgaaaatacggttattgaacttgcgtgtcaggccgtttctcaactgatcgtgtccgcagatattaacgataattcaatttttaaatgctgctaaataacctttaagatcctcagttatttagaaattcaattgtcgattaaaagtcaattaatataatgcgaattgtttattttaacaactagctaacatactaaaaccaatttattttatttttctaatggtttacattagttttatctcaggataaattacagacatgagagaaaatgagcaagacactcgcttctctagagctgctacaactcacttttcaagattttgttttaatgactaccggaggaaataacgtgtacaaactgaatcccttttcacaggaaaaacgccgctataagatgtataaggcgggacggcattggatttatagtgccattgctgttttaggcggagctggtattctgatgtttcagccaacgcaaaccgtttttgctgatgaagcatcaccgactgccagcgcgacgacgcatgccaaaccgcataccgaaatcaaagacaaacagcccgttgccgcatcactgactcctgctgataacccccagcccagcgttgacaagccagcagtccccgcaattgaaactcagccaacatcagcggccaatcaagtcgaagcgccttcaacaaaaccggctgaccattcgaaggcagcgtctgacagccatgccgcatcgatcgtatcagcaacaccaacccctacgccaaaaactgcacctgttgcaaccgataaagttaaagttactgtgcctgttgaaacaccagcgtcaccagtcatggcgccaaccgcttctccgcgatctgcggtccaaacaaagccaacacctgcgccagccaaaccaccgattaatcaggccgttttaaccaaaggaaatgtgcaaccgctttggaatgaaaatattaaaggacaaggcatggttgccgccgtcattgatagcgccattgaaccgcatgatatgttgcgactaagcgacaacacgacggccaagatttcaaaagaaaccattgccgactttgctgctagtcacggctatggtacctatctcaatgacaagctgccttttttctatgactacaccaccaatagcaatactaatctgcatttagataatcatattcaaggtgaacaagtagccggcattatcgccgggaatggacaagaaagaccagatggccgctatatcctcgaggtcgcgccggaagcacagatcctaagcatgaaggttttgggccaagcaaaatcactgaccacaaataacgttgcccgtgcggtgtatgacgcggtcgcgctaggtgcagatgtgatttatctatcgctggtcaagactgtcgatgttgaagatcccactgctgaagatcaagcggcgattcaatttgctactgatcatggcgtccttgtcatcaaaactacaagtaacaacggtaatgccatggcgattcacggcacctccgtccccggcggcactacggctggttatatcacgacaaatgatagcacgctttcgctgacaggtggcggccttagtgccctcactgttgcttcggaaaattcagcgctgggtactaaatccgccatggcgtataactcgtcttggggaccaactactgactataaactgaaaccagatctcacgacacctggtgaaaaatccgtctcgattggcaaaaacaacgcgttagcgaccaagagcggcaccgcggctgccagtgcttatgcagcaggtgctggcttactcgttatgcagcatctcaagcaaacaactaagctaactggtgttgaactcgtcaaagctgtcaaattagcgctcatgaacgctgctacccctatgatggatcatgattatccgggcaactttgtctcaccacgacgtcaaggggctggtcaaattgatgtcgccaaagccagcggtttaacggtgacggcagaaggtaccgatcaaaccggttccgtttccttgcaacaattcgaggcagcaccaacgtttactatcacgttgaccaaccacggcacaaccgatcaaacttatacggttgtgcccggccatcccctcacgcaaacctttgacaccgcccacactaatggcatttatgctgttgccttgccaggtgcgacgctaacaactgcaacgccaactttcactttgaaagcaggcgcgtcacaaaccgtggccttcacgttgaccctagatcaaactgtccggctgcatcaagtcattgaaggcttcatctccttcaaagctgcggacgacagtcaatccatttctatgccttacatgggtttttatggctcaaccaatgcagaagtcgtctttgataatgctgctaatgaaggtcgaagtacttttacaggcagctatttgcttgatgaaaataattacccactgggcattgccgatccgctcaccttaagcgacattgttaacagtggtagttatcacgttaattgggaaaccgttgccgcctctgcaaaagacaataaagtggcattttcccccaataacgatggggtttcagatgccgtcatcccgcgtatttttgttaaacaaaatcttcaacaggtcgccgcccaaattctagacacagacggtcatcttgtccgggtcattgatcttgaaaatgacaccgctaagtcacattacgtgcaagatactaactataatacggatttgaccctgtctgatagcatgcggcgccatcctgatggtttcaaatgggacggtaaagtttatgatcgagcaacaggcaagttggtgactgccgaagatggtcgctatgtttaccagtttgttggcaccacctacactgctgggataagaaatcggcaaggtattaatctcccagttgcgattgataccgtcaaaccgacgatcacggacttcacttatgacaatggcgacatcaccttcaattacgaagatcaaggtgtcggcttcacccaatatagcgccgcagtattggccatcggattgcgaacctatgaagtccctcttggcaatgatggaactaaaaacaccggtaccgtgacctatcagctaagcgacgatcaacttgacgcgctggaaacaggcgatggcaaactgacgctgacaatcaccgatttggccggcaacagcagccgtcagacgattcaagcagttgccggcgagtatctgccagaagtggacaccacgccgacgccacaagttcgctggtcaattccgattgttcatggtaacggactcagaatggatggcaattatgaaatcagaaccaaagatgacaagtacacggttcaagtgatggtgcctaaagatggtgattatcttgtcgttttaaaagatagtgtcaccggcaatgtctatgttgaaagaagcgaccaaaccaccggcatcgctactttcgatgttgaaagcccctacttctatgccaacctagacgtttatgcgctttatgagccacaattcggaaccttcatcaaatcaccggctattccttcgctgttggttttccacgatcctgacgctggcgcttatagcaatgacaacaccaaaactgaaagctttgatgacgaagcaacggccaaaaacgctgcaacgcgattaagcagtgccgaaccattgccggggcggaaattctcggacaacttgctaagcgccataccaacaagcggtttgatgtttagcgatctgaacgacaacagcttgactttagtaggtgtcgacaaagccagtcattgctatgatgccgagcatcaactgcttcacatcagaggaaaaattaaagatccttcgcataccgacttgcagatttttgccacgccgaatccgagtgacccgcaaaatcgggcaatcctcgcagcagatggttcgtttgacgtcacggttcctttcaaatcaactgaagaaaagaacgtcggttatgccttaacgaccattaacgcaactggtcagaaagtgaccactgacggcttccttcaaatcattttagatacaacaccaccaacattgaccgtgagtgacacagatggcatgaccgttgacgcaaacggggtctacaccgccgaaaccagtgccgatatttttacccttgaaggcaccattgacgataacgttgatggctatcggctttacagtaacggcagcaatgtcctcactcagcatgctcgtgctggtttcaacatccatcaaccggcggcaacagctgaggcaggcgcaaacagaacgaacccatatgacccggtgccgtttaagcgcggatatattttgcccgttggtacgagcattgtcaggttggaagccgtcgatcaagtcggcaaccgcactgtcaaagtgttcaagatcaagaaagttgctgtaacggaaaattctgaaccgactgagtctgatctcgaagatcaaacggtgacggatagtcctgaaatttcaagcacggaatcggctaatgacggcgacggcgtgactgacgctagtgctgtaatggcttctgatgatacgcgggatcctcaaagtgaagatcgtgaagtcaaagattctgcagaagatgcctttgtagaacatgtcgttgacgaagatttagttgaaaaagctaaagatgacttagtcccagatggcggcaacgacagtgaagagacctcttcctcggaagcagtccttagcgaagccaaagaatctgacgaaaacattttcccagacggagataaagatgttgaaaacgatatctcggcagagggaatcctcagtgaagccaaggaacctggggatgagacaacttcggatggtgatgaagatacttcttttgaagcggtccttagtgatgccaaaatgtctaaagacagcgtgacttcaaacgaggacaacgatgctacaagtgatatttcttcgcaggaagcccttagcgaaaccgaagcatctaaaggtgaagtggcccccaatgatgataaggcaattgaagacaccaatgatgcgaaatcagctgttgacagtatcgaagacgctcaaggtaatgtctcttttgatgacgctaccacccctaaaaatgattcatcttcagtagtgactgacactgaagtcaaagataccctcgtgaaaacagcggttctcaatgacaaagtgcctcaagatagcagcgatatcaacgaagaaaaagctgctaaacctgagacttcttcgcaagcggtcattcatgaagctcatgattcagtagccgacacagactcaagcgacaaagctaacgccagtgataccgctctgatagcaatcgcagacgagaagatcgacattggagctgccttcgcttctgttttaacagaaaatgggaagaaaaaaatgcctagtaaagagggcattaaatcggcaattacagaactgaccactgaaccaaaagctaagagagcatttaaagacgacaaaaataatgaaaaggaagtcagtgcgcacgctgccatcaaaaccgaacgaaaggattcctttgaatcaaccgctaatggtggtgacgaggatgctccaaagatcactgtaccaaatgctaccactgacaatgacctagccaccaaaatcaacgcagccccaacacctgccatgagtaccagaaacgacgctcaatccggtgtcagctccaagttgccacaaatggcgaattcgcatcgtaatgccttgcaaattctaggggtcatcatcatcagcctgatgacaacgctagggatagttgtcactgataagaagaaacgcgagaaaaacaaggtcaattcttaaacaagggaaagccgtccacaaaaactattgtgttcagtattccttcaacctcagccaagagaaaatgctaattgctggaaacagtacttagcattttttcgtaacggtgagcctgatattgaacccaatttttgattgaaggcattgatttttattctgtctgattgaaagtttttaaagttcgcgcaacgcctgtcataaaacaagcgtctgttcatcgtgatacgcatatggtatccatctatatcacacaaataatttagttgattcgtttattttatgattatccatcgttaaataaatctagccatttcgttaaacacctatctgaatatttttataattgtttaattattcacctcctatagtaataactaaattaaacgttaaacctggttaattttctatgccttatgattgacattagttttataacgagttaaattacaaacaaggattcactggatcacttattgacacacatatcgctgatggcgccggttactaccgactgctttaaataccattggaggaaataaaaatgaacagagtcaagccattttcacaggaaaagcgccgctacaaaatgtataagtcagggcgacattgggtctacagtgccatcgtgacttttggtgcagcgagttttctgatgatgcaacctgctcaaggtgtttctgctgatgccactaccccaccaacgacaacccaaacaaaatctaatcaagcagcgccagacgcgacatcggctgactcacccgtcagcaagccagcatccacgaccactggacaagtaacgtcctcagccgacaccccaacaacaacagatgcaagttccgcgcctacagccactgcgaagcctgctacaccagcaccagtagcgtcacaggctaaaccagaagcatcagctaaggcaaaacaacctactcaaacgacatcggtcaccccctccaccccgacaacaaccaataccaaaactgctcaaaaaacagttagccagcccgcacaacaggcgccagcagccccagcaaaaccagctccaacatccaacccagaaaacaaagccagtctaactaaaggcaatgttcaaccgctctgggatcaaaatatcaagggtcaaggcatggtggcagccgttattgatcaaggtgttgagccacatcaagactttcgactcagcgatgccaaaacggctgcactttcagaggatcaaatcaaagcattcactgcaagtcatggctatggcgattatgtcaatgaaaagatcccattcttttacgattacaccaataacgtcaacgaaaatctaaaatttgacacgagtaatcacggtcaacatctcgctggtatcatcgctgctaatggtcaacctagtgattcaaagaaatatgtaactggaattgcgccggaagcccaacttctcagtatgaaaatactaggcaagtccagttctgactcactcaataatgccgcgcgggccatctatgatgcagtggacttaggtgcgaatgccatcaatatctcctttggcatgggcgtcgatgttgatgatcctaccgctgaaggacaggcagccattaaatttgcaaccgatcatggtgtttttgtgacagtagctaccggcaataatggtcacgccggtggtatttacgacaagtccgcttcaaatggaatcacaaccagttatcagcctgccaatgcttcaactttgactacacctagcgcaacgccatctgctatggcggttgctgccggaaacgatgttctggatgctaaggccgctttgatatccgcttcttcatggggaccaacagcatcctacaaattaaaacccgatatcacagcacctggtgaaaaagttgcctctaccttactgaatgatgaacttggaaaagtgagcggcacttcacaggcaaatgcctatgttaccggtgccagcttactggtgatgcaaaatctgaaacgcagtacaaacttaactggtgcgcaactcgtgaaggcagtgaaactagccttgatgaatgccgctaacccaatactcgatatcaattaccctggacaaatcatctctcctcggcgtcaaggcgcaggtcaaatcgatgttgcaaaagctgcaaatttgacggtcagtgcagaaggcaccgatgatgccggttctgtttcattacaacaattcaccggtagcaaatcattcgtcattacgttggaaaatcgcggtaccgatcagcaaacgtacacgcttgatcttggccaacctgctaccgaagtgattgacaccgccaacaacaaaaccgttcatgatcgcacattgtctggtgccaccctcacaactgctacgccaactttcacgcttgatgccggagcatccaaaaagatcacctttaccctttcgcttgatgacacggttaaattaaatcaagtggtagaaggctttatcaaattcaaagccgccgatgaccgtcaatccatttcggttccttacatgggatattacggttccaccaatgatgaggccgtgttcgacaagcccgcaaacgaagaaagcagtatctttaaaggtggctaccttgtcgataacaaccacaatccattaggcattaccgatccaacatcgctgagcgagctagtcaataacccgacgaatggtttcacttggcaaacgattggggccaaagttcagaacaacaaagtcgctttttcaccaaatggcgatggcatttctgacaccatcaccccctatgtcttcaccaagcaaaatcttaaacaagtgattgcacagattttagatcaagatgacaaagtaatgcgggtcattgatcaagaaactgacaccaccaagtctttccttgaggtcggcagcactaccaatgctgatcttgccaaatcaatctcaatgtttctgaatcctgataagctcaaatgggacggtcaagtctatgatcaaaccaccggtcaaatggtgcctgcaaaggatggtatttacacctatcgtctgatcggtatgacctatacaccaggcgaaaataacatgcaaaccatgagcttaccagtggccgtcgatacgattaaaccgacgctatccaatttggcttactcagacggcaagctaacggctgactatagcgaccaaggcgtgggtttcaccgcgtatagtcaagccaaactcaccattggttccgcaacctatggcattcctttaaatcacgacaatcaatcaacctcaggaacgttaagttatcagctaagcgatgaacagcttgtccttctgaaaaaaggagatggcaagctcatgctgaccatcacagacctcgcaggtaatcgttctgaagcttccattcaagcaatcaatggtgaaaataaggaagttgatccgccattcatttggccgcaagtacgctggtcgcttccaattggcactgataacatcatccgaccagatggcctctaccaagcggcaaccaaagacagcatctatacggttcaagcgatggtgcccgcgggacaagattttatcgtcaccgcgactgacagtaaaagtggacgcgattatttaggaaatcttgataaaacgaccgggacagtcacttttaaagttgatgcgactgggtatccttatgcccgccttagcatcactgcattagcccaagatgggtttggtgatttcattcaatcacctagtattgctgagttcgtcatcttcacttccaaaaaatacactggatactctaacgaaaagactaaaaccgacccgtttgatgacgaagctaccgtgatgggccgtgccaaggtgatttcgggtgccgactattcaaaaccaatcaccacaaagggaaagttcatcaacggcattgcatttcttgacctgaacaataacaaacgaacattggtaggcattgacagcgccagcactttctacgacgccaagcttaagaccctcacgcttcgtggcaaggtatctgatccgaaaaacagtaagttacgcatttttgtcaccccgagacaaaatgatcctcaaaatgaagtgacgtttgcagcagatggttctttcagtatgaccatgccatgcaacccgactgaggagcggaatattggctatgtcctcacaactctcgataaagacggtaaagagaagaccaatggcggcttcctgttgctttatatggatacaaccttgccgacactggagctttcagatgctgattcaatgaaaattgacgatgatggaacctaccttgtcaccacggacgctgacactttttcaattaaggggagtgtgactgacaatatcggcggctatcgtttgtatagcaatggtaacaacatcttcacgcagcaaaatctggcgggtttcaatgcacatcaatcttcggccacgccgaatcaacttacaaacgggtacaacccatatggtgcagcatcatttgacgaaacctatcaattaaccgatggcctcaatatcattaccctgcaggcagttgatcaggttggcaacatggtaacgaaaacgttcaacgtcactaagataccaaaacttctcaaggaagaatccttggatgaactagaaattactcctgaacaacaagatcaaacacccaagaatgatgcaggtgaagcaccggtcacaacatcatccagtgatgaaaaaactgaggtgacgccaagcaccgaaccaacgatggtcaatccggaagacagcaaggttgaaacaagtaaccccgttgtcgaaatagatacatcaaaggaagctcaaagtgacggaaacgatgacacggcaacaaacacaccagcatcagtaacaacaggtgttgatgaaaatccagttgataacagtcctaatgcagccacaacgatgccgaatcacgctaagggcgttgattctgacgccgaagccactgaagcaacaaacaccaaggacaacacaccaggaaccactgccccaactagcactgatccggcgacggacaaagagagccccactaagtcggaagttgatccaacagtgacctcactacctgacagtcaagtagttgagaccgcaacaggaaccaccgtcaatgaggacaaagacaacaaaactgatgacgacgaaccaactgtcacaaacctcacgacaagcaaagatagtgctattcaacctaaatccgatccagctgcaagttcgcaaagtaacgacaaagctgttgaagcagccatggaagatagcaaagccgaaaatgataaaggcagtaaatctgattctgctgaaacgaatatcgccccgactatggccaaaaacagtggtgtaaagtccgaaatagatttaacagccatcgcgccacgtgataacacggcgacatcttctgggactgcaacggaaaatgccgatgtcaaagataataagggtaataaaaccgatactgttgaatcagctgttactgacacagaagatgacaatgaaggtaccgttaaatcagaaattgaatcagtggcaaccgcgccaagcagcaacacggccacagccactgaaataacaaaggaaaacacaccaaccgaagatgaaaaagacaatcaagtcaatgtggttgaaacaacggtcactcatccgaaaccgagtaaagatcgtgccactaagtcagaaattgaatcagaggcagccgcgccaagtaaaaccgaggtcggtgaaacagtcgcggaagacgccaaaggtgaacatgataaaagtaacaaatccgatgatgtcgaaccaaccgtttcagacccgaaaacagacgaggatcgtgccattaagtcagaatcggacacatcagcaatcacaccaaacaaagacaacatcgatgaaacaaccgtggaagaggctaaagccgaggacaatcgagaggctacagctggtgccattgcaacagttgccgcagacccgaaggcaagcgaagataattccgttaaatcggaaatggacgcaacgacaatcgcaccaattgataacaaggccattgaaacggtcacggaaactaccggagtcgaaagccataagtccactgataccgagtcgcctgtcactgacccagcaattgacaaagatcgtgccgttaattccaacatcacgccagccacagcctcaccaactgctgacaaagcgccggaagccacaacggaaagcgtcgatgtcgaaaacaccgagagccatcaccccgatatcggggaaacatccgtcagtgactcacaggctggcaaagattctgctgctgagtccaaaattgatccaaaggcaaccccatcaagtgacaacacaaccactggatcaacggtcgaaacactcacaacggggagtgagcaaaacagccaaattaacacctcgaaaacaaccgtgacaccagcaactgacgacaagaaggttccgtctgagaccgtcgcaccagctaaaacaagcgacgatacggcggagttcggcactgcaacgacaacatctggccaaaacacgctgactaaaactgaattcgagagctcaaaccacgcaaccaatcaccctgacaccacggattcgtcaacagacgcaacattgcaacccgacgaacctactatttcgattgaagcaactaaaccaacgccttcaaccgaagacaatcccgtccaaccgaacgttgatcaaaaagtaagcgaccaaaagtcggacaaagataaccaggataatccgactgctatcgagaaaaatccgaaatccaaagtgactgatgacgaggaaaccatcagcaagacgcgtcaaaaagatccgaaatctaatatagttggaaaagaggatgacacaatccttattgttcaaaaaggtctcaaaacagaaactgttaaggatgcggaacccgcctcgcctttggatcaaaaaacgtcggctctcaaacaaaaagagtcaaaaaaaaaaacactggcaaaatcagtccattcaactaaagcagctgccaaagccctaccaccaatggggatgcaaaacagtcattggttgcaagctctaggcatcgccctccttggtatggtctttgcgctaagcatcggcctgacgagcaaaaagaaacatgaaaaaaactaattgcaactaatcagccagttagcagcatcaggacaaatcaccgaatcaacaaacactaacaaagagcttcatgccagcagcaaccggcatgaagctctttgcttgtctatcgcacaatttccaatcgccgccttaccaccactaatctcgagcactaaagcaccaactagctgtcaaactttttccctgtcatccccgaaccggtcgacttttcaaactcagaaaactgatcgctaaaaatagtccagctagcagcatctgaatccagttgtcagacattgcccgatgacgcatgaacgtcatgatattcaccgcgcctaaatagcgataaccgatacacaatgcaaaatacgctgttggcaagagatacgcgactgccagcgatcgcgataagctgtaactcaaaaccgtgatgctcccaactaacaaaattttgacgacaaagtcgaaccaaagtatgagcagattgaccccaacatttaaaaaagcataaacgccgatcaatactgtggccagcatcgccagtaccaccgcataccaaatgaatcgcaacagataaagccaccatagttgcgtttgcttgctattaatgactgcgccaatctcgaccgtttgttctggtaaaaacagactgccaaaagcaaaaatggtcagcagtggcagaaacaactcacccggcatggcggcttgcgctaagttacttggtgtcatcgtaaaaacaaccggcatgagcaggccacacccaagcacgatcaaactagtgctgcactcgttggctttgagttctaacccgaccaagcgtttcaaagttgatggcatgaaattttcctcctcgttgaagatttaacaacaccacagctaagcaaataaaaccaatggcgagcgcggcataggttaaccgattaaacagtaattctggtagatgagcctcatagtaggcaacgttatgcagtgaattatgtcgcggtatcagcaaccagccataattgccagcaacttgccgcgcaccaatcatcatcgtgctcaaccaccaaccaatctgcaccacgaatccgagaaaattgccaaaaagcgcatcacttaaaaagcctactgcgctgctaaccatcactgttggcaataaccacagtccggtcattttgaagaacgcgagataatcgatttgatacccttgataatgcagagcgatttgaatggttaggacgattcccatcaaaaaaatcggcatcaaaagtgtcacgagacttgctaagtatcgactgcctactagtcgccaagtactggtcattttcgattgcagacttgtcgttgcacgacttcgacgatcagcataacaataagcgatgacgacaacggtgggtagaattcccatgacaataccggcgtaatcggcaaatagtcgggcaaaggtaccactgatacggtcttttttgagaatcagattgtgatcttgccgtgcctcggcttttgtcatcggtcgcgacgcaaacccctgaatgttctgtgaactgtaagccgattgtccgccaatcaacctgtccacctgtcccagtgctttcaccaatgtggcttgtgtctctgtttggttggcttgtgtcagtaaactacgaacgcgggcctgatctgcctttggtagtgtcactgtttttgcaaaccccaagggatacgtgacgtaagtattgtgctgatagtcgtatcgtaactggccaacgccgtttgttttgcgcgtctggaagtcggttgctgtgatatcgtcgtagctattagttgatgtcggcaacgccgccacgtttcgtgcgagcattggccccatatttaacaacacaaatgccatcactaataaggtataaatcgtgaaagtcaggctcgttgtttgccgtttgacctccatccaaaatagtttcataagaaggcctcctcatgcttcatctgcaaatatagataagcctcctccaacgttggcagaacttgcgcactggtattgatctgactggcagctaaaaatctcaacttaaccattgtcccatccgttacttgctcagtaatccgacgatgccgtttaaactcgtttaactttgccactggcacttctttttcaaacacgtggccatttgccgccaataggagttgatcggttgtgccattgaacaaaagccggccttgatcaagaattccgatcgtattggtcgttgcctcaatgtctgacacgatatgcgtcgatagaagaacgatgcgctcatttgcaaaatctgtcagcaaatttcggaagcgaatgcgttcttctggatctaaaccagcagttggctcatcgacgattaaaacttttggacgattgacgagcgcctgtgcaatccccaaacgttgcaacatgccgccagacaaagcttttattttagtgcgggccttgtctgctaaatgaacctcttcgagcagatgttgaattcgctgaaattgatcccgtgctgggacattggctaataccgcaagataagtcatggcatcgacgactcgcatgttggggtaaaagccgaatctttgcggcaaatagccgatttgttgacgaatcgcttttgccgctttgatcggcaccccgcagacttcaaccgtacctgctgtcggctgctccagcgtggtcagaattttcatcaaggttgatttaccagcaccatttttgcctaacagcccgtacatccccgtctcaatttctagcgatacttgatcaagcgccggcgccgccttgccgcgatagcgtttggtgagcccttcgatgttaatcttttccatgaaaaaagcctcctttagcttacaaggagaccttaacaagcaattcacaagattctgacaacaatactttttttcagcatttttctgacatcgttggtaacattagcttttggcgctgccgtcaaaatagccgaaaaccgctgtcgaacaaacacccgccgcatgtttacggttttgaattttaaagtaaccgcgatgtgctgcacatagttgattgcagatatacatgcccacgccaaggtgatgcgctgctttatcatttgaaaaataaggcaatttgaccttgcgttgctcagttgccgttaatggctggccatcgttgcaaacctgcaaggtgatttgctggtcattgaaggcgagatgaatccccacctttgccttagcgaaccggagggcattattgatctggttatcaaacacctcaaggatagcgtctggcgaaaccgataacttgttgtctgtcgaccgtgtgctatcaacttgccagtcaatcgtcttggctgttggtaatttatccacttctgaacgaagctgttgttcaacctgtgcttctgtgattgcatgatgattcaaccgaatattttgaatagaggtcacatgactcatcgttttgataaagttgttcatccgatcaagctgtcgctgcatctcgtctagtaaatgttgatctggtggctggccttcttcattgaacgttaacaattccagatttccctgcaagacagttagcggcgtccgcagatcatgagcaaacgcggcgttgacttgtttttgatcatcagccaattgccatgcggtttcgagcgccttgcgtaatgcttggcgcatttcctcaaacgcggctactaattgaccgagttcatcatcagatgtcggctgtagtgtaaagtccagatcctgcgtctgaatatgagtaacaccatattgtagttgatccaacggcggccccaatttcacacgataaaaaagtctggctgtgacattcatgactgcgtatagcatggtaaaactaccaataattgccccaccaaagtataagctcatcccgccaatgaaccagcgcttggccaaggcagttgcaattggcatcatcaccacatgccaaatcagcaagtagaccaacaccaccaatgcagcggcaattgtgccgatcagaatcagatgcagcaaagctttttttattggcaaacgcgttaggcgctgctttaacttgtccatttatagcccactccccaaacggtttcgattggtgaggttacttgataccgatcaaaaagaagtcgaatgcggcggatatgttccgtaatgactcgatcatctccaagagcgtcataaccccatattttttcataaagctgttcacgactaaagacttgccccggattcaggcttaacagctcaactagttgatattgcttcttttcaagacttaaaacttgatcgccaattgacacttgtttagcgcggtagtcgatgagaatctgatcaaaaatcgccatccgtgcacgtttttgcggttggctttcccgtctaaagtgggccttaatgcgagcaccaagttcagcaagactgaacggtttcgtcacataatcatcgccgcctgcaccgagtccacgaactttatcctcatcagtcacccgtgcggtcagaaaaataattggtaccgatgttatcgcccgaattcgttccgccaacgaaaagccgtcagtatcaggtaggttgacatcaagcaaaatcaaatcaggattattggtcagccgttgcaacgcacccgcgcctgactcggccgtgattaggttaaacgtcggaaggcgggcagcaaaataacgattcaacatccttagaatatcgatatcatcgtctactgcaagcactgtcccgcgaagcctttcatcacttagcatcagctttgcctccctgttgacaacaatttattcatggaaactaactagcattctttttgaagaatattttccttcgttatgcctactgtacccgctggcggaatcgcttgcaacacgttcaaacagctggcggcgtcaggctcatcaaaagtagcccgtgcaaactggccaaaaacccacacaaaaataccgataaatcagtttttctcgactcatcggcattgaaagtacccgcttagctttgtcccatcaactcagattgacattgatgatagcatcaatctaaccgcgatgtttaatagcgaatacggaatgttttaggcgccacgcgataaatcacgatggtgcccgccaccacatagatgcatgtgatcacctagattgcataattaaagttaccacccagaaaatgtgaaaaaagacctgtcttgtcgctgatgttgttaggcgacttcgagaccggtttttgggctcgaagcgccgccacgctctagctccgcgtcgcaagccacatctggccggagattgcggagtttgacacggcaaagaattttagccctaagtttccgctcgattagccgtcatcatctaaaccgcccaatcgcacaacaaaaaaacggcgaaccccccatatcaaggaaagcattcgccgtcatcaaacttatttcaaatcttcaatactattaatattcttcatatacttcggcactgccaagccgacctttgcaccatctaagttcacgccaagatcaacaacttgattcttataatcagaataaagttttgctgacgtattcggtaaccaagcagaaacctgagcatcggcagctttagttgcaactgaagcccaaactggttgtggttccattgcccgaatcgtcacgttataccctatttgccgcaaaacagttgcaacaacattggtggatgcgatttccgaatcccacgcaatataggtcatcgtcagtttaggcttgccgctaacatgcgtcacacccttggtccactgtgcgatttgttctgggtgcttcttaacgaaagctttggctgcctcggcaggatctttgccgccgttgaccgccagcatcacactggacatttcttcaggcgtccagtggaactgatctaatacctgataagcttgcggtgcatcctgcttaaggcccttccgcacgattgtatgaatctgttcggttttgccgtaaacatttttaggatccttgagaaactttagtggaaacttggtgaacatccagtgcggcgtccagccagtgaccacaatcggacgtttgtcggcaatcgccttttgcaacgtactggtcatagcggcggtggaacttggttgcaactgccactttttatccacaagaccataagctttcagcgctttgtctgtactggtcatgaccccagcgccagcatcaatcccagtaatggtgtaattgatttgcggtcccagcggctctttagcgtcatacttaggctgtgtgctgctgcaggcggcaagtgcaccgactgtgatcaacaccgctagcgccgcggcaatctttttcaaaaaagtcaaacggccacctcctaacgactacgattgagactttgcgtgatccggtcaagaatgatggccaaaatcacgatggcaagcccggcgacaaaaccgccgccagcatcattacggccgactgcaaagtaaaccttcgtacctaagcccatcgcaccaatcatcgaagcaataacaaccattgacagggccaacatcatactttggttgatcccggccataatggttccgcgggcaaacggcaactgcaccttcaacaattgttgccaaccagttgccccaaatgcgaccgctgcttcatttaaatccgctggtacttgcgtaatgccaagctgcgtcatacgaactgtcggtggcatcgcgaagataaccgaggctacaaccccgggtaccatcccgataccaaagaaagcaacggctggaatcaggtaaacaaaggccggcatcgtctgcatgaagtccatcaatggtttcaccactgcggaaactgacttgctttcggccgcccaaattcccagcggtaccccgatgacaatcgctaacaaacttgcggtcaacactaaggttaacgtttgggtcatgtcacgccagaaaccaaggttccaaatcaacagtaaaccaagcaattcaaaaatcagtaagctgcgatatttctggtcgcgttttagataccaagttaacgcgagtaccaggatgatgaataaccagatgggaataaaatcaaagacagcttggaaagcattcacaatgccgccgatgaagttcgttaaaaccccgaagaagccggaaaactgggttaaccacgcaacaaatgaatcgacccagtgggccaatggtaatgtgggaatgctgattaaaatgttagacattgacattgacctcctgtccagataatgcacctaagacggcaccgcgaatgatgatcccgcgtaagcgatcatgatcgtctaccactgcaaatggtaccggtgtggtggaaacagcgtctagtaagtctgccaacggcgtatccattttagtcgttggcacatcggacttaacaattgagcgcagatccttttgaccagcatcaatagctgaccgcacgtcgtcagcatccaaaatgccgacgagtttacgtttagtatccacaacatacaaacttgaaatttcattgtcccgcatccgccgggcagccaaacgaggaccatctctatcaatattgactgtgttggcccgaatcatcacattggcagccgtataaacctggctgcgatcaacaccttcaatgaatttctcaacataatcgtcagcaggctggctcaaaatttcttcaggcgtgccaatctgaacgatttcgccatctttcataatcataatgtgatcgccaattcggagcgcttcgttgaggtcatgcgaaatgaagacaatggttttttgcatatcttcttgcaagtccaataattcatcttgcatatcgcgacgattcagcggatcaagtgctgaaaaagcttcgtccatcagcagaatttcggcatcgctagccagcgcgcgggctaaaccaacacgttgctgcatcccaccagacaactgatctggatattgatcggcaaaaccatttaagccaaccaaatcgagtgctttgttggctttcatctcgcgttcatctttttccatcccttgaatctcaagtccaaaggcagcattttgcagaacggtccgattcggcagtaaggcaaagccttggaaaaccatgctgagcttttgccgtctaacttcacgcaatgcttgcttatcaagtttggcaatgtcatcaccgtcaatcagtacttgcccgtctgtcggttcaatcaaccggttcagcatccgtaaggtcgttgatttaccagaaccggaaagtcccataatcacaaaaatctcaccggttttaatcgaaaaatcagcacgatcaacaccaaccgttgcgccggttgcttttaaaatttcaggcttggtcttgccggccttcaacatttctttcgcgcgattcacgcgcttaccgaaaatcttggttagcccgcgaacctcaatttttgtctcggcattactttcaactttgtgttgcatctactcactccttgttttgaaaaacgtttgtcatcgaattgaaacaatgctatccattctagagatagtttgtgtgtgattcaaatcacggaatctcattttcattttcgccgccattaagcgccacatgacgttctgtaattaatgcgcacaaaaaaagcccgtatccgcatgaggttatgggctagggacaatcagcgattcgaattttgagagcttctctgaaagtcaaggatagatgaaatttagatgggatctttttcattattcacaagctgttaagattaatctctgaaaaaggcaagtgttcgtcgaatggtatttcgttgcctaatgtgatttgatctgggccagtcatggtgtcataagccagcacgcgaacgccattttgtttagcagtcgagatggcagtcactagttcaggaaaacggtcccgataaatggtcatttggcgaatatccggtaattgcacgatgaacaataaaaatgcctgatacccttctgcctgcgccatcgtcagcgtatggacatgcttgacggcgcgagttgttggcgcatctgggaaagctgctagggtgccattagccaacgtgacccccttcgtttcaacaaaccacgactggccatcagcggcttttccagcaaagtccagtcgcgaatcgcgccaagtcgattctggatgaacggcgtatggcaaggcgagtcccggcaattttaaggtgccagcttctaaacattccttggcaacatgattgggtgccagactgtcgatgttgatccagcgaccttgccgttgaacagccagcaagtcatagtgcgttttgcgatttgggttatcaacatagcggacactggctaatgatcccggaatcaaaatttctttattgcgtccggtattattcatgtggacaggttcgacggtgccattcaggtcaatttcaacggtaaagcgactcacccgtttgatgagctgcccgacgctgacattttggtagtacatgcgttacttcctccccttgttgggtgttggccgccatgaaaatagcagtcgcaacgatccatgaagaatcggtacgactgctcatttttgctgcacttgaccgaaatcagcgaacgataatcaccgagaccgatgcatcgcgagcaacttcgctcgcaacatgaccaagacgtaaccgaccgcggcgaacatgagaacccatgatcaccaaatccggtttgaaggctgggatcacttcgtcaagaatggcagctgctggccgcccttctgcaacgatcggttgtgcgttttgaacgccaaatgccgttgctttttcgacgtaagtgttcagatccttagccagtgtttcccgggccgcatcaacatcatcaggtgtcaatgattggaaaatattgaggtcgccggtttcaagtaccgacacgatccccaacggaatgtcataaatcttggcaaccgtgcaggcgtagttcaatgccttgcgcgaggagtcgtcatcatcatcatcaaccgccaataacaaccggttataatgcatggattcaatcgtcaaatcatcttcagtaaccaaaagaaatgcccccttgcaagtttaggtatccctaacaatgtcattttatcacatgtcgcccttattttccgcaaaatactgcttaaaccgaccaacataattatggaacatatatttcatcaataaccagcgcttgaatgtcatgtccggtttataaaagaccgtcgtaccatagcgtttctctttaagtaactgcaaggcttcctttttagcttcgttatctgcagaatactgcttgaaaacacgctctggaacccctagccacaatttatacttgctgtggtcatcattaccataaaccgttggcgcgtccttcaaatctcccacgatgtaatcgcgaacaggccagctggcgagattatacccatttaaagtgacgaaaaagctactccggccttgacgaatattaatttcaaacagcttgaacgtcttgtcacgatgatcatacttcatatcaaagttagcaaaaccggtgaacttaattgcttcgaggaatgttttgatctgatcgtacaaatcctgatcgaaagctggcatgatcgcgacatagttaccgattgaagaaggcgtaggatcctcaagtagcggatgacctaagcacatcattttaacgtgatgatattgatcaacataacagttcaaagtccgcatgttactgtcatcacctggtacaaagtcctgcaagatgagatcagacgtatagccgttatcatagattttggcaatcgtattcgtcagttcaacttgcgagtgaatcgtaaacgcctttttgcggccttcaaagcgaatgttcaaccattcaacggaatcagtcggcttgagtgctactggaaattcaaacggtgccgtgatggttgcgttgctttcatacatcgacttggtgacgattttggttgccggatatggcaaatgatactcttcgcaaacttgatagaagctctccttactattcagacgcttcaacaattcataatcaacatatgggcagatgaaccactggctcaactcatccttatgtttggaaacaagttgggcataggtgtccccgcaagcgattaacaacagtttgcctggagcatctgcatgtaccttggctacctgccgcatattttcaataaaagtcggatcggaatcaaaatgctcgatcagatggacattcacgatccgcgaaaaacgcgttggagcaagttgttcgcgcgcataaacatcaatcgccccaccgatcatctcgtggaacgaacgcgccataccatacacattcatgtcactgccaagcaggatgggggtaaaactgggtgcatctttcatctgaatgataatctcctcgttcaataagacgcgaattcggtcaactgtgcgtcttgaaattttcattttaaaaccttgtctgccgattcaattattgacagcaggcatcgttagactcgttttgtaagacgcgaagttgattttatcaatcagcttccgtccgttgcccccgaattataccataatgccccaccgcgttcacttgcgtccggataccataacactttttcaataatcatgaatcaaaaaatactaggtcatggctacctagtattttctgaaactcactcaaactgttcaacttgtacgccttgttgacttggcgccaccacctgtacttgccactttttccaactttcttgagcttgcgcctgtacctgcgcggcagccgcaaatgagtctgtgatcgccagcatggtcgaaccagaaccagaaatcaaaagaacaccgccggccgtctgcaccacttgatgagccgctgaatagtctggtattaattccgcgcggtaaggctcctgcatccgatcagtcgcaacttggcgtaataacgacatgtcgccatcagccagtgcccgggtcatcaaggtacaacggcccatttgataggtagcatctgcataagtcatggttcgcggtaaaattcggcgggcatcagcggtactgacagcatagtcagggatcaaggtcacaaaatgcaactttgagctgacggtatactgccgaacgactggttcattttgcgccattatcgtggcacatagctgcccgtaaatcgctggtgccgcattatctggatggccttccatttcagtagcaaatcgcaacagcgccgtatcatcccaaccggcttgataccacgcattagcagcggcgataccaccaaccacacatattgctgaactgcccaaaccgcgggcactcggcaccgctgaatcaaccacaatccgcagattaggaacaggctgatcaatcgcctcggcaaatttgctaaacgcctgataaatcaagttctcactattggcgaaagctgggtcatcgccaatgatctcaagcttttgggtgctcatttcaaacgtaaaatgagctttgagatctaaggcaagtcccaacacatcaaagccaaccgctaagttagcgctcgttgccggaacggacacgctgatcatcgttgaatacctccttcgccgccccaataatagcttggcccatatcggttggtgccacaacaaccttttcctgcggtcttagctgttgaaggcgagcaagattcggcggaatcggcacaccgctaacctgttgcaacatttgcattgcagcaaagtcatcatccggtacgtgcgattgtagtgctttggccaccacgcgtggaaatttataagggcttgcggtggctaaaagcacattcggggtgttatccccagacgctgcccggtactgctgttgaaccgcataaccaacagcagtgtgcggatccagcaaatacccatcccgatgccaaacctcgcgaatggcatctgccacctcttcatcaacagcaaaaccgccagcaaagtccgcttgaatcgcggtcaacacatccggccgaacttgatagctaccagtcgtctcaagttcctgcattaaatgcgcaacatacgcgctatcttcgccactcttataatacaacaggcgttccagattactggaaatttgaatatccatgctaggtgccactgttttcaaaaacggtcggttgcgatcatacacaccggttgccagaaaatcagccaattcgctgttggcattggcggccgcgattagtttatgaacaggcaagcctagactcttagcatagtagcccgccaacacatcgccaaaattcccggttggaacagtgaaattaacctcatctcccattgaaatggcctgtgttttaaccagttggctgtacgctgcaaaataatacacaacttgcggaatcagtcggccaatgttgatggaattggctgctgacagggttacttgctctgcctgcaaccgagcagcaaagctagtgtcagtgaacagggttttcactgcgctttgggcctgatcaaaattgccagcgattgggaaaactcgcgtattgtcactgcccacggtcaacatttggcgctcctgaattggactgacaccatgattaggatagaaaaccgtgatcccagtctgcgcgacatctttaaacccttgcagagccgccgttcccgtatcaccgctggttgccgctaaaatcatgacccgatcatcaggatcaagtgccaactgcatcaagcgcggaagcaactgcaagccgacatccttaaaggcactggttggtccatgaaataactctaagacatgaaaatccccgacagaacgaactggcgtgatgcgatcatcggaaaaatgctgatgataggcaaaatgaatcgctttttttagtgggtcggtgttaaaatcaggcaacaggatcatgagaactcgctgagcaatcgtttcataatctaaatctaacagttcatgaatgttcagcgcctgatcggccaaatgcggcaggacaaacaaaccgccttcttcagaaataccttgtttgattgcctctttgctggttttgctaacctgatgatcccgtgtgctcgtatatcgcatttgaagaactcctatctcattcggcttgaattaacgatatggatatgataatctgttcgcattagaaaaacaagtgtctatattttataaacaaggagctgagaatttatgaaaattgccatcttaggttttggtactgtcggtagcggcgtttacgatattattgcaaatggtgatacccgaatgcgcgtcaccgctattttcattcggccaacgcaccctgcgaccatgcctgagatgacaacagaccttgacgccattttaaacgatcctactattgatgtgatcgttgaaacaatgggcggtcttcatccagcacatgattatattttacaggctttgcagcacggtaagcacgtggttaccgctaataaagccgttgtcgctaaatatttgccggagtttaccgctgttgctgcccagcttcacgtgcaattttacttcgaagccactactggcggcggcatcccgtggattcgcaaccttgaacgcgccgcacgcattgatcagatcgataccatcgaaggcattttcaatggcactagcaattatattctcgatcagatgcaacgcgcccacctcgattttgaccccgttctcctagccgctaaagatatgggctatgccgaagccgatcccagtgctgatattgatggcgaggatgtggtcaacaagctgaaaatttcggcagcacttgcttacaacatggccccgccacgtgatgtcccaacttttggtattcgcaacgttagcaaagccgacattgacttttttgcaagtcaacatcaggttttacggttgattggtaaaagtaaacgtgacggtgaccactatagtatggtcgtggaaccgcgcttgtattcagaaaccgccttggcggccaatacatttgaaaacttcaatctaattcgcctgcatggacaaacgattggcgacctgcaattttatggccaaggcgccggaaaatacccgacagctaacgctatcgtgcaagatctgtacgatatccttgaaaatgccccgcatctggaccgtagcttcgatcagccgctacattttgacgccaacctgaatgtcaccgattacgttttgcgcgccgatcccatgaccttcgcgatgttcaatgatcgcgaaaccgagatcgtcaatgaccggctggtgatcaagcaaataccaactggcgacatgcacaaactcatgcgcggcgttttggccattgatgccgatgcttttatggcagcaatcggagacagtgagttggctgctaaagacgtccttcaccagcaagatcaggaggtgatcggatgaaggtcgttaaatttggcggtagttccgtggccgatgccggtcaattccagaaagttaaagccataatcgatcaggatgtgaatcggcaaatcgtcgtgattagcgcagctggaaaatatggtaatgctacccgaaaattaactgatacgctctatttaattgctgacggcatggaagccggtcgagatgtcgaaccgctgtttaatcaggtcttggctcggctagaggccatcaacattgcgctgcagctcaatgtgccgctcatcaaactgttgcatacaattcgccatcatctggccattcgctattctcgagactatctggtctctcgcggtgagttcttgacagcccacttaatggcagcctacttaggctatacttttgtggacgccgccaatcttttgtttttcaataaagcaggcgccattgatgaagccaaaactcagactgcttatcaacaactagccagccatcatggtatcgtcgttcccggtttttatggtcgcgacgcagatggacatgtcaagctgatgccgcgcggcggttctgacatttctggtgcatggctagcacgcttggcccacgctgatctctatgaaaattggaccgatgtttcaggcattaaaatggccgatccgcgtatcattaaagatgccgacagtattgatgtgatgagttacgacgaattacgcgaactcacctacatgggatttagtgttttccaagaagaagcggtgcaaccggtccgtgaatgtggcatcccgacgcgtattttgaacaccaatgcgccagaagacccaggcacgctgatcattcatgatgatgaccccgccaatgatctcaaaacaatcactggtattgctggccgtaaacattatttggtcatcacggtccgcaagtaccagttggccttgcacttagaagtcatccaacatgcgctcggggtagttgcagcgcaccatctcgttgtcgattatctgcccacgggcattgacagtttcagtctgctcattcgtgaaccgcgtcgtcaagtctcggtacaggagctgaccgctgaaatcgccgccgcctgtcagccagacaaaatggaagtcaccgaaaatgttgcgttaatcgccatggtttctcgtaaacttcgacaacgaccagccattgccggaaaagtcctcgcctatctggatgataacctgctcaacgtacaactcgttagtcagaccaatgacgatatcaatttgctaatcggtgtacatgatcttgattacgacaaagctgttcgggtcatttatagcagtattcatcaaaactttcagcgtccggcgccttatattgaggggattgcctagcacgttacaagccttgaatcgcatttaataaaaaagcatcctttccgcaaaaatttaacggaaaggatgcttttttgttaatccaaccttttgtcactagcaagttaacaacttataggttacttattcttttctgccatccgcgatggtgtcggttttgggtcatcatcagtggtttcctttttaggagccattgttgcttctgctggcggcttcgttgcagctgcatgttgatccttgatggcatcgacaacgggttgattcccagcttgatgcatcaaggcgccgttcagcatcccgcgaatatcaattccggcaacttcttgcaacatgtccaattgtttgaccagactgccgctggtttgaccggtcagatcaccgtcaccatacaatttgatcgaatcgacattggcatatggactcatcgcggcttcgataatctttggcattgcctcaatggtcatcttaaaccgaccggattcgtctaactgacgggctgcttctgcttgcttggcaatggcttccgcttgcgccagcccaattgcccgcgttttgccagcttctgcttccccgatggccttagtggcattagcgttggcttcggcggctaattctacctgcttggctgatgcctcagctgccgcaatctgcgtagctttttgcgcttcagctgcgcgctgcgccttatacagatcggcgtcggcttgtttacgcacgctggcattcaattcttgctcttgtaattcagcgtctttttgggcaagttcaatatctttttctttttgaacttgcttggccttcatttgctcaacaatagcagcctgatctgcatgcgcttgggcgatttcttgctgtttcttgaaatcagccattttgacttgctgttcgcgttcggcatcagccacctgtgtctgccgctcaatttcttgttgcttagcttcttgatccgcttgcgcttgctgaatccgggtgtcacgactggccgccgcttcagccactgctgcatttttcttaacttcagcgatttgctttttacccagcgaatccagataaccgtttttatcggcaatatccttgatcgtgaatgaaatgatctgcaagcccatttttgccaagtctgaactagctacatcctgaaccttctccgcaaaggcatcacgattctggtacgtgtcttccacggttaaggtacctaaaatagcgcgcagatggccttcaaggatttcggttgcttccgaattgatttgttcgtcattcttgcccagaaattgttctgccgcagtcgcgacctcttcttgactggaaccaattttcaaaataacggttccgttaacgatgattggcaccccttgttgtgtgtacacttctggggttgcgacttcaatcgtgcgagtattcagactcaaaacatcccagcgctgcaggattggcagaatgaacgaaccgccattcgtaatcagcttaactcgattgccgttaacatctctaaaactgtgcttgcccgaaatcatggctccagagataattaacacttcgttgggcagtgcggttttgcgatgggtcgccaagaaaataaaaatcaaaatcaagacgatggccgcaatgatccacggcatataatcagttagaatttccataagtcccctcctctaaatgcgatggctaaccgcgccagttcacgctctcctaaatgcatcaacatatgcgatgccttgcttgagttcaatgatgacgaccttggtgccttgagccagtgtttgatgggtgccggaccacaatttggcgggataggtttgccgcgccaaaccaccgccagtcaccatcacttcaccagtgtgaccatcagaaacagctaatgtaacagtccccaacaaataatcgcgatcactgacggatgtcgtgttctcaacgggtgccagtaatcgttgcaagaacgcgatcagcggcagtaagactaaagaaaaaagcatccacaataagccaatcgccaaaagcatggcaccaatgatcacaagaatttgtaaccaaaaaacttgttgggtcagccatgccaccatcgtcatcacctcactttttaatcacattaaatccctttcattttatcatgcaagccgtccataacctataccattatcgacacaacgtgcgttttttattttaacttagcgaattcttcatcccaaaccaatttagttatcaaaaaataaattttcgcaaaagatatgcctttagacgttacaaattttactgacagcattgaaccgttaaagctacagaatttcttttgttgatccaagattatgtgcattcacaaccaggctttaggcgggattgatagaaacctatcagttgtaattcaaagcatagtcttcagggtcttgataatgcagcgtcttggtgaacaagacatgactcgcataggccaacgcaatcggcaagataaagaataacaaggtcaattcaaggacattgccaattgtgacactgcccatagcatcaagcgctgccaaggggccgactaagccagaaaatccaaaaccggcactggccggggtgccttgaatgttcaacgccgccccaataccgcctagaatgccagcattaatcgccatcggcaaaaagagctttggccgagaaagaatgttagccatctgcatttttggcgaaccgcggaagtgagccagcgacgtgccaaaagagtttgccttccagccataggtcgccaaggcaaaacctgcccccacaatcccgaggttagcagaacccgcaccgataccagtcaacgagattgccgtggcaataccgaccgtactgatcgggctcacaatcaacacggcgaaaatgatccccatgagcacacccatcacgattggctgcaaggccgtcacatcatggacaacgacaccaatatacttcgtgatgcttgaaaccggcccaagcgttaacatgccaatcccgccggcaatgaccagcaccagtgatggaatgagcaaaatcgtataagctttcaaggcgtcaccaagcagcactatcaacaaataaccaatggctaaggtgatcgcaaggttaatgacatcgccagtaccagcaaccgtcaatcctgttttagtcagatggtagttgcccgccccaacgatcgcggccaaagctaacgaactggtttgaatcggcgtaaatttggccaacatgccgacacagacagccgacagtgccggcaacaaagtcattgcagcccctgtcatgtaggtaaccaccgccaattgcggaaagcttggcagcaacagtttgacaatcgcgttcaaaatagcaccgggtaccaaggcaacaataattcccacggataatccgttcaaaatgttcatagtaatggttttagcatcttgtttcattgacttgtcctccaagttagttgacttgatgcgctgacttgccgccttcaagaatggttttaacatcgtccagtgaaatatcaatcatatttttgaccgccgcatccgtataaaaaccgatatgtggtgaaatttcaacattcggcatagccttcaaagtttcaagtgcctgattatcaacgagcgtttgactgcggtcttctccgaaaataccggcttcgccttcaatcgtatccaaggctgctccggcaatcgtgtgatcattaagtgcttttatcagcgcctccgtgtcgacaatcggaccgcgtgctgcattgatcagataagcggtcggtttcattttacgtaacgcatccgcatcaatgaggtgggtggtcacgccgtccaacggtgtatggaccgtcacgacatcagatgtggtgagtaaggtgtttagatccacataactgaccgtatccgccaattcaggccgcttcactggatcactgacgatcacagtcgctcccaatgcccgaaaaatacgggccacagcactgccgattttaccagcaccaataataccgaccgtcaagttatgaatttcaggtgcttcaaggccggcccaactataatcatccttcgcttcgcgggcgcttgcttcccctaaatgccgaatcaaccgcatgacttgggctaaaaccagttcggaaaccgatcgtggcgaataggccggtacattggtcacaactaatccgtttgcagtggcggcatcaaggttcacaatatcgtaaccggtaatgcgcaatgtcagctgtttgatgccaaatgccttcagtttttggtaaaccatttcgtcaggaatcgcaccatgctgttgaatcacgacaccgtcataccccttggctaaatcaacggtgtccggtccaaattcaaccgtgttggtatcaacttgaatatcattagcagcgacccaagcatcaatcgcagcccgctcatcaggtcggacggtatacattagaatttttgtcatatttgcctccagattgttagcccagcatttttcaatcggctcattaatgcgttgccatatacttggcgatgcgctcggccgccaacttgagatccgccattgaagctgcataagaaatccgcacgtacccttcaccgccggggccaaaactagcgccaggaattaccgcaaccttcgcctcgcgagccaaagcgtagacgaacttccaactatcatgcattcgctccggcagcttagcaaaaatgtagaaagccccatctggattcggcacggtcaaccccgcagcggttaaggctttgatcaagaagtcacggcgtttcatataagcttccttcattggctgcgtatcatccatgccgtttttcaaggcttcttcagcggcgcgctgcgcattggtggtgacactcgtgatcgtgaattcacttactttgccaatctgctgaatcacatcagctggtcctgcggtgattccgacccgccaaccggtcatggcatgggactttgagaccccattcaatacaaccgcttgatcaggtaaaatttcacccatcgacacatgtttgcctgtatacgtcagctcggagtatatttcatcactcaatacgaagatttcgtattgcttgatcaccgctgccaaggcctccaaatccgcgcgatcgtatgtcacacctgtcggattcgtcggatagttcaaaacaacggcttttaccgtgtctttgtttgcctcaattgccttctgcaacttctccggtttcaaaatgaaaccatcttctgacgtatcaataaaaatcggcttggcaccattcaacaacacaattggaatatacaacggaaaaattggcgtcgggatgatgacggtatcgcctttattcagcattgccgtcaaactcgaatagataccgcctgtcgctccggcagtgatcaaaatttggctttccgggtcatatttggtgttgtatttcgtcgccagataatggctggcagcagcccgcaatcctggaagtcctttgctttgcgtgtaatgactctcattgttttcaatcgatgcaataccggccgccttcacatgttcaggtgtcggaaaatccggctcgccaagtgtcagcttgacaataccttcaatcccgctgatcgcagcattaaattgcaaaatatcgctaggcttgagctgcttaacttcctgattcatccgatcaactaatgccatattattttcctccaatattttttcttatagttctatcataacgtgtttcatggggaagacctaggcgtccgaactttgccgccacggtcaattgtccccttcttgagaccattttgattagcgagtcactcgttctgctgcttgaaatcaaacaaaaaccccacagtcacaagccgactgtggggtaagataatgggaatgattctcctgatctcagccacacagtcaattgcttgatctgtgtgaccgctcactcaaaggtaactggtctcacagatcgtgtctgaaaaaccagaaataaaaggactgttcgctttgagtcagcttgttggtcattatgagaacctcctaagaattagattagttacaggttactgggttgtgaagcatttgtcaaatgatttatgaggtatcattagcaattcagttttttttaacgactttttgagatcactttaaaaaaggtttatcccagaaagtgctaagccaggctggaaatttcgttcaatgtctagtgcctgaccttccatatcaagaagaacagtttgttgctctgccgtgagttgatagtgatgttcacgcatctcatctctaataaagtagccgatcgaccgcacttgcggaccaatgttcatcccttgtgtttgtttacttgctagtttatcaattgcctgttttatttttaagacaatcgtttgggcggtgccatctgtttgttctccaaaaaggtgttgtagttctaacatcttaacaatgatcgcttgcttttcatccattcaaaatcgctcctttattcatgcacgcgttgttaaatcctgactatatacaaaactagccttttgaatgcttgccgtcgtgctatcgcagaatcccttccaacatctaccagctaccaattttggttatcttatccaaaatatacgcctgaggaacagttcggggttcatttaaatttaaacgtcggtattttcaggtttttcgtcgttctttcctttaattcgtataaggacaccacgaaaaatgcagttttgccaaacgacaacaaccaacacataccctgcagaataggctacaatgaccttaattaagagaggagcatttagtcatgaattattcaatcacacctaacagcaccttcccggttgtcaacattacgatgggccaagatgaaacgattcaaattgaatccgggtccatgatttatcacaatggcttggtcgaactcagcggtcatatgaatagtaatggtaagaaagggcttggcggtattatgagtgctatcggccgctcagtcactagcggcgaacattttttcatcacaaccgccactggcactgccccggatgctgaattggccatcgcccccggtaatcctggcgttatcaaagagttaactcttgacgacacccatcagtatcgtttgaatacgggtgcttttctggccatggacaccaccgccagctatcacatggtgagtcaaaaagtcagcggtgctttgtttggtgggactggcgggttcttcattatggaaactgccggaactgggacaatgctcgtatctgcttatggtgacatcattccgatcaccttggatggcagtcatgaatatgtgattgataacagtcacgttgttgcatgggacagcaagctaaattacaacattcaacctgccagcggtatcattggcttcacaactggcgaaggtttggtcaaccgctttagtggctctggtactgtgtatattcaaacgcggaacattgaagctttggcaaatctggttcagccatttttgccaagtagcaaagactgattgaattgccctgatttaaggcaagccaatgcacatcaaaaacccgtcaatttttggcgggtttttgatgtatgcaaggaatatcaagcaaaaattgacgacactcgtgtcttgtttgccgaaaatacatgatttgactgtctacatctaaattaggcaaattcttggccattcggtagcattttccgaataccgccagcagggttaggatcatccccacggtatcgcgggatcaaatgcaggtggcaatgcatcactgtctggccgccatataggccgacattagcgccaacattataaccatcaggatgatattgctgatcaatcaacgttttgcctgcttggatgagacgattgatggctaacagttcctcctcgcttaagtcaaaaaaatctcgtcgatgcgtccgcggaatcacaagcaaatgaccctggctcacaggatgaatgtcccaaaaggccactgcgagatcattttcaagaacgatactggtttggggaagatggcaaaagatacagtcggcttgtggcatcatgatttcctttctaataagtctcaaatcaaaaataagcacaaggcgcttgcagatctgaactgctgcatttgccttgtgcttattattcaatacgatggattatgcttcaagtttctctttacttgaatctgcaatataatgcggcacttcatcatcgatgaaatagaccttgtaccaaacaaggaaggtgtaaatcgtccaaactttccgacgatcatcgctttcctgccgatacgtacgatccaagatatcgagaatggcatcctgatcgaagaattccttgacccagtcttgttcaaacattttgcggaccgtcttgtagaacggttcgtcttccaaccactgcttgaccggcactgggaaaccgagcttttcacgactcgcccattcttccggtaaatgacggttagcagcttcacgcaatgcatacttcgagttgtgcgaattgatcagatacttggttgggataccagccgcgaccttagccacttccttatcaaggaacggtacccgcaattccatcgagttggccatcgacaacttgtcagctttcaaaagaatatcttttggcatgaactggtggatgtcgagatactgcatcttcttaacttcatcatcgtaatgacgtacctttttgtacgaagcggtcacgatgtcacgaacactctcactttgccgaaattccggttgtaagatcttgtcagcctggccctcatgaaaaaccagtgcttcgccgatgaagaattcttcggcaggagctgttgattcataaagatgcaagcggccatggaaatttggcatctttttcaggccatgggcgatcgtatacttaacaccttttggcaacttgcgtaaaccgtccgcaaagactcgaatggcgtggctgcgcgtatggaagccatagttcgcataaccagcaaagagttcatcggcaccttcgcctgacagaatgacagtcacgtctttatgtgccagcttcgttaggaagtatagcggtacacaggaaggattggaatccggttcatccaaatgatattgaatcaatgggaagttatctaacgcttctttttcagtaacaatatcactagtgttatccaaaccgagtttgtcactgagttccttagcggcaacgccttcgtgatactttttgttgtcaaaaccaattgagaaggtatgctctggccgcaacaaggcggtgatataagaggaatcgacccctgatgaaagtaaagacccgacttcgacatcggaaatccggtgagcatcaactgactcagaaacactcttgtcaatagctgcaacagtatcttcaaagctcaaattgttcgccttgaaatccatgtcccaatacttcttaatggttaacttgttatccttcaaggtaaagtagtgcccttcaggaatccggtaaacccctttaaagaaagtctcgtccaaagccgaatattggaaagtcaaataaggcttcaatgcttccttattcaattgcttcttaaacttaggatgcttcaaaaatgctttaatttcactacccacaataaaggtatcgccatcgtgatagtagtacattggcttgatgccaaagaaatcacgcgcgccaaacatttctttcttattatcatcccagataaggaacgcgaacatcccgcgaatcttcttaagaagttcgtccatcccatattcctcataaccgtgaagcagaacctcggtatcggaatgggttttgaacacatgcccagcagcaatcaaatccttgcgaatgctctggaagttataaatttcgccattaaagatgatcgcaactgtgccatcctcattcaggatcggctgcgaaccaccttttaagtcaatgatcgacaaccggcggaatccgagggcaacgttatcattgatatattcgccgctggaattaggaccccggtgtttgatcatgtccatcatgttattaataactggctttttatttaaaattgtcttgtccgcaaacgcgatgattccgcacatacagttaaccccttttcgcgtgaatgacgatcattacttgtttcagtataaagatttagcgtcgcaagtcaattcaagagcgtgagcagaatgtttctgcgccagttcgttctcttcgggagaacagtcggaatacgaggcacgttaactagcaacacagaagttttttaaaggtaagcgaacgaatttgagttccatttaaaacgacttcgatattccttatactataaggagtaccgaagtcgctgtcttttaagtcagtttgattttgagcagtttgcttgaagcctgaaacgctcatggtaaataattctacaatgcttccgcatcaaccagaacggaaagatcggttaattcagtaacgctacttatagcaatcaagcctgttagcttcaggcgaacgcatgatgcttaaaataatctgctggttcgatgtccccttgaagctctgagaaaacagcaatttttgcatctactaacaggttctttgacaatttagtcacggttatttgacagacccaaacagccatccgacgacacagttaccatggttgctgtttggctgaacgtttaatgggaaaataagatttcgaacaattaggtagactaattgttcagcgaccactctcgataagctaacaataaacgcacgtgtaggcggccaaactgaagtggacgatgcaaaggacgatttcgtgtttaatctgtcggaaaataaacaagcgaattttgtcaacacctccgactaaagcctgaagcttgtgagagcggggccgaatactatcgcaaccataaatttacttagaacatgttcgagttctctaaaaagtgcggcaattagacatgttagccggataaattgacggtgaaatatcaatacaagtcaagctaggatgaagctttctagaaatcagctcaaaacgcgacgatctcttgaacattctaaacatggctttggcgtatcttcgcgatcgacttatggccgtgtaggattcggataaagcaaatgatcctagtcattagcagcccaaaatcaaatgcgcaaaccatgcgccaggcgtattatcaaagggcgttttggggcactttcgtttaccaccaataacgtgagctagctctttttcgtttaagagttccatgggtattcctcctcgtatagttaatttttaagtctcccgacaactcattatgtcactcgtcctcgcatcatgcaatatctaatcgttttattaacatttgtctaatcttgtatttaaaaatttttatttgaggatggtcaggttgtacagtcagtgcttaatcatcaactaagataaatcttgaaccatctacacgtatggccattactcaaaagtcgaatctagaacagcgtgttgggtttctttgacttggagattattttcaggtaaattgaattcaaaataaaggaattccttgcggttgaagacactcacctgccaatacagtagcaatgcttctagtgaacaaatgtatacttatcccattagtgcagctatcattattgcaaaacaaattctttaaaaagcggtattttcacacttcaacatcggaaagttgaacgaatttatagatggataagtaaaggctgtgatctgtgatgtatttgcgaaagctagtcacaagccactgctatacagctaattcagccgttattcggatacttttaataatattctaaatgcgttctaacagctactatgctgactagaaaccgttatcatttgttggctttagattgcaagatattggtttttaataaaataaaccaaacaacagcaagaatggtaggaattacataatagaataaccggtacaaaattaacaggcttgcagaggtgttaggcagtacgcctgcatgttttaacgtttcagtcaggcttaggtcaaaagaaccggcacttccaggaatcaacgatgccacaccgagtgcagcagagaagaaatagctctgatataaaacaaataaatcaatatttaaatttaaaatagcatttgataatagcactataccaaagcatgcaaaccattcgatgaccgatgtcattagcaagatcaattttgtggaaaattttaaggatggtgttttcagcattaatggtatgagtggatagactataatcaaaaaagaaatatatgaaagcgaacctgctaaaattgatacattgttattcttaattagtaatgcggatatgctgtaattaatcgaaaggcctgataacgaaaaaagtgagatgtgaaatgacattttagttgcagtacgagcattgacatgttgccccaaaagcgcatatctgagagaagcccctaccatacctcctgtaccggcaacattatttacgacatttaatgaccagctagtcatgttgaagaaaccgccccgagaaggtacggaaagtttgtccgcgtaaactttgtcatacacaatcattggtgtgactgctaagcaacctaagaacaataaagcaaaaattttctggcctgttagcaactgtaatactttctgaatactagatactgataactgtcggcacaagccaatcatactatacgtcactatcgatatcatcataaacaagtatattgttttccaatggcggacatctctgatccatttaaaaaaattgattttcaaacaaattccccttaaagtttgaaatgaggagcacaaatgagaaaaataaaagcggattctataatggtgataatcatcttagtaccaacaattacattactagtcaatgctttgtttgcaattagctcatccatgagagcaatgctattattgatattagtaatagcatctcttgcatttttccctcagaaggacatgttcattgcaatcaatcttttttttacaagaaaaaaataacgcaacaatttttatttacgagactttgaatttattcgggggcgttactaccaacacagccccaaaatacgttgtatgaatcttcattttgacgctatcttttctaactcttagcaagtcggtaaattgttacctactgtcattttagacaaactggttcgtattttaaccccagaatgtatggcagatgagtcattgctttagcctcgaaggttaatcctattaacaatgctttgcatagcctatcatatggattagatctgggcaagatacttagtcactggataaggcgcttaagatcaattggcacctgaagaacatcgcctttaacaaggcatctaagatttttttgaatatggttgtaagctaaaccggtattattattgttgactttgattagcagcaccttggttgtttcagtcaccttcatttgagccgattgcgtttgggtaggttgacgggaccagaaatgaatgtaagcgtcacatagtgcagtacctataattgtcaaaatcctccctctatacacgggtttggacaactatcaccgttcaccagagaaagccttgttgattgggttgacgacatgcgaaaagcaggatcgcctgaacctgagaagctagttctaaatgcgctacggactgcagttgaaagcaatgtcagaaactacaagtacgtcaatggcatcttgaaaaactgggagagcaagcgtcttctcacggttgctgctgtcgaagcaaacgatagtgaacgccagtcaaaccgaacgccgcacaccgaaccaaaaaaggagaactggggatatggagtcgactaaaggcttattcacacatgcggacgtgcaaaaaatcattgagaagcgtggaattgacgttaatacgctgccaactcaggccgagatcgaacaccgcttccacgaacgctctatggccgcattgaaccgtaaaaaggcacgtgcaatttatcgctactcagtcttccccggaaacgttccggctaagtttacgttcgaaaaatggcagcctgaaatgcagacggatttgcagaaatcaagagatctgggaaatagggcatacaagttggcaaaacaaatgcaagaaacgcctgaaaacgtgattttatttggccctcgtggaacaggaaagacatcacttgctttggcgatgctgacgagtctacgagatgaaggccagtcagggctgtttatttcaacagcagagctgagtaacctgatgggcttgcaatacgatgcaccagacgttcgccagcgtttagtaggcattgagcgcgcaatgaaagaggctgacgtgctgttgttggacgacttcgggacagaaggcggtatgaagctcgacatcaagccggttagacgcgacatgcaagagctgatgtatcgtgttgcgaatgcccgtcttgattttgagagcaacagtcctcgtctatcaacaattatcacaacgaacaacgagatgagcgagcttgagcacatgtacaacagcaaactcatcagtcgaattattccaaaatcaaaagactgcacattaaattttgaaaagttaacggacgtaagggggaaaagatcgtgacagccgaagaaatgacaaatagagctttgcagcatttggacaagcatttgcgggcctacgaagcgtccttgaatcaaacgatagctgacattgaaagcgattatgatcaaggctacctagacgttaccgaagcacagtggcaagacattatcgtacttttaggcgctgttattcacgctgatacgcgcatgatttgcaaagcgtcagagagtatctgtgctgacggtggcgtatcggggagcttgctgcgtttattgtggctagctaagcatttcgcaacactagatttttcaatgaaaccgagcattaaacaggaggcattctaaatgcaagcaattaaatcaacagtgaacgtcggtgatctggttgtggtgcctgatcgagtattcatgggcgtgcgtgatctcggcggtgtggcacgaatcatcagaatcgagcgatacaacgccagaggtgcaagtcaagacatcaacaagccagttgcttttgatggcaagacacccaaagagctaatcacaacggttgagatggttgatggcaagcaacgtcaatactatctgaaggacgtgaagccagcgtgaacaggattattattccattgcccctcatgactcttaaccagtacatcaaggttgaacgaggcaacatgttcggcggagcaaaagtcaagaaacaagcaacggaaacagtaatgttggctgtgagaagagcgatgaatcagggcgtgaaatttcaatgggggaaacctctaagtttcgactggtactggtatgacaagcgaacagacccggacaacatcgcgtttcagcacaagtttatcttcgacggcatgcaaaaggctaaatttttagaaaatgataactgggatcacattgtagaactgcgagatcggttctttattgacaaagctaacccgagagttgaagtcgaagagatcgattaaggagaaaaaaatcatgaataaaaaattgacatttacagtaactgttttagcagggcttatgttgggggccggcgcaaccgccattgccgacaatgtttggcaaggtcaccagaacatcgtggagaccaaaaacaatatcgacaagttgacggataaaatcaagaattcacaatctagctccaattgacgacactacagaaaaataccggcttgttagcgatggcggctgcgctggagacgcatgccgataccatcttggcggcaaataaggctgatcttgcagctgcgagcgccttgccggaaaagtttgttgatcggctcgcgttaacgaaggcacgcattgccgacatggcagctggggtacgacaggttgccacactggatgatccgactgcgcaaacggacagggcgtgggtgaacgaagccggcttgacgattgctcaaaaacgcgtgccattgggtgttgttggcatgatttacgaagcgcggccaaatgtgacggtggatgcagctgccctgacctttaaaagcggcaatgcggtcattttacgcggtggcaaggaagcattacacagcaatcttgcgttggcgacagttttacaagatgcgctggcagcaaaagggttaccgcgtgatgccgtgcaattgatcaccgatcctagccgtgccgttgccacccagatgatgcacttaaacggctacattgatgtgctgattccgcgaggcggcaaagggttgattaaagcggtggttgaacaggcaacggttccggtgatcgaaaccggagctggcaattgtcacatttatgttgatgcccatgcccaattgcaaatggcggtggcgattgttgtcaatgccaaggtgcaacggccatctgtctgcaatgcagccgagaagcttttgattcacgctgatgtggcaaatgaacagttgccagtcattgctaaagccttgcaagatcatggcgttgaattacgcggcgatgaacgtgcccgcgccatcgtgccgagtatgcacgctgctaccgctgaagactgggatacggaatacaatgacctgattatggccgttaaggtcgttgactcagaagaagaagccattcaacacatcaatgcgcataatacaaagcacagtgaggcgattatcacagacaattaccaaaatagtcagcagttcttacagcaggtggatgccgccgtggtttacgtgaatgcctcgacccgcttcacggatggctatgaatttggttttggcgccgaaatcggcatcagcacacaaaaattgcatgctcgtgggccaatgggattagccgcactgaccacgattaagtatcaggttttgggcaatggggagatccggaaaaattgaaagtttattttgaatagcaatggcgttggcacaatctatcgatcacagatagtttgtgtcaacgccattttttacggtctaagcatggagccaatgcttaactgttgtttgatggctaagcaggatcggtatggttaacagcaacgccaacaaaccacaggaaggaaacccccacaggccgccagctatgtccattaaaccaccgacgtataaactgccaatgggcgtagagccttggttgagcagaacgtagacgctcatgatccggccacgcaactcattggggatagagaactgaaaagcagcattggattgattcaagaaaaccatgttgcaaaatccaatgacaaccataaaaatcatcgccaaccaataaacgtgaacaaaaatcatcagcgattgaaccaaggccgtccctaatgccactagaaggtataaatcgcggcgtaggccaaaccgagccagataactcatgaggaacgctgcaatcagtgaaccaatccctgttgccgatagcagattggcatagccttgtgcaccacggcctaaaacttcctgcgcatagatggggatgatgacattattgttaaagttcagtgtgcaaataatcatcattaattcggcacttaatttaacgttgtcatggtggacgatgtaagcaagcccttctttgacatcagcaatgatgtggcgcggtgtgtgactggcaacaggatgctgctgatgaatcatcaataaaccaataataatggcaatgtaactcaaggtgtcaactagaaaacacggcgccactcctatggtgaccatgagcaccccggctagggaaggacccgcaatttttgccaaattgaaaatggaagagttcaatgaaatcccgttcatgaggtcttttttgccaacaagttcaataacataggattgtcgagttggcgtatcaaaactttgaagaatgccatagcctaaggcaattaccagaatttgccagtattgaacaatttttagaaaagtgatgatcgtcatggcagcacccaagactagaaaaccaaattgggtcatcaaaagaatccgtcgtttggggtagcgatcaatgagcgtaccggcgattaaggtgagtgccatgataggaacaaattgagccgctgcgagcaagccaaccagaaatgcagatttggtcatttgatagaccaaccatgtttgcgttgttcgttggatccaagtgcccatgacagagatacattggccaatccagaagcggcggaaattggttgaccgcagtgaagagaaagttgcaccaaaaatgtgcctatccacgaaaatcatcgccttgtttggagtctattgtttcttatcgttggctttttcagtgaagatgtcaatactgaagcagggcgtcttttgcaagtggtgtcgtcttttcaatctatgaaagcaaaacttttcagtaaaaagaggcggctgacttgtcaatattttgagaatttttttaattaaagtcaaaaaataaaagcgcattcaactgccttttggcgggattgtgacgaaattatgaaaatttatatataattgatcatttatgttgacgataaaactttcggcctgttaaccttagctcaacacataacaagggggaacttaatcatgaagcaggcaaaagaaggcatgttcgttttatgtcgtgcgaatggcaatatggaacatgattttgttggtcgcattcagaaatgctatgaaaattctgcattggtcgaaattcttgattatgcgccgtaggatcaagtaaacgtacaggatttaattggtcgcacagtcattgcattcaatcgcatgaaacgcagtcagacgacgcagttagcaacaacacaaaatcaagttaaagaaagtgtcgggtagctaacgacgatgttagttgcatggcctctaaaatgaggattacagcatcgagtgctgccgtaaaaagccgcaagatcaaggccaccagcgttgtcaatagcagtttataaacttttttcttagaatagttgaaactgatgcctctagggtgtataaatgcttcttgtgatacaaaaacgtgtgccgactcatggtacaattaataaaggtggtcaagaggaatcatgttatttgcagcacatcttcgtgattatgaagtcgttggtcagtatacggataaatgggggcatcggcacgattcttcccgggtctgtcatcagatgactaagcgagaagcgcgcgacgctatgcagcgctatttgttgcaacatttcagtgattcggttgacttggatgcaccgatcaaagtgaaagtgcaggccaccaagtaagcacttacccgccagcaagttaagcccgcacggcgaatttgctggcgaatgcctttaaggaggtttttctgtgtcacaagaaatcgttattggtgataaagtatcagttcgtaaagcaaaagatgtgccattgagtttcaaaggcacggttgaaaagctctatgccaacgcggcaatgctgacaatcgacagtttttcgcctgatgatgcctcactggttgaagatatgaagaataagacggtcgtgaactacaagcatattaaaaaaggcggcaaagcggttatcccgccagcgcctgaagaaaaacgaccgggtgcacgtcactagcgtgtaatgaaaaggactgtacgccgattgtacagacttttttattttccttagaggttgcgtgagccccaaagtggcatggcataatgtcaacttggtatccttaaattaagcaaagaaggaggaaatcatatgacagattatgatgcagcaaaagacaaggttagcggcaaggttaaagaaaccgctggtaaattaactggtgatgaatcaaccgaagctaagggtaaggcccaacagattgctggcgacgtgaaagaaaaacttggcgaagcaaaagataaagtagccgagaagttcaatgacgttgtagataagactaagaaaaaagaggactaaatcgggggatgtagctccgattggtcaaaccagagagaacgccgacagatggcgttctttttttgtaggaacaaagccgcactataaccacttacaaaaaattagcaaaatccctttacttactaattataagtaatacatttatctgtgttctgataagtaagcaattttgggaggctttttacacatgacagttgttaatggttacgaacaaagcgatgcagaaaagaaattgaacattttgaacttgccgtcattggcagatgaagcaaagaagattattcctactggcggttatggttatatcgtcgggggttctgaagatgagtggaccttggccgaaaacacaaaggcgtttaatcacgctcagattgttcctaaggcattgtccaacattgattctccagatctgtccaccaacttcttgggcattgatctcaagacgccaattatgatggcaccgactgctgcgcaaggtttggctcatagccaaggcgaaaaagatactgcgcggggcgttgcagctgttggcgggttgatggctcagagtacctacagctcaacatccatcgctgatacagccgcggccggcaatggcgcaccgcagttgttccaactgtacatgagtaaggattgggacttcaacaagagcttgctcgatgaggctaagaaggccggtgtgaagggcatcattttgacggttgatgccactgttgatggttatcgtgaagaagatatcattaacaacttccagttcccaattccaatgccgaacttggaaaagtattcagccggtgacggtaaaggcaaaggaattggcgagatttatgcctctgctgctcaaaagatcagtgaagacgatgttcgtcgaattgccgaatacaccgatctgccagtcatcgtcaaaggggttcagtctcctgaagatgctttgcgcgcaattggtgccggtgcagccgcgatttatgtttccaaccatggcggccgtcagttgaacggtggtccggcatccttcgacgttttgccagcgatcgcaaaggcagttaacaagcgcgttccaatcatctttgattctggtgttcggcgcggcagtcacgccttcaaagcgttagcagccggtgctgatctagttgcctttggccggccagtgatctatggcttggctttgggtggtgcagaaggtgttcaaagcgtgttcgagcagattgatcacgaacttgaaatcatcatgcaacttgctggcactaagacgattgctgatgtgaagcacgcaccattaacacacttcaactatgctgactaattcagccagaagcgtgctttaaaaatataaaatcatgacctccgcgactttgctgttgcggaggattttttgtctttgtgccatttcaattgcttttaaaggcaatcacagtcagctttatctgctaacgatcccatcaaaaaagccccgctgccatttgaaatggcaacaaggcttagcggcaatcaggtcacagcccgatttgacttaatgtgtacatagcattacgaaattcatctcggcgattagcctttttttcgacatcactaggtaattcagtcatgtcgatacgaacaacggcgcgccgcaaaaggctgaccattgtcttgtcgttcattttgatgtagaggtgatcggcgtcaaatcgctcaaccgcgtcctcccagacccgggcgttttcgtggtcgctttccacgttgcgcttaatcagcgacttgccatcgacggtgttgaatgtgacatcatatgttgtcatatgaattctcccttcattgatcactttcattatacaacgggtcgttgggatggagaatgaattgccaaagatataaggtattggccagcaaatacgcagttaagcctagcataaacggcaatggcatagccgccgtcatgaagctgtataccccaaaaatcatgagtgaaaatcctaaataaaaccaacgcttgaagccgatgtcgatcttgttggttggataggcgcgcaagtagccaatcaggctaaaatagtaaacagctaaagccaaggtaatcgccgcggcaaaccaacgcggatctaattcctgagtcaaccacaggtggataaacgtgctgatgctaaggatggccgctaataacgggtaatgaagatgaatagctgccaaaccgcctgtttttatctggcggttaaggccgttatcataaactagctgataagccacaaaaagcaatataaccacaaagaaaaacaaaccggcctgcagtgataagccgctataaaccgtatcggccacgccaataaccgcttctccgaaaatcagcaggaccagtagcgagtaacgctcactcaaatgactaaaatccaccggggcagcattgatcgttcgccagaaaagcagcgggacaaaactggcccccacaacgcccaaaaagaagaccgtgaatgacagcgagtatggggttaggaaaggcgatacaagtgccagcgcgccagcaattgttaaggtcagaccaaaaattttgggtaaagcagcatgtttttgccgccagatcaggccatattgaatcgcaacactcaaaaacaaaatggcggtgctcaattgaaaggaccattttgttttaacgaaatcaacgttgatggcggtacttaagacgatgacccagaacatattaaaaagagtaaagagactttgggctagttggttgttaaagtaccggttggctaagacagtttggtaagtccaaatcacccagaaaacaagtagcatcatcaaaaactcaccaagcatacgcggagcaatgaaaccatgtgtcggcagtgcaagcgcttgcgccatacggccaacggcataggcaaaaattaaatcatagaacagctcgaccatcgtaaccgatttatgcgactgggtcatgagcatccttctttctaaaggcaaagagacaagccttcgccgatctcgtatatatagtagcctatcattttccagcttttccggcaaaaatgcagagcgggaaaaggcccagttagaagctggaacgtaagcgacctcaagcctaaatggctgggctttgggaggcccttatgtggaggcttctgggcctgttcgcgtggtggggcacgacttcgagctaatgcgcaaggccaacgccgtctcgccactaggacttggtctaagcgaagaaaactgcttcgctttgaccattgagtccattgctattccgctggtttcatcaatgaagtagaatgacaaacatgaaactaagcaaagcagcactatttgatgcgtttaccactcgcccgcgcagtctggtatactagttgggttaaggaggccgttttgtggttaaattagtcctgttaaggcatggcgagagcatcgccaatcagaagaatacttataccggctggtcggatgtgggtttaaccgcagagggtaaggcacaggctgagacagctggggaaaaaatcgcgtccacggggatcttgtttgatcatgttcatacgagcgtgctatcgcgggcaatcatgacggcatacatcgtgcaagataagatcggccagaactacctgccgatcacgaaaagttggcggcttaatgagcggcattacggtgccttacgtggtattaacaaggacttgacgcgcaagctgtttggcccggatcaggttgcaagttggcggcggagtttttccgcacatccgccattacttgctaatcctagtcgaacccggcggtaccactgttatccagccacgatcatcccgcgcggcgagagcctcgccgatgcgagtcaacggttgttaccgtattggacagctgaactggcaccgcgccttttgtccgggaaaaatcagctcattgtcgctcacggctctactttgcgcgccttggtgaagtttatggaagacatcagcgatgctggcatcaacaaggtcgaaattggaaatgcgcaaccaattgcttacaccttggatgacaagctaaccattctggataagcaaactttataaaattatggaggctgagccataattcccttgcaagacttgtgattcattaaattccgaacaagcagtgagcaagcctctttctaggtggtaactttattattgcaatctaggaagcaaattgccacttattatgccgacatgtatcttgatttttctgaagccgagtttgctaacttcctgaagacatttgatcttgattcccaccagaagctggcggccctgtcaaaaggtaatcgcaaaaaattgatcgctgcactgacccttgcccgccaaactcaactttatctgctagatgaaccttttgaaggtatcgatagcatgacgcgcaaacggatcatcagtaacttgattgcgtggaaaccggcagcggcaactgtgattatttcggatcatcacgtaagcgacgttgccaatgtgttggatgaggttgtcatcattaaagacaagcacgtggtggcacagaaaaatgccgaagagctgcgagaagaaaccggcatgagtattgaaaactattatgaaagtttctatgaaggaagtgaccaacaatgactaatacatggacaatgatgcgaaccttgacccggcaacgttcactaacagcatttaaaacattcatcgtgactttggttgcgaccgttgtatcaatcctactagcgatgttcactggtgaagcaaaaatcaccgttgattttgtcttaacccttctctttgcttatgctgtaattggcggtttggtgttttttgttagattggcgatcattcaagagcgtgtttgggtcaataactactatcgatcagtgccaaccaccaaccttaaactttatactgctaatctgctggcaacctgcctatcatttctgatatatgctgccgtcgaaggtgttgttttactagcacttgcagtgacgcgttggggtatcaacttaccaacgggtgatcccatgaccgtgttagtcgaaatggggatattcctgattgtcttagggatatttatctgggcatttatcagtctcgttcacttgttatcagtgaccattatggcgttcctgccagaaactcgaattcgccttgttcaatggattatctatctggtggttatcattgttgcttcgttcatattcgatcaggtccaacgcctgttcttactaccctttggtggttatgacagcaatactttgacaggttcttcaagcgttctcgtcggcatcgggatcttcatcgtcaccattctgcagatctctgcagtgaatgtttacctacttgaaaagtgggttgaaactaaataatgtgctctgcctagcaaccacaaaaaaacagcgtcccaccgcgttttaacgatagcgggacactgttttattgtggttttatccactcactgcgtagtaaggaatactcattttcatcatggaaaccatctgccagtttttccccggcgcgatgggtgccatcgtgatgaaagccggccttttgagcgacggcattgcttggtgaattgtcaacagcggcgcgaatgatgactttattgacgccatactcttcaaaaccgatccgacacatcgccaacaccgcctgatgcgctaggccgcgaccacgaactgattttttaagccagtaaccaatatcaccactttcatcactcgggcgaaaatgattgaagctgatcatcccaaccggctcatcccgataccataaaaccaagttcattgactcctcacggccaaaatgatcattgacgctccgcaaaaatgctgcttcctcggcctccgtttttaatccattcgcccaaggtaaaaatcgaccgatatcatcgcgttcttgatcgataattgcaaagagcggtgctgaatccagccgcggacgcggtaatgccaacttaaaatcgtcatcaatcacataacttaacatgctaaacaccttcatctcgcgtttattgcgctaacacccaatgcgccggtgctgcttcgaccagtgaggcagtcggatcaagcacctgccggtcaaagtgcaacaccggtttttgctgctcaagcattggatcagcctgcggaaccaatgacagcagcgtctgcgtgtaaggatgcagcggatggtgataaattgcatctgtatcgcccgcctcaacgatgcgaccttgatacatgaccacaattttatcactaatgtagtgaaccatcgatagatcatgggcaataaaaagataggttaagtgttgtacatgctgaatttgccgcaacaaattgacaatctgtgcctgaatcgacacgtccaacgctgaaatcggctcatcaagcactaaaaacttaggctgtaccgccaaagctcgagcaatgcctattcgttgccgttgtccaccagaaaattcatggggaaaacgattaatcgcgtctgcaggtaaaccaacctgcgtcaacagtcgtaaaacttgcgccagccttgcttccctcgaggtggccaaatgaaaattgtcgatgccttcagcaatgatatcgaccactttttgccgcggattcaaggattcgaacggatcttgaaacaccatctggacctgacggcgaaagtctttgcgcgccgcatgtgagaaatgacggatcgactgaccgccaaaaagaacatcaccaccggaaatcggaccaatcccagcgatagcgcggccagttgttgtcttacctgacccagactcgccaaccaaaccgactgtggttccggcattgatcgtgaagttaatttgatcaacggctttgattgcttgccgccctttataaaaagtgacacttagatcgttcatcgtcaataacggttctgtcaaactggcacacctcccgcttgctggctttcaactactggatcgtttgtctgttcagcatgcaactgagcaaatcgcgcccagcgtttctgaatagtgactggtggctgatagtgtggggttcgtggatctaataaccacgagcgtacaaaatgtgtcggcgatacttgaaacaacggcggttcttttttaaagtcgattggcattgcgtaaggattgcgcggagcaaaagcatcccccttaataggttgatgcaaatcaggtggcgttcccggcaaggtaaacaattggtcacgttgatcatctgaactaggaacggcatctagcaatccccaagtatagggatgctggggatgatagaaaatctcgttagctgtccccacttcgacaattttgcccgcatacataatcgccacacgatccgcaatgtttgcgaccacgcctaagtcatgagtgatgaaaatgacactcaaatcatgtttggctttttgcgctttaatcaacgccaaaatttgtgcctgcaacgtcacgtccaacgcagtggtcggttcatcagcaatcagaactttgggctgcatcaccagcgccatggcgatcatcgcgcgttgacgctgaccgccagaaagttcatgcggatatttgcgggcaatcaaagctgggtcagctaatccgacatcttcaatcgccgcaaacaccgcctgcctcaaggcgtgaccgtgaacacggcgatgcaccttcaagccttcgccaatctggcggccaatgcgcatcgtcggattcaaaccgctaagtggatcttgaaaaatcagccccagctcttgcccgcgcagatgggtgtactgacgccgactcgtctgcaataaatccttctcgccatacagcatctcgtcagcagtcatcacagcatccttgcccaacaagcccagcaaagcatgggttgccaccgacttgcctgatcccgattcgcctaccaacgctaatgtttcgccttgatgcaaacttaaatccacgccgttaacggcataaacttgttcgttgccttcattaaaaacgacttttaaatttttaactgtaacgatgtccgccatgtgttcacttccttcaatcgcatactggggtaacaatgccgctaaccacttactttttatatagaaatagatcgacgataatgccgccaaacaaattgatcgccgttagcacactcatctctaaatttgtcggtaagtgtttgataaactgtgcggtcagatggccatgcggtcgttcagtatgccaaatcaatctcatagccagcaagaacaccgtcacacctgcaagaagccaaaaggtttgatgaagcccccacaacaaggctagcaggaaatggttctggcgcagtgcaaggcctgttgtcaccaacaaaaggccagcaaacacacctgcgacaatttgccaatgatgtttctgcatcactcaaaaaacctccttttcttcgcattgatttcaggcacataccagtagcttttgggtgagacaaaggtcgtctcttactgtcatgtgcgctaaaattagcctagctttggaatttagggtcaagcgcatcccgcaagccgtccccgacaatgttgaaagcaaaaacaattgcaaccaacactagaatcggcacataaagctgcatggggtgctgcaacatctgatcctgaccatttgaaatcaaaatccctaagctggtattgggtgcctgaatgcccattcccaagaaacttagacttgcttcaccaaaaatattctgcggaatgctttgaccgatgtccaaaatcaaaatgctcatcatgttgggtacgagatgtcgtgtcataatccgccatagcggggtgtctaacatcactgcggccgtcacgtaatccaacccgcgcaattgcatcaccaaaccgcgcgcctggcgtgctgaactcgaccaactagtcactgccagcgcaaacaacatcgtccaaacgccgttgcctaacacgatcatcagcagcatcgtaatcaataaactcggaagtgaattgaaaacttcaatgatccgcatcatcacttcatccacccagccgccaaaaaatgccatagtcatgccgtagatcgttccgaatccaatcgccaagatcgtacttaaaatggcgaccgctaaggacacttgaaccccaaggcatagacgggtaaaaagatctcgtccaagtcgatcggtccccagccaatgcgcagtactcggaccaatattccgactgtcaactcggattagatttggatcatagtgttgtatttttggcccaataagcgcaaccatgacaattaaaatcaaaatcacggtccagaacatggctaaccgatctttgaatagcttgtgacgcgctgaggcccagaaaccaacacttttaggcacaccatcgtggacattgatttctggcgttgcccctgactgatcaaaagttgcgtcagagacaaccggtgcagcttcactaccaactgtcggtacttttttaaaaaattgaaaatcctgattgcttgcggccatgtgttgattagcctccttaatggcactttgtttaaacgcgttcgttgacccagaaacctccgtgtaaggaccttggtcgcaatggcccaagtgcggcccatcacacccaaggcctcttatactccggtttctaaccgggctggctcacgctctgtcatataatttaatgcgtggatctgccaaggtgtatagcatatcggtgatgaacatcgtgatgatgtagaggatggccagtaggacggtttcgcccatgatgatgggcacatcgcgattgtttaaggcggtgacgaagtattggccgacaccagggatcacaaaaatgctttcgatgaaaattgaacccgtgataccgaatgccaaggtcaccggcaaagaagtgatgatgggaattgaagcattgcggacaatgtggtgcaacactatctgcgattctgatagtccttttgcccgagccgtcatgacatattcactagaggcaacatccaccatcgaatttttttaaaggcgggcatagattgcgatgtaagtcacgccgccagcaatggttggcaaaatcgtataaatccagccgccccaccaagtttgatcgccgctgggccaaccaatgattggaaaccagccaagtttgcctccaaagtagctttgcaacaacaatcccagcacgaggcttgggattgacattagaaaaagcgctacaatggtgaccgcccgatcaagccatgtatttttatacacggctgctaaaatacctagtaacaaccccagtggaatgccaaacagcatctgttgaatgcccaatcgagccgatgcgggcaagcgatcccgaatcaagctgctaatcgtcactgacggatcagaaattgattcaccaaattgaccatgaagcatgttgttcatagtgataccataacgttccaatactggcttatctaagcccgtattttgatacacctgtgctctggtagctgctggcaatttgtcggtttgcgcactcaacgcatctcccggaactgctgcgaccataaagaatgtagccgttgcgattaaaaaagtagcaatcagcaattcaacaaatcgtcgaacaatcaatttgaccatggtgctaattgcccccttttgacatcgtcatgccgcataaactgacatctcctttaaaccccgatagacaccaaccgccaacgtcaatcagcatcaaaaagtcatcattcttttgatgcgtaagtataattaaacgtaccgccgaagaccgtcgtttggagattcttgacagacttattgatataaatccgcgattgcgggttggtcaatggtacgacaccgaagtccttggcaaccaactgattttcaagctgcttgtagagcgttaatcgttgtgccgccgtgaggttaccgtttaattggtcgtccagatcatcaaaagtcttgctgttatagccaccaaagaatttttggaatccattgccagaattccataggctcaagtaggcgttcggatcagccgttgctaaccagccattagccagcagatcgtattgattgtcatttcgcatttggataaagctggcagtatcaggtgctgttttgacagtcactttgacaccaagattttcctgaatcgtttgcttcaaccacgtggccgtatcatcactgccaagcgtcaaataaacaaagttcagtttagtcaaatcagtcgacttccctaattcttgtaaaccttctttcaccaatgcttgtcgcttcgccttcgtgttgtactgtgcctgtgccgttttcaacggattgccgacgtactcgccataattggtcccgctcacatccaacgactgcggcaccatcgtgtatgttggcttgtcccgaccatcattcactgccttgttatagctcgttcgatcaatcgacaaggaaaaagcttcacgaaccttcacatttttgaaaagtccttgggttccaccgttgtgttgattcatgatcaacactttcgttgtcgaaccgttctgttttcgagagacgagtttgctgcttttggcgagttgattaaaatcgctgatcagcttgcctgaggcagatagtgcgtccaactgaccactttgcatgagcgaaagaaccgttgatggttttttcaccgttgtgtaattcacggtctggagcttcactttcttagcgttccagtatgttttatttttcttgagcgtgatcttgtcatcctttttccaagacgtcaatttaaacgggccattgaaaacttgatcttgcacgtcggttttccactttttgttgccgactttgttaatcttgtccaagcgcactgggtaataaatcacggttgccatatctgacaaaagtgatggataagcataggccagcctgatttgcagtgttttcgcatccaaggctctcactcctaaatcggccacactgcctttgccggtgttataggcttcggcccctttgataaagtacgcgctcgaagcctgcgcaaaagcattttctttcttcagcagacgctgaaacgaatcaacatactgctgggcagtcacggcttttccgtctgaccattttgcatcgcgcaacttgaacgtataggtcaacccatcggccgacttggtataagatttggcgccggtcagcaccaccctatccttgccattcgtcgattcaatggtcgtcagcccttcttgcacctcagacaaaatgtcattttcgttcgagttccgcatatcattcacatcgagtgtggttggatcatctgtttctgacagattcaaagtctgccttgaacccgacgccgaagtgtttttactgccgcaagcgacgagaatggtggcgagtgccaagccggtgataagtgctgttaccaagtggttcttctgcataaaaaattcatctcccaaaacaaaataaaactggcgatgcatctagagttctagatacaccgccagttttgtccttcgttcaagtcaagtgatcccgtcacccaaaccaaaccctagccatgtaaatagaactgctgtgtgattcacagcagcagcacattgacatggacatggcttggttaaactttgtcatcacggcgactccttccgaagaaattagcaacagcatacttttaaaaaaatagttcgtcaatgtgaaaatttaaaaaattgactcattggcattgcatcatcgtcatcatttggcaacaaaagttcgatgtatcagtgcttataggcaacataaaatcagcattaaaaaactaatgtttgagttgcggtaccagtaaatcagtcagtgctttgacagaaaatgggttttgtccggtaattagctgaccgtcttgaactgcaaacgacttatatgctcttttttgtacaaaatgagcattgtgtttatttgcaaccgttttgtttaaaaaaggaacaactttttgtttaccggctaaaatctcttcagcatgtgtaaaacctgtgatcttcttaccagcaatcaaatactgaccagcttggtctttgatatttagcaaaccagcgacgccatgacaaactgatgtcacgtatccttgatgctgataaattgccagcgctattgcttgaagtgcctgattgtctggaaaatcccacataacgccatggcccccagtgaaataaatggcgtcatattcagctggattgacttgctctggccgtaatgatgctgtcaaagcgcgttcttgaaaatcgtgatcttcatatattttcatgattgctgggttcgtatatttcatgctttgtggatcaagggggacaaagccgcctttcggactcacatagtcaaccgcgatgttggcttgctgcatcgcatcaacaaattctgctgcttctcccaaccacaatccggttggttcatctgtatgctgataacgtgttgtattcgttaacacaacaagtacttttgtcattttgctgcctcctgaatcacggatgtcacatcatccaaaacttgtttcagctgattaattgagcttgtatcatgggataaataataataattccgcgttccctcgcgccggtatgccactaatcccgcctgctttaagattttcaggtgatgtgaaaccgcaggccgcgataacgcagtcgccgtcgtcagttcacttacgcgttttccctgacaaggttgatccgctaacaaagcgatgataatcgcttgacgcttttcatcgcccagcgcgacaagaaaatcaccaacatcagatagttctttttgcaactgttttaggcttgacatttcttcaccctttcgtttaattatttaaaccattaaagcatgtaatgttgttaaagtcaataaatcgacacttggaggtgagaccacgattactgggattttccttccacagaaatgcgcttgtctactcctgaccggcaacaaaaaagctgatcacagcgtgttgccgcaaccagctaaactgaaccaaaaataccatctgacttgacgcctatgcgtgcgctgatttgcgcatcaaaacggctaacaaggcgatccctgcaagtgtgaacaaaattgccggtatcaaattagcggccgtaaacatcacgaaggccatcgtggcgaacaagccgccgatcgacaaaccaatgccccatttttgaacggctgtcaagctatggaaagaggtgcggaaacctagcgccagcaacaatgaaccagcaaaagcaacgagtccaaaaataatgtggcctaaaatcaaccagttgaacatatgtgtctcccccttatcgtttgcggacaaatgccaactgcaaaagcccgtgtgtcatttaaaagtatgacgtcttaactatacgtgagactatcacccctgccaactaaatctttcgagaataatcacccggtaacatttcgcccgccacatggagttggccgtccttcaacacgactgcatgatcccaaaaacggccaatatcatgccgatgtgaaatgacaatcatcgccaccggcagctgccgcaagaggaggccaagtgtctgtgccgaggccgcatcaagatttgcgaacggttcatccaaaagtaacatcggccgctgagccagcaaagcgcgggcaatcccgattttttgcaattccccagccgacacattgacaccatcttggccatgcacaagcgtggccagtccttgcgggagacgcgcaataaaatcggttagcccaacttggtgtaggacaagcgtcagttgctgatccgatacttgccggccaagcgtgacattattggccaatgtgtcctcaaataatgcaacaacctgcgggacaaagctcatgctgtttgctgatgccgccagatcgcgcttgtctgtatcttcaaactgaatcgttccagcttgtggcaccaataaacctagcatgaggcgaagcaaagttgatttgccgccaccacttggaccagttattaacattttcgcgtgtgcagtcacgtcgagctctaactgtagctggttcaaagtcggttgcgtagcatcaggatacgtgtaagtgacattatgaagaacaaatttagctggtttttgtcgtgactgtccacctgccaactcctctttatgcagcgattggatcaacggcaacaaccgtttgacagacaccaagttgcgcgtcaattcagcatactgacttggcatactgtaaaacaaccaagtaaaactcggtgtcaacatggaaaatgcagcaaattgaccaatggtgatgaccttgaagccaacaaatagcagctcaatgcctaaaatcgcaatgtcaaaaacgagccccaacgaaaatcccatcacaactgttttgacttgttgcatccccatctgatactgtgcctgagaaaacttctgataggcgccgttaaatagttgcataccaaactgttctttttgatagctttttaacaattcgcggccgttcaaaatttgcaagaggctttcctgcatctgactattctcaatctgtcgctgattttgcgctgtttgcaagcgaccggacatcatcttcggaatcaaaagtgccgttgcacacagaccgatgatcaatagcgttagttgccaagagctgaatagaccaaatgttccagcagctaaaaaggaaaaaccaccaaccaccaaagccgtcatggagcgcatcaacaacggcgcagcagtctgcacatccgtggtgaacccgttgacccgccgcccgctagcttgattgtcagttgcaatcggcccattcatccaaagctgccatcaattgcgtttgaattctttgaatcaattgatactgaccgcgcgtttgcagctttgccatcacaaagcgacctaaccctatcgccaaagctgtagctgcagctaacgtgatcatgctgactgtaaaagcagcatgttgcatcacactttgaatcacttgtgccagtgataactcaagaccagcacaccccaaggccagcaaccataaaatcgagacaagtggactatcaacaagccgccaaacttttttcaaatcagttatcatggcgatcacccaccttcaacacctgatcggccgcagtcacaaaatcaaacgtgtgcgtaatgatcacaaccccgcgcttcttagcttcctgccgcagcagttgcatgactgcctgttgattaaccgcatcaatgtccgacaatggttcatccaaaacaataaatggacgatctgcggcaataccgcgaataattcctaatcggcgctgttcacccggagacaattgattaggttgtaacgtctggtcaagatcggcagcataccgatcaagttgcagttgctgtaataatgcaggcaactttgttggatcagcctgagaagccaatagcaaattagccgtcacggatgccgtaaacatcacactccgctgcggcacaaacgcaaacaacgatgctgacttgattttagcaggcacaccctgaatctcgattttgccagtcgttggctgcaattcgttgagaatcagcttcagtaaggtggttttcccagcaccatttgcgccgatcaaaaaggtgatgccttgattatgaatctgaaaatccagatgttgtaaaatttcccgattcgtttgcgggtaatggaaactcacctttgtgccgcgaattttgatcgtatccggctgatagtcccccttcataggcgaaaataccggcattacctgctgtgtcagtcgtggcaatacgcgatcaatagaggttcgttgctgagccaagaaaccaatcgtcggcgctaatcccaaaaatggccataggattgaacccacgccagcattccaggcacctaacagaccggcaactgagctgccagtgacggttaacatggcaaaacccaccatcaacgttaagacctcagccaaatagacgccaccattgaaaataccggcaagcgcgccagaggccgttgccatttgcttcatgcttggcgccgcttgctgaaaataatcagcgtgtcgttgacgattgtaagcaaacacattcagattgcgaaccacagcgacatttgccaaaaaatcattgaaaaacgctttgtgcttgtcatcaatttgaataaaagtcgtttgcgcttgattttgttgacgaaacaagccccgcgaaacaccggcaaataaaccgccgaatgctacaaacatcagtgccaaatgccaagactgcgtcacgacataaatgacgccaagaaaaaccgtgatcccaaaatcgactagtggcaaaacccctgcatccagaaattgcatgatatgctgcgtgtccgttacgatcagattagtggcagttccattatcggggacctgtgtcgcgtcgtcttgcaaaaagttagccatcaaagcggtcgcaatgtcaccactgactcgtcgtttgagacgttctgtgacaacgcctgacaaaaaataaatcccagtgtagacaaccgctgccgctaacatcccagcaaaaatggccacaagcaagttgacctgtcctgaaagtgcaacggtcaaaccaagctgtatcagcatcgaaattaaaacgttaaaaccatcaatcagcactcgtagtgtcagtaagccaagcaaccagcgatatcggatagaagtgattcgtaaaatagtttgcatgctttaagtccccttcaagcgattggtctggccaatcgctaactgttgggactgcgcttttggcaacatcatgcacctacgcaacagcttcaaaacacacttgctcgcggccacacaaaaagacggcttcgcagccgcctttaatcaacgcaaataaaacatacacatgactaacgaccagaagcatccccgcgaaccgcaaccaaaaaactgattgccaacgcagtccctgcgttcaaatttgatagggtaaagcgtccattgatccgcgttggaaaatgcctccgttctgtttcaaattttattagctgtagcttagcagacgacaaaaccatcgtcaattaatttgcctcatcagcaacacaaaaagtgtacccatttcattttcactaatgcgctaaatcatcacagcaccaattttgctaacaagttgcgccgctaaccatgattccttttttgaaggctgccaatacatctgcaccattggcgattcgaacactgccatccaaataagcgtgagcatcatccttaatgctgatcgccccattttgaaaatccatcgctaaaccgctggcaaagaaaatcatgtcatagtcagacgtatatagatccagacccgcatcattttccaatttcacctgatagtccgaatccggctgatcaagcacaatcaacgtaaacttcgtcccgatactgcaggcgccgccttgcaacgaataccgcccgccaccatcatctgtaatcagcaacaacgtcttctgatcaatatgcttcttcttcatcaaatcaacaaaagcctgcgataatttgatcgttgccattgtatcgtcacctttcttgttacttacttttagtgtgacactttcgggcgggaaaatcaattgtgcgcgagtgaattaaccattcatttgatcataccagtgatgaaacaagttcgattgcattttgaaaaacgcctgcaagactagcttgctcattgatgacaatcaacaaccccttcaccaaccaaagctgaaccgtcatcagaaaaagatggcggtcagtaatttgaatcccagataaagccaagaattcattcaaatatgccatcagatcctgtttatttttcggcataaaaccttgaaacaacgccgcaaagtccaacaacttcgggccaagccgagcttcaccaaagtcgatgacaacgacttgccctgagttagtcaccagtaaattccacttccctaagtctccgtgaatccaagcatcgcgggactgatcaatgcgcttcagttcaggaaccatggcggctatctgatgaaacagaactggcttcttttcagataatgcttctcgatgggcacgccataatacggccaatggcattgaatctggtggcgaaaatgaatagtcaaattgatccaacacttgccgcatttgccgatagcttttaagcgtttcacgtaaggatggcggccgttctgtgcctgataaaaatgcctgtacttgatacgtctggccttcaatgacaacaaatggctgacaagcgatacttaataagatctcaggcgtgagttcaagacttctctgacgcacagcattgctcactgcaaactcaaagactgcttgcttttggctttgaatagtcttaacgatgtatcgccctgttgttgcttcaacttgccatgccatgctggttttgccattgtgcaaggcctgtagatgccgaacgctacctaaactgtaagctttcgccacactgtcaattattttcaactcgcaccttctcccaaacttacacaaatccattcacgattcctgcccaagacgaaagtaatcttgtcacgacctaattttctcaccttgcttcgctggtgtcgccgtttttcgattgaccccggctaaaaatttcaatccaacaagagtactagaaaaagtgtcaattataattgacaaacagtgagaattttcgtacattgatgatgtcatataaatgtgacatttaaagatggtgggaggtaaactcatgaaccgcgtacgcgactatcggcgggcacagaaaatgtcacaactggctttggcggaaaaaatcggcgttgctcggcaaaccattaatctcattgagaacagcaaatacaatccttctttggatctttgtctcaaactagcctggacgctaaaaactgatttgaacaccttattttggagggaagaaagtgaatcgaattgaaaagaagctgataaaaaacatttttggcattcagggtcccgttgacgaacgggcactcgcaattattggccgcgcctcgatgtacgcagttttgggaattcttatctttgaagtgattgttgacattgttggcatcgcgttgcctatttatcatgatgaaacggcttttgaaatcttgttaatgatccagttcatgggcgttattagtattatcattggcacaatttgtttaaccatcgggagatccggcttaaatcatcaagaagtaacaccggaaaaatactcagccgcactgaaaaggatacagcttaaaacaatatggtgtgggactttaacaataattaatgttcacgtcattgaagcgctattatcactgaaagaacgggcattactgacaagcttaactagtccacggcaacttctgcagacgattgtttttggttctatattctgcccgcttatatactggattgcaaagcgaaatctcaaagttgtttatgttgacgattgaagctatactttccgcactctgctgataaacagggctggtctatgctgggagtggcacacttgccctctgaaaatctatcaaggtcctatttcttataaaacaatttgaccctagaaacgtcatacatttctagggacaaattgtttccgccttttgctgtcagcctttaaagcaacctttttttgtcccagtcagtaaaacaaaaagataataccttcattttacccatcaagtattcaataattccctgatatacaagaaccaccgcgggaatcgaacccgcgtgcagagaagattatccgcagcaccagcgtggttgaagatcattttaggcaaacattaattgccgttatacgtgccgtcattgccagttgcaacagccgtcgttgcggtgtaaatatcaccattatcaaccacgtagactccgatcacaatattcttgaagcctgagttaataatattctgatagtgtccacccgtgacgccaccgttattttctggacgttccccaacaatatattgctggaacatcgcatttgcaatcaaagtgcttaatttatcggcattaccaacaacatcctttttgaaaaactgcgaactagaaatgttttcagtgctccgattcatgtaagtttcgcctttttggtagctgacctcttcatgaccagtagcaggcggatttatcggccgcgtgtggctaaagttgtacatgacttcaacagcccgcggtgcttccatctcgaatgctttagtgtcagaggtgataactgtttgcgtcttgttcgttcttgcctgttcgccattcacaagcacattgaactttttagcaacggcttgagtcagctcagcatcggtatactgctggccttgctcaatcgaaactttttgatcctgctttgtgacttgatcctgaatgagcacaatcacagcatcattcacactcttaatggcaccgatgatcgtgcctgctgcagcaacattgcgccaaacattggtcgtcgtaactgtcgtgaccatatcccagttgttaggatcaagtactgtcgctgacgttggggttgacgaaatctggatgtagcccgtcttatcggcgagtgcaaaaccaccttcatctacatccacttctttataaacggttttagcttctggcttgtgatacttgtttgtaaatatcgtcgtctccgtggtatgaccagtgctatccgttgacgattgccaagttgaagattgagaaatgaagtaataaccatctgttgaagtcaacatatttcccttgtcatcaacattaacagtcttattgatcaccgtggtatttggcttcgtatcctttttccacacaatggtggtcgtgaaggtcgtcgtgatattaccagtctgagcatcggtaacatcagcggattttctagaactagaaacctgcgtatagccgttcgtatttgtcaaagtgttgccagcatcatctacattaacggtattgttaatgataaaacgttgcggggttcgcttccatacaacagtcgtcgtaatcgttgtcgtgatgttaccagtcttaggatcagtcgtatcaacagattgcttagagctagaaacaactgtgtaaccatccgtactggttaaaacatttttatcttcatcaacgttaaccgttttgttgacaactatatgcgtcggggtttcgttcttcttccagacaacagttgtcgtgactgtggttgtgacgtcaccggtcttaggatcggtggtgtcaacggatttatccgaactggagaccttcgtgtaaccatccgtgctggtcaaaacgttaccagcttcatccacgttcaccgtcttgttgacaacttggtgcgcgatcttgtgatagatattggttgtggtgtaagtcgtaatggtatcaccattagccagtgtttctacagttttaactggggttccagctgtgatcaacttgtaaccggtaagatcgataagaacttgcccattttcatctttgttgatcgtgacctgtttttcagtatcctgtggtacatggatcgttggaattgtcttttctgcatcagcaactgtttgttgaacggcgggcaatgtctgttggtggtccatcgtatcaacctggctacttgtgttgctgcggttgttgtgttggcttgagcagcttccgcattggtttgagctgtggccaactgatcattccaagtcgccatctgggtattcaaagcttcgatcttttgatcaagttggtcgatctttgtattcaagtcagccagttgtgctttgacagcttgggcggcttggctattttgactggcaaccgaggtcggaagtgcctttaaggtcgtttgtgcctgagcaaagtcgttttgagccgctttagcttcattgtcaacgcttgttagcgcctggttagcagtagtgaggttctgagtggctttgttggcagcctgtttggcttgtgctaaggcagaagttgcgtccgccaattggccttcataactggtcaatttaccttgtgcaacggctagctgagctttgacagttgcgatagttgcttgtgaatccgggttatttttagacttatcagcaagtgtattcagctgattttgcaaatctgtcatctgcgcagacaacgttttaacctgcgccgatgcctgatcaacagcagtctgcttagcattcacagctgcatttgctgtgtcaaaagcagcttgcgcttgagccactgcagtttgggccgctggcaattttgcctgggccgcgtcaaccttggttttggctgcatcaacggcagcttgtgcagttgtccgcttggcttgaagatcggccaatgtttgagcattctcagtattgagcaaagccgtcaatttggcttcggcttctgctttggccttggcttcggcggctgccttaagggcggcttcgttatctttggtggtctgatcaatccccgttcctggggtggttacttgctgcccagcgccggaatttccagttgtgccagcgccgccaatggttgtgtatttcacctcagcctgttgtgccggggacgccactgccggcttggtcggattcagattaaacgtctgattcgtgccagcagcattttgcgtcgttactgttgcgttgtcgccactgccttgcagagaaagcttagcgccagcataaatcaagttcacgttagcaatgcggttaatggctgccaaacgatcaactgaggttgtgaaacctgtatgattcagcgcctcgctgatcgtcgaaagtgtgtcaccccactgaatatcataaaccgtgctattcgacgccttaatctgcgcctcaatctgactgactgggtgcagggtccaaactcgtccattatttgtctgtgattgttgcgaggttgctggttgatcacttgcatgcacaacctggccactagtcgccaaactaatgcctgctgtccccaatgcaaaagcggtcaaaccaatggctaaccaaccatgatgtttgctgtgaaccaaggtgaccttgtgttccttatctgtaagtactgaccaaagctgtcgtctcattgctctcatcgttactcctccacattcttttatgaaattacaaatgttattatacttcgttattaacaaagcttgtatttattaccccaaatcaaagcgtattctcataattttctttttttattgaagcatcacctttttgaattgatacgtaaacgtgaattgtacttcccaatttgaccaaaaccatttgtcgaggcaactaaagccgtcctttataaccttaacctaccgtttcgtcacacgaccaagttcctgcgatatccttaaaaattcagtccaaagctgcacgacaaactgcgataaggtaacatacaataacagtatgcttttgcaaactcattttggaaacgaggccactcatgaaacatcgcaaccgtttattttggctgattatgcttgtggctgggatctttttaatctatagcactgaaagtccggtgccgatcgctgctcgcaacaccgtcaagcaaggcattagcaatgtctggaccgccacaactgataccgtcagcacttggctaaacggcggtccgcgatctgtcgcaaaaaatggtgcgtcaattgccagcaccgcgccaagtcaaccgagtcaggtaccttcagccacaccgagtcaagcggtcgatgccacacctgccttgagtattgttcaagggcaccaacttcgaagtgtctattactaccattttgatgacgacttgccacagtctgaacacgatgtctttttaaaagccgtcaaagcgtataacgcaacgggcatcgtcaaactggttgccggtcaaggtaaaaaatccgataaccagatcacgttttccagttataaaaaagaaatgtcagcaaaaagttttggctcaacggaactcggtgctggcggcccgacaattattgtcgaaacctatggcagccaagtcaccgtcatcaaccacgcccgcgccagcctgaatctttcttatcctttacaatcggtcaacgatgcagtcgcgatgcacgagctcggccatgcgttgggactcgatcacagtcaatcaaaagcatccgttatgtatccaattacgcaaggtgttagtcagttgtcggcaggcgatattgcgggactgaaggcgatttatggcagtcgataaaactgttttatttaaaacagtcaatcttggtactatctgattttttgtaaaaattgcgttactcaaatcagcatcattatttttaaatgggaaatcattaaatactatcaaaaacctcgggcaaaatttgaaaattttgcccgaggtttttattatttgtcaaactaatttcccttaccaaacggtcacttgaatgacgttgataccttttctgcgcgctcgctgcaacaccgcttcatctgcaaaactatctgtgattaaaatatccaccttgccaagatcagcaatgtgatactgctgagtagcaccgatttttcgataatctgctaggcagatgacacactttttcgcctttgtaaccatcattgaatcgatcgctgccgcctctgcattacttgaagttaggccaccgtcaaccgagatgccgtcacagccgatcacggtgacatcggctatcgctgacgacaaaaagttcagcgtttcactgccagccagcacacttttctttgtactgaccctaccacccgtaatcataatcttagtgccctcatgccgcgcacaagcagttgcacatggattgttggtgataacggtcactggtattttagccagttcattgatgacttgcagacacaatgaattggcgttcatgaaaagggtgctgtaccgcgcaatgtaatggggaacagccgccgcaatcttttgggcaatcaccgccaaagttctctgctcacccccaccatgtccggcaatcgcttcaacaagaccgttgtgccatttaacccgccccatggcatgcaatattttcaggtcccgcctgatcgtgatttcggaaacctcgagccgaagcgccaatcctttcacagttgcaattccgtgccgatcaaccagtcgttcaatgtcagctcgccgcgcttgaacgttggccagtgaatttttcattaagcttgctcctatgttgtgactattgaagttcctgtcatattggtaacccaccacaattgtttgcatgtttgattgccaaataccctaaaaatgtgcaatcccactttagactcaagtcacttatcgcttcaacgccatccgactcgttgtctatcaaaaccagcctttcactttcaaaaaactgaaaaataatcataaaacctgcaaatgatcttataccgcaattgtgttaactaggacggtcagcgtacacttttgtatgttaatcgtaacgattacgattttcaacttcgaaaggatgtgctttttatgtctagttcctcgcatggattgaagtcaatatttgagacagattttaagagacattcagaaccgcgttttttgttcagttttcaaaggacgaccttgtcaaaagacaactttgatagattatcatgaccagcgttacatgtcaacgtttttttaaacattgaatatttattcatctgttctcgacgtcgcacattgcgcaagccatcaacttgatctaattaagtatatccgctaaagatcagcgccttttgttttgacaacaacaagtatcataccagcactttaacgatgtagtcaataaaaaattcatgcaaattgaaacattttaaaataccgaaagatcgcgaacgttttctccagaattgcataaaaattcagcatttctgcgaacattattctattcatcgtgacaaaagttcagaaaaaagaaccggctcatttgtgagccggttcttcgtctaaatgatcaagtgcttcagcgacccacccgtctaaccgagcggcaatcggtgcaaagcctgtgtgaaatttacgactggtccaataatgcttgctgcgacgctttttactcatgctaggcgacgcttgtaaggcacgtaaggataaactgattttttgggtatattcgtcgatgtccaaaatcacaacttcaactcgctggccgacggtaaaaatatcgctggtgtccttgacataaccatgctggcattctgagatgtgcactaaaccttgcgtgtgctcatcaagcatgacaaacgcgccataaggttgaacgcctgtcactttgccagtcaagatatctcctatgcgatattccattctgacacttcatttcattggatttctctttgagtataccctaaaaatcattgccgaccaatattagtcttcaatcgtaacctgatcaatcgtgaccggttcaaccggcttatcattagcacctgttttgactttactaatcttctcaaccacggacaggccacttaggacttggccaaagactgtgtggcgatgatcgagccacggtgtaccgccttgtttatacgcttcaataatgggttctgggaatccagcctcacttagttgcgcctgcatgctcgggtctaaatgcgcattagtcacaatgaagaattggctgccattcgtatttggaccagcattggccattgaaagtgcacctttcaaattgaatagctgatttgaaaactcatcattaaagggcttcccccagagactttcaccgcccatgccggtaccggtggggtcgccgccttgaatcatgaaatcatcaataatccggtgaaagatcaaaccgtcgtaataatgttttttggcaaggcctacaaagttttcaactgtctttggcgcctgttcagggaaaagtgcgatttcaaagcgaccttcgcttgtttcaaaaatcgcttttggtcccttaaagtctttgagttctaattgtgggtaatccatgatcaatctcctttacaagttaacgttcttgtactaggcgtagtataccagcccagcccctgagcgcaaactacacaggcttgctgatgcaacgatcgtctattaaaaaggctgcttacgggctaatcacacttgacagaccggtgttcagcctattttggtacttatcgtgaaaatatggtagtgtatggacgtcatactatatagaaacggagcattgcaaatgtcagtgcagcatgtatatgaaatcacggtaatcggcggcggcccggttgggatgttcgccgctttttatgcgggtttgcgccaggcagacgttttgttattggagagtcttgacgagcttggcggccaaacaggcaacttataccctgccaaaattctctatgatattggcggattcccgcatgttagtggcaaagaccttgtcacgcagctcaaaactcagctcgtgcattttcatcctgaagtcaagaccgctacggaagtacagacgatcgatcaagatccagatggctttttcacattgcatacaagtcaaggcgatttccgcagtaaaactgtgatcgtggcaaccggtggtggtgcttttacgccgcgcaagttagctgttgactatgatccggcattggaaggcaaaaaactgttctacttcgtgcaggatttggaaacttttcgggatcaggaagtggccgtggctggtggtggtgattctgcaattgattgggcactggcacttgaaccggttgccaaacatgtcagtctgattcaccgtcgtgccaaatttcgcggcttggaagccagtgttgctgcacttgaaaaaagcagtgtgacaatccagacgccttacctgatcgaatcagtcacccctcaagatgatcagttagtgattcaattgaaggaagttcgcggcgaggcacagccaacgctcaccgtcgacaagctgttgatcaactatggatttgtcaccgacaaacaccacctacaggcttggcaacttgacacggatcgaaatggtatactggtggacacacaaatgcagacgagtcgtcccggcatttttgcaattggcgatgctgtcagctatgctggcaagttgccgctgattgccagcggttttggagaagcgccaaccgctatcaatgaggccttgagccgcttgtatccagatcgacgtcaggccttgcacagtactcagttgtatcattaacgctcatctgcgtaatttacccatcaaggagcaaaaacatgacgaatgaagaaaaattgtatgaccgcacgattcaactgttacatgaacgcggggttcggatatccgatattggcgaacttgtaatgttcctgcaagaacgcttcatccccaagctgacacttgaagaagccacacaaaatgtgcgcattgttctgcgcaaacgtgaagttcaaaatgctgtgatgactggtattgctttggacaaggcagcagaagctaacagtttggaagaaccgttgcaaaaaatcatcgctgaagatgaaggtttatatggcgttgacgaggtgcttgccttctcgattgtcaatgtatatggttcgattggttttaccaattacggttatattgatcgcatcaagccagggatcttagctaagctgaacgcccatgagcctggcattatccacacctttttagatgatatcgtgggagccactgctgctgctgcagcaagtcgacttgctcattcacatccagaaattgaagacgacatttattgatgttttggtaaaattctgtcaggattcatgaaattttcacaccaatccgtataataagctgtaattcattaaaggagttcacaagatgacccaactgttcgacttcatcatgcatattgatgagcatctgattaccatcgttaatagcttcggcccttggacctacgccatcctttttgcgatggtcttcatcgaaacaggtgtcgttattttccccttcctgcctggtgattcattgctatttgctgcaagcgcgttggctgcaaatgccgcgtataacctgaatgtatggattctcttcgccgtctttctggctgctgcggttattggggacaccgtcaattatgaaattggcaaacgcgttggttcggcagcatccactggcaatggctggtttggacggctgatcaatcgcgacaaactgaagcaggcggaggctttcttcgacaagcacggcggtaagacgattgccatcgcccgctttatgccgctgattcggacatttgcgccgtttgtttccggcggctcccgaatgcattacggcaagtttatccattacaacctgttaggcggtttcctctgggtcaccatgtgcgttttcggcggtttctacttcggcaatgtcaccttcgtgaaagaacacttttcgttggttgccatctgtatcgtgatcatttcccttctgccgatggtcattgctgccattaaaacccggacagctaaagctactgaacgctgagcaaaatgatttgcatcaaaaaaacgcatcgcctgtcatgtggtaaattccacgtgacaagcgatgcgtttttgcttgcgctgccaatcatgccaccttcgcatcttgacgcccgcgccaaatgccccagatcatgacagcttcaaacaaagcaaatgctgtcagaaaacacaacatgaagaatccttcaggcaaaacgttgatgatcggatcagtttctgggtcaaacagccagtcgctattgcgaaaaaggacttcatgaaacgtgatgaaaaattggtcgaagttcaccgctaatatagccgtcaacacaacaggtaccacggccccgatcataaacggacgaaccaacaaatatctttttctggcaatgcgaagttgatgcaaccagcgtaccgcaaatgggaccgtgaccacagcaacccctatatcgaagagaaagaggtggcgaacatccgcaaaatgaatggcgccatgtacgcttgtggggaaatcattcatatgcagagtaccaacccacggtaaatttaagtaagccatcagctgcaaataattctgataaagtcggccaagggacatcacggcaatctgcggtagatcatccatgtgtgcataaactggaaaagtgatcagcgtacttaaaatcgtcatgaacacaaggacactaatgatggctagccacaatgctacccattgggcaatacgcttcatggaggttaaacctcccaatccgtcaaggcatcaatctgatgtgtgggctgatggacttgcttggaaacataatcacgggtagaaacgccggtatacactaaaatcgtatcaataccagcattcagccctgccttaatgtccgtgttgtaattatcgccaaccatggcaaccgcttctttaggtaagcccatttttttcaaggctttctccataatcgttggttcgggtttgccaatgtaaaaagcccgctgctgtgtgctgcgctccactagcgcgatcaatgagcccgcgcctggaaccaaaccgcgctcattcgggagattggtgtcagcattcgtcccaataaactttgccccgcgtttaatcgccagtgttgccagttcaaacttatgataagtcacatcatagtcaaggccgacgaccacataatccggatcaacttcatttaatcgtaatccagtatccagcaacgcctgcttgaggcctaactcgccaatgatataaatggacttacccgtcacatcgccatgattaaggtcggtcagatacgctgcagttgctagtgccggggtgtatacctgcgccggttggacatgaatatcatgattctctgctaagtttttgaccacatcttctggacttttggtcgtgttgttagttaaaaataaaaacgggatttgtgccgcctgtagtcgttcaacgaaatcctttgcagcgggaatccgctccttaccgcgatagatagtgccatcaagatcgatcatatagcctttatacttcaagttcgtccctacttcttattagtctcacgccgccgaatcgtaaaatgtcgcttgcgtggttgtgtctgattgatagttttaacctgatcgccgcgaattttggttggtcgggttgttttttccgtatacggtttttccgcttttgctgaccgtggcttatgcttattgttctggctgttgcgccgatttgttgggggtgtctggcgatgcactggtttgatcgtttctgatctctgccccgcctcacgatgtccctgacgacgatgcggctgcccttttgtcactgacttgtctaaacacgccaaaacaaagtaagcacagccaaaattacaatattcatacaaataatcttcaagtgtgccgatgagctggtctttgctgacaccgcgtcgatcatctttatagaatccgcgtaaacgcagctgatcatagccccaatcaccaacgatataatcatacttatcaagaatttcgttgtagcgttcgttcaaacgcgcaacatcaaaagcatttcggtgatccttaacaaggcgatagcggcgaccatcaatcgttagtaaatcaccgttaacaatgaccacccgcgaatctttatcagcttctggggtcaatgcggcatcaatttgttgcataagcggttcatgttcgcccatgtgctcacctccttatgtgtgctgatgcttcgcaaagtatatcacgaaatcataatggatatttttgagctaagtactcgcccaccacattccgtaatagcttaggaaaaagcaattcattgctgcccataatcttaatggttggaaagaatggaatgaacagaaaattgtccaccgtcacaaacgtatattgttgttctggcaccaacggtttcccatgccatagaacaacccgtttttcacgattaacgctaatcccccggtaaccaatgtcaccaaaaatctttccacgaaaactcatgccgatcatatgaaaatgtcgcaggaacattcgattcttttccatttccatgattaagcgccacagttccttaccactcagcgttacttttaacagatgcatgggatgcggcaaacaggttaataaatccgcttgggttacaacacccggacccagcggcataaggaaaagtccggcatttaaaatcgccgcgtccacctgagcgccatcagccaatgcttctaaacctaaatccagtaatggtgaaggcccatcatatttgatcgatagctgcttgggcaaccgcgccacctgatgctgcttgagcaaagcaattcctttgctctcatagccctgtatctcacgcgggtcagcagctgccgcttgcatgagctcagttttaaatgtctcggcctgacgggtgataatttgatgctgatcatccagcgtcagcgtcactttgccgacataatggccatacttttctgcagctgttaataaggtggtgccatgtaactcgccgtctgccaataaatgatgcgtatgaccaccaatcacgacatcaatctctggatactgttttgctaagtgccgatcagcctcaattcctaaatgtgacagcacaattaacacgtcataggtacctgataattgcttcaaaatatccggaaatacatccgccacggttttaacttgccagccatttggtcgatatgtcagaaaaaatggcgccgtgaatccgacaatcgcaatgcgtgtaccagcacgcgtttgcgttcgcacaaacggtttagcccatgtcggtcggctgccgtcaacctcgaataaattagccagtgccactggaaagttcgcatgatcgtataaatgttccagcacatcatgcgggttaccgacaccttcattattgccgatggttgctgcatcgtaaccaatttcattcagcaattgcacattgatctgaccttgcgtagcttccgttaagggcgctgagcgatccatcgcatccccgtcatcaaatgccaacacactcgcgccttctgcttgttctgcagcgcgtgttcccaacataaaccgccgaatcttcggccaattttcaaaatgagaatgcagatcattggtatgcaggatcactaacttttccacgagaaacctccctgtgccggcaaaaataaatactctaactggtgaatcaccggcgcgctttcttatttttatcctatgctctgataagcgggcggtcaaacaaacggttgttcatcgattttgggctaacgcatgggccttaagccgataaatttcatgcacttcagcagcggacagcggtgtcccaaatggcaggtgtggcatcaacaaatcgcgttccggtgcatctaccccgacattaatattctcagcgagattgacgctgttgtgatgaatatgaccatgtaaattcagtgtttgtttgacaatccccatcatcaacgggtagtgcgtcataatgaattgtgtatggtcgtccttaataatggtgccaacatcatgaaacgtgaattttggctgtccattcacaccaggatcatttcgatgaagaaacttgaacagtgactcataatcatggttccctttaatgaagacaattcgaccgttcagctgttttaatataccaagcacttctggtggttgcggaaaatgctcaggattcatcgcgatatcgcctaaatgatagacaatatcccgatcccccacgcgagcattccaagcattgatcattgccgtgtccatagcctcaacagaggggaaaagtcgcggtgcaaaatcgttttggcctaatagatcggcgtgaaaaaaatgagtgtctgcaatgaaatactgcatattattcctttctgcgatgcgcatgacgagttgtcacaacccaagttgtcatcggtaccgtcaaaacaacggcaatgaccgaaatcaagacttgcaacaactccccaacaaagattttattattgatgatttggctgaacggataacgcaaagatacaaaccaaatgaacaatgatgaaaacccgccaaaaaaaccaaagaacaatgtatttaacgccgtgccaataatctcatgccccatctgtttgatgccggcatcacttgcttgatccttgatttcatccatccccgccgctacggcaatagccgcctccgcgatggctcccagcgtgcctaataaggttgttgcaatcaaaatatgcggaaaactaaccccgatgtaaacagagaagccttcaagactttctgaatcttctggtccaaagccagctgtctgactgagcgtcatagtcaaaataatgagccccacaagcaacgtcatgattagcaacgcggaaacaaacgctggacccgcaaccgctacatgactcgtgctcaagaaaatggtgctggctaaaataatcaatccgaataccacagcgagaatgattggattgaacccgctcgccatcaagatcacgactaaaatcataagcaaagcattgaccgtcagcgcaaagaaattggctaggccttgtttgcccccaatcaagagcatcatgactagtagcaatagtgccaaggcaagaattgcattcatgctgccaccttctttattttagccataaacgcggctaaaccgctcgtcattggcaccgctaggacaattccgaaggcactaattaaactttgggcaaaaccaagccccatcacccaaatgactgtttgtgcaatcgagttattattacgaatccatagcactgattccacaaaagtatcagcaataaagatcataaagagcactgaaattagcggtcccatgacattccggccgattgccatacctgcctgaaaccgttctttggcgctgtcatgcaactgaaaaatcgccactgaaatgtcacttgcttcatcaagaacagcgcctaatgaaccaataacaatctgagcgaagaacagcaattgcggcatttgcgtcgcatatttcacttcttccagatgcacaccgttataatttgtcaacgtcagtacaccatagcctagtgccacagcaaggccagttgccagtaacgatcccagtgaaattgtgacggcaatcggcttaaaaccaacaatgaaaaccgcagtcagaattgtaaatacgactgctagaccaacaaacaaccaccacgcctgccattgcttactgccaatttcccacgttaccgcgataaaaaagatcactgtgttcaaaagaatactaatacttgttaaccaagcgcgacgccccataaccaaaaaaattaggccaaatgtcaaaacaagcaaccccgcaaggatggcatcgcgtttgatgttgttgagcgtatagacgcccttatcgacatctaaaaagatttgttcacctggccgcaactgattgtctaaaccgccgctgaacgagtacgtattatgaatggtgacgctttgcccgcgttttgctgtgttcagtaaacgcactttaacctgttgcttggttagccgatcatgattctgatcctcatcatcatgactggtcgttttaatgacttgaactgattcgacacgaccgactggtttggcgtaaagactgctatcaaactgcatgccaataaaaaccgcaattgccgcaacgaacggaataagccatttaccaaaatacttcacgctgacgcctcctcacattcacccggccaaaattagcctagtgaatgccctactttcatatgccctacattatataagcggcgtcaacgtgacgcaaaatgcggcgtgtaccaaactaaccgaaaatcaagccaactacgcgacgattcgcgatggtgctcacctagttagcgcggtgggtgagactaaagccaccgcaccgctgctagcatcacccaagccaacgttaccagtgtgaatgccagtgtttgttaggttttgtttaaattgttactgtcgctgacgatccagcgatatcaccactcatccaacatggttctgcttcagaatctcgtggtaagcctgacgtactggcccttctggtttgtcccactcttcccagctcgtcaaatcagctgacgggaattcataatgatcgttgatgtactgttcgtaagctgtcacagcagttgaatggggaatgtttagttgaacgatccgcacacgtttaataagccccttcatagccgccttttccgcccgaccgttcatcatgacgttacctagttcaaaatagcgactaccgtcattgagtgtgatttcttgaattaaatcgaaaacttgaaatttatcagccatgttcttcatactcctttatcaatttagccactgcttgtcgtgttctaaaaattgtcccggctactttgcgatgctatgtttatggtatgatgtttttttctggaaaggagcagcctgtatgggcaagcgactcacgctggcagtgctattgctgcctttattccttctgctttcgggtttcacgctgatcggccatcgcggcgatccgttgaattatccggaagagacttatcaaagttttgacagtgcttttaataatggcgccgactatgtcgaactggatgtgcatgaaagtgctgacggtgtcgtggtgattcaacacgactcaacgattcaacgaatgaccggcgctaatttggcaattgccacaacgaactttgctcagcttcagcaatatcataccaaaaatggcgagccgattcacagcttggaagatctcttcattcatgagcaacaaaccaaccataaatttctaattgagaccaaaatcgtaaagggagaacctcatccccatctcgaagacaaaatagcggcattaatccaaaagtatcacatggaaaatcgtgtgatgtttcactcattttccgctgcaagcttaaaaaggcttcaagccgttttgcccaatgtgccccgtatccttattgttggctcacttaaacgaatcaattttgatgtcttaacctacgtagatggtatcaacctgagttcggacttagtgacaccgcaacttgtgacccaacttcacgatcttggcaaaaaagtctacatctgggacgagatgaacgaaaatcgctcattatggacttggctggtgaatctcaacattgacggtatcgtcaccaactatacggctctagggcatgaatttcaggcattgaaggccgctgcagtgacaaccgatattaacgatcttggtgccaactccagtaccacgcccttacccatttacgaaaatccatatcagccgacgttgcgccatgaacaattagcgcctgaaacccctgtgatgatttccagcatgatcacgattgctggcaacacctattatcaaattggcgacaatgctttcgttccagcgacaactgtcaatcttgcgccgcaagccggatgggctagcctcttcattaatcaaaatgctgttgtcaccggaaaaaaatttcgcgtgccagtatacgctgatccgttgcatcaacaagatgtcattgctcacatcgctaaccatacgcgtcatcacatcacagcggcacggtatgaaggcaatcacctctatgtaaagatcaaaaccggttggctaaacgcccaagatttgcaactgttgccagatgctgaaaatatgactacctggatgagtcaatatcgcagtattcctgctgcacaaaagccacttgtccactgggcattaggcgacacggcctttgacacaccactgttgaatgctagcgtcgttggcatcggttaatcgccgaaccactctcaatcataagccgttcatcaattgtgactatcaaccctcacaatttgatgaacggcttattagtttcccatgattaaacatgctatcctaaagacaatgacagtaagaaagtaggttaacctcatgacgattaattggcagcaagaagcagagaagttagaaccgcaactcctttcagacttgacaacccttttgaaaatcaactctgagcgcgatacggaccatcaaacaaaggcgtacccacttggcccgggaccggccaaagcactggaagcctttttgaccattgccgaacgcgatggtttcaaaacacttaatgttgataacgttgccggtcgcattgagcttggcagcggtgacgagatctttggtttgtttggccatgtggatgttgtgccagcaggtccaggttggcaaactgatccattcgtacccgttatcaaggacggtaaaatttatgggcgtggcactagcgatgataaaggaccaagcatcgcagcttattatgccttaaagttgattcgtgatcttggcctgccaatcaataaaaagatccactttatcatcggcaccgatgaagaatccgaatgggtcgggattcatcgctatctggaaacccagccggcaccggattttggcttctcaccagatgctgaatttccaatcatcaacggtgaaaaaggcattgccagtttcaaaatcgatcaaaagccaattgccgctgcaccagctgagttaacgctcaccaacttctcggccgggattcggccaaacatggtgccgcaagtcgcaactgcgaccatcaccggcaatttaccagaaacttttgccacacaagcaaccgcttgggcggatgaggctggcgtcaaacttacccttactttgggtaatccaacaaccattgaagttgtcggcaaaggtgcacatgcacaggagccaaaagatggcaaaaatgctggcacttacttggccaatctactggcagacttgccatttgatccagcaggtaaagcttatctcctgatggtcgctaaatacttgcacaacgactcacgaggcaagctgttaggcatcaattataccgacaagctgatgggcgaattgaccgccagcccagacatcttcacctttactcaagatggcgaacaaagtgtgcttgtgaatgtccgttatccgcaagggacagatgctgacaccattcgtgatcagattgagacgacattaggcgccgacaaggtcaccgtaagcatcagtggtcatgcccaaggccctcactatgtgccaggggatgatccattggtgaaaacacttctccaaacattcactgatcacaccgggatcccaggacatgagcaagtgatcggaggcggaacttatggtcgtatcattaagcgcggcgttgcattcggtgcccaaatgccaggtcaagaaaatgtgatgcatcaagctaacgaatacatgccgattaaggatatcatcacggctgttgccatttatgccgatgccatcagtcgcctggtcaagtaatctctgggcgtcattttatcgacattcagttcatgcaaggccgtcttagttttaaactaggtcggccttgttggcgttaaccgttatcaaaacgtctgaaaggaagcaatttatgtttgaacctgatgctttaaacccatggttagatgatccccgtttgcgtgccgctgtcaccacagcaggcaccgtcacatccacaaatgtcattttaaaaaagtccgttcaaaacggcggccccttaccacagattttaattgccgaccagcaaaccgctggcgttggacggcatggtaaacattttgcaagcccagctgatgctggactttacatcagctatgcgtttcatccacaaattaaccgtgccctaatcacacctgctgctggtgttgcgcttcaacaagcaatcgccgatcagtttggcatcagcactcagattaagtgggtaaacgatctacagaaagctggtaagaaagtcgcgggtattttagccgaagcgttgttggaacaaaatgctgtcattttgggaaccggcgtcgatcttttccctgctgccagcggtcctttgccaaatgatcagccgatgacaaccattttgcgcgaggtccctgcaaatgatccgcgtcccgagcttgctggtcgttatttgacccacttgatgcggctttttgccaatcccgagaccatcatgccagcgtaccgcaaacgagcagcgtgggttggtcgccgcatcacggtcagcggcacacaaaatccgctgaccgggacgatcagcggattcgatgataacggcgctttactattaaaaacagatcttggcacattggtggtctcaagcggcaccatccgactcgttgaaacagtctaagtcacttcagttaagcgtcaatagcttcgtcaaatcgctaaattcgttgagttgataagtcggtgtgatgtgatcgcgatttggctgaaaatgtggattaaaccaaatcgaatcaattttgccattgatcccaccttgaatgtctgaggtcagcgagtcgcccatgatcaatgtctcacgccggtcaaaccgcgggatgcgtttggcaacatagtcaaaaaaggccacggtcggcttcgggctgcccacgctatcagaaacaaaaatatcttcaaagtaatcaatcagaccgctcgatgccaagcgttcacgttgcacaggctcgataccgttgctgacaataaacagccgataatcctgcaacgcatccaaggtgtccagaactcgcggcagcaaaatggcctcttgatccaaaaaatgatgataggtgcgttctgccaaatgcggatcagcctcaatgtgatgatggcgaaagagtttggcaaaccgcacatcaaataattctggccgcgtgatgcgccccgcttcgtagtcacgccatagactggcattaattttcagataacttgcctcaatccgcggcgagtaagtcaaattgagtctggcaaacatctttgccagactttttagttcacctgctttaaaatccagtaacgtgtcatcaacatcaaacaaaattatccgatacatactaagctcctattctcgtcttaaagctacatgctatcagttttacacacctgatgagacgtgacaagctgtttgcgaagtcagcgcttaggcttcgccactgcgtcaaagatgtgctcactagccttggaatctgcagacaacgaccccgtcaaaaaccggtcatcacgcctcaagcagcttacaccccggttttaggctaggtcggttcacacgcctcaacaaatccccggttagaatccgcttaatatttaaggtatactaaggcgtattagaccataatttaaggtgggacaagcatttgaagaagttctttgatcgagtcaaaacgctcgggactcgatttcgccactggttcactgcgtttgtgacccggcgtcctgattccgaagcagagacaacaaacttaactggcaaggaggccgttgtcttttacggcaacgtcaccttacaaagtattaaaaccattgtttattacttactcggcgtgctcggtattgcgactgtctttggcctcggtttattcggcggctatttcgtttcaattatcgatgccaccccgattccgaccgaagctgccatgaaggccaccctttccaatacaagccgcacttccagcatgtattttgctcacaatgtcaaactcagcaatgttaaaagcgatttggtctcaaccaaggttgatttgaatgaaatgtcgccttggctgacaaaagccattgtcgccactgaagatgaagacttctatcggcatgatggcgttgtacccaaagcggtcattcgtgcttttttctctgatttaactggcatgggcaatcaaaccggtggctcaacattgacacaacaagtggtcaaaatgatgtttctaagctcagaaacgacctttaaacgtaaagcggcagaaattatgctggcccggcgtttaaataatcattttagcaaggatcaaattctagccacgtatttgaatgtggcgacacttggtcgtaacaataaaggtcaaaacatagctggggttgaggcagctgcccaaggcctattcggcgtctcggcgaaggacatcaacctgccagaagcagcgtttattgccggcctgccacaaagtccgtttatttacaccccgtataccgcttctggcgcccttaaaagcaatctcaaagatggtgtggatcgtcagcagaccgttctattccggatgtatcgagctggggtcattagtcataaacaatatgtcgacgccaaggcatttgatatcaaaggtgcttttctccagcatgagaatgctgaagaagacgacaatcaatatggctacgtgtacaacatggtgttaagcgaagccgaatcattacttgctgagcagttggctaaaaacgatggccattccgccgccgaattggcgaaagacaacgccttaaacaacgactatctacggcaagctgctaatcttttttcatcgaaaaattatcagattaaaagcacgattaacaaagatgtttacgaccggatgcaatttgtgatgaaggcaacacgcagcacatttggtcagacttataccagcacacaaattaatccgaagactggcgaaaccgaaaccattaaacatccagtccaaaatggttcggtcgtcttggacaatcaaaccggggctgttttaggcttcgttggcggagtctctggtgaactcaatcatatctatacattgcgttcgccaggatcaacgattaagcctttgctagtttacgcgccggccgttgaccaaaaaatcatcggctcgcaaacagcgttggctgattttaaaaccgatctcggcaacaattacagcgtgacagactacggcggtcagattcagaatcgctttattcctgccaccgaagcgcttgcccaatcctacaacatcccagcagtcaacttatataaacacatcaagccgaccgttaatgttaaggactatatggataaaatgggcatcgataccctcaccaaaaatgactatagtcagcttggactcgctttgggcgggactgattacggggttgatgtcaaagaacaagccagcgcattttcaacctttgccaaccaaggtgagcacgtaccagcctacgtgatttcggagattgtcgatccgtctggtcatccaatctatcaacataaggttaagaaaacaaaagtcttctctaagggcacgacctacatcatgaatcaaatgttgaaaaacgtgattgattccggaactgcggaaagcctcaattatcaactccacttcaacactgataacctgatcgggaaaacagggacgagcaatgatttccgggacatctggtttattggctcgacacctggggtaacaatcgccagttggatgggctatgacaataatgatggcacaacttattcactagatgagactggctccatgaccaatgaagcctattgggctaaattaaccaacgcagtttaccagacgattcctaaacaatttaaggttaatcagaaactggcacgcccggatacggttaaatcagtgactgtcgataaacaaactgggcaacccgccggcaccttgacttttgacggaaacacctaccgaactggcggctcaaccgtcaccagcctttacaatgattggcagccaaccacgaaaaatgattttgccatcggtggcagtaaagctaattatcagttgttcttcgaccatcttgatggcaaacaaaatggctatggtcaggtttccgatgccaacggcaattcaactgaagccaaaaaagaacatcaagaaaccccgatcacgccaactgaagatactcagacgacaactagcagtcctcctagcgtgacagtgccatcaagtcagcaaaaccaacaagggacatctgaaaaccagccaagcgaaccacaaaccacagggactggcggcacgaatggcgccaccggcactggtgggactggcggtactgggacgaccacagaaactggcacgacaaccggcacaggtacaacgactggtggcggtacgaatactggtggcactaataataccaatcaacaacagaccccgcctgcaacaacgactggcggcggtcagtaacaacacgatcacgagttttcatttcaacgcaaagaaaaaaggcctccaagtaatttgcttggaagcctttttctttaccctaatgactttacatggtaagcgcacgattgtgaggtacatttaaaacggcttcggattcccttatgatttttgttcagttttcaaaggacgaccttgtcaaaagacaactttgatagattatcacgctgacaaacaactgtcaacatttttattaaatatcctgttaaatggaagatgcaagcgcttctaccttaccctttttagaaaaggaattgctttttgacagcaataatataataccagcaactcagacggtgtgcaagtatttttttgagtttccagcaaaaccacgcgatgctcctagccatacggcctaattgattgttgcgtgatgttgcttaacctacccaacaaaaagcggtacatacgacttaatcgccgtaatgcaccgccttattggactcaattacttcatacctaatttcacttggcaatcagggcaaataccgtaaacttcgaggtgatggccactcactttaaagccggttttcttagccgccactgcttcaacatctgtaacgcctggataactgaaatcaaagattctgccgcagtttgtacaaatggcgtgataatgtggctcaatgggaaaatcaaaatgagtggccgcatcattagacgacatttcttcaactagattaagatcaaccaaaagccgtagattattatatacggttgcaacactcatatgcggaaactgcggcgacagcttcgcataaatcatttccgcagtcggatgtgccgtactgtcaatcatgtacgaaataatcgcttcacgctgcggggtgacccgaatctgcttcgctttgagcaagttaattgttttgttgtaaaccgcctgattcatagccagtctcctatttgtaactattatcatatagtaaaattgtacgctcttttctaatctagcacaactgtttacttacaaaagttcagaataagcagcttcaggtcagtaatcccattcgctacagcacattttgtggacacagaaaaagcagcgctcgccgctgaacgctgctttcaatgaattcgattgctactttgactcgctactgctgctatcgctatcgtctttaagttcgggtgcatcggtcttatactcatcggcaactgacttacccttgttttccgctattaggctcgtgcccttcttttgcgcggctttcaactttttctttgtatctgtcagcttatatgaaaagtcacttcgatcaaccttcttaaaaccggccggtgtatagaatcgcaacaaatcgccgttaatgacgcgatcagacagagaaagttcggtggtcactcgattagtggacgcatcaacactttccttctggctttctgataatttgtcgattttcttaccagtcgtggtattgaaatattgactaccaacctttgtaaagtctggcgtgacaaagtcgccgtttcggaaggccacggtttgcggatgatccgcggataacaagtcggacccaaattgaactgtatcgttatctttcacacctaacaggttcaatattgttggcagtgcgtcaatctcaccaccgtacgtatgattaataccacctttcaagcctgacatgtgaatcataaatggtactcgctggtacatggcgttgttataatcattgaaaccagaaatgttcgtaagctttgccatggcttttttatggttattcgaaataccatagtgatcaccgtaaagaacaatcattgatttgtcatacagaccagtttccttcaaccaattgaaaaactcacccagtgcttcgtcaagataacgggcagtttgaacatagccatcaacggtgtcgtcgccagtatccgtcttctcgatggtttgattggctttatccaaagtatacggatagtgatttgtgaccgtgatcattttggcatagaacggttgtggtaattgctcaatgtactgagctgagtctttgaggaaaatcttatcctttagcccatagccgacatcgtagttcttcccacttgaaaaataatttttcgagaagaagtagtcatagccccaagacttataggtgttgtctcggttccaaaaactcggcacatcgccgtggaatgatgctgttgtgtaaccttgctgatccaaaattgctggcgctgcctggaaagtattggttgtgccatcagtaaccatggctgcgccttcaggtaaaccaaacagtgagttttccatcatcatctcagcatcggcagttttcccttggccaacttgattaaagaaattgtcaaaggataacgtatcagattcatgatagagcttatttagattaggcgtcacttcctgcccatcccatttgaagtcaatcataaactgctgaaggctttccaaatggatcacaaaaacgttctttcctttggcaacaccagtatattgcgcattaggtgtgactctgttcttattaagataattcaaaacagatttcacatcactcgaatcggcgtttgctttcgtggcactgttttgtgctgttttgaccccatcaacaacagtataggcattaagccctaaatacttaacaatatagttattgtcaaaggtacgcgtcagtaagcctgaacggtcactataagccatactgagattagctgcgaacatcgtgacagctaacaccgaaaccccgagcgcaaagcgtttcttaatcggtcgaatgtccatccggataactttaaaaacaagcaacagaatcaaaatgaggacgtcagcgaaaacaataaaatctgttggttgcacaatacccatgatgcctttattgaggttattggacacggcgcctgaccctttgatcaatgcaaatgtcagaaagtccgaaaattctcgatagtaaaggacattggcaaaaagccacaccgatgtaagtgcatcaataatcagcatcgtaatgtacgatttacgccctgacatgtatagtgcgatgccaaaaaggaacagtgtggttggaatcgggttgatcgccaagatcagatgttgaaagctgccggtgacgcccagattgaattttgattgatatgcccagtatgtcttcgcccaaaaaaggacgatggcaagcacaaaaaaaccgagccgggtattaaaaaatcccctgagtttactgccaagctggttcatgtggagcctccaagtcattgtttaatgtcaaaagtatagcacattcgctaggataaccgcttgttttgaaaaagacaaactttctggacctatttgggccaatccatggtgattttaaagaagcctttaaattcggatcaggttttgacggctactgaataccatttccaagcgcttctgatcatgtgctacacaaaaagcgaaccttgtcagttcgcttttgtcgttgatcaagctggtgcttgatcgctggtgctgtcacttgtgccatcgtcttcatcaaaatccatcaaatcatagatttccatggccgcaagatcgatattatcaaactgaaaggtttggtgagtgcctaattcttcaagttcataagtttcggtcttgggatcgtatgtcacgaggcccttttcatcaccatttttttcgaagcggcgcgactgggcctcgccatcgcctgcctgcatggcttctaggcgcttgatgatggccacgagctgtgattgtttcataaaatggcctcctataaacgcgatcaccaccttgcgagccaacatgccaatcattggcactgacacatcgaatctcatctgggcgggatcacgcgctgtttatttttcctatttcaagaaatagcttagcataaaccacggcctctgtgggagaaatctctctttgaattgcagttttattgcattgcaactatgagggaaaatggactatgctatttgcaacctacatactaaggagatcgcccatgaagttgcaaccattaaataaacaattagccgatatcgacgttagtgaaatccggcaatttgacgaaagcgttagcaagattcccggtattttgaagttaacgttaggtgaacccgatttcaatacgcctgagcacgttaaacaggctggcattgaagctattcaggaaaattattctcattataccggaatggtgggtgatccagaactgcgggaagctgcgcaacactttttcaaaacaaaatatgatactgattacgctgctgaagatgaaattcttgtcaccgtgggcgctaccgaggctttggcaactgccattacaaccatcagcgatccaggtgatgccatgctggtgccgtcaccgatttatccggggtacatccctttgcttacgttgaatcatgtgacaccgatctatatggacactagcaaaaccaactttgtcttgaccccagcgctgatcgaagcaacgattgctgctcatcctgatgccaaaatgaaaggcatcattttaaactatccaagcaatccgactggcgtcacttatcgtgcgtctgaggttaaagcgattgccgcaactgctgctgaacatgatctttatattatttgcgatgagatctattccgaactaacttatggtgactcacatgtttccatgggcagttatgcttacgaccgaacttttgtcgtgaatggtctgtcaaaatcacatgccatgaccggctggcgaatcggttttttgatgggtccgcgagttttgatcgcagaggcgaaaaaagtgcaccagtatctcgtcaccgcggcaaccaccattgcacaacgcgctggcatcgaagctttgacgaacggacaagatgatgcacaggtgatgaaagccgcctatgccaaacgccgcgattttgtctatcaggcgcttttggacatgggcttcgacgttgctcggccggatggcgccttctatctttttgccaaaatcccgatcgaactggggcttgattcgcgacaattcacgcaatcgcttgccacagagcagaaacttgcgctgatctcaggtactgcgtttggccctggtggcgaaggttatattcgcatcagctatgcggcttccatggctgacctcaaggaggcagtcaaacgtttacaagcattcatagctgcgcataaagccgcctagttttgaagacaatagataaaagcgcttggttatcagatcaaaatcggtctgataaccaagcgctttttatttatcgacatgtagcttacggataaagtatcgccatcacagcagcaacgtctgccgatgtaaatgcgaccttaccggcttctgccagccatgttaaaaaaatattcacccacgaagcatatcgtgccaaaattcgctgctcctgttttggggtggcccagctagtctccaaagcaggtctcagggcagcagcaatttcgttgatttgccacgccttaatgtgatgctgattttgagccatcaccaattcaacgatgccggtcaagatatgcttaatctcggcgtctccgatccctaacaatggcgcataacgtttgctttgtctaaaggcaggccaatactggttcagttcttcgcttgctgacgacatttcgccctccctgagctttgacttttcttagtcgctcacgtacgtttgctttttggcgggaatgccatggcaatgatgccgcagatcatccccaggtaataggtcaagaaccgccataacagcatccctagaatcaattttgaaggcgacgcaacataagtcgcaaacaaggtcttaaagctatactcggcccccccagtaccgcctggaatcggaaacaggctgacaatcatcacaatcatcacgtgcaacacgatgacctcaacgatactaacatgacttacgccaagcgacaggagcacaaagtacggcactgcatagtaaaacagcaattgcacaagtgtcaacaagcaagccttgatgacccgcttcttttcgcgttttaagtgcaaactttctgcgtaaaaagtgtcaattttatgatcaagattactttgcatggcaagttttttctcaggtttgacaaaccagccaatcggtatcatcaccaaattcactaatttttttgtgaacttatagtaatacatcaccatgagcaagcctacgatgacaaccacatgaatcacaaaaccaaaaacgatgaacaaagcaagcgccccaaaatgtttggacacctgatcaaacccgatgaatagtgtcaggacaaagttaatcaggaccatgaattgatacacgacaaacttcatcaacaacacggaacttgcccggccagcttcaacgccactttgcatcaacgcaaataattgggctggctgaccaccagaagccatcggcgtaattgcattaaacaattgttcaaccaacggcacacgcaaagcggttttaaagtctaaatcatcagcttcacttcgaataaagatctgaaccacaaaggtttcaatgatccacgacccaaacatgagcaaaaaagccaccagcagccacttgagatcaagcgtcaatagttcgtggattaattgtgcgccattcagatcacgagcttcataaataaaaataccggcgccaatcaaaatcatgattaagacagccagtttgttcttccgtgtcatataactcctcggctagtgcttccccagtgcagcttgatgaagatagaaatcgtgccagactttttcaagtcggctttcatcgtaaacttcagcagcttgtcgactcttagttgcataagttgccaaaagatcatgatcatccgcaagtgctcgcaatcgagactgcatatcgtcaacatcaacagccgtgatggcataaggtgtgatgatttggtgatacagctcaagatcccgcaccatcactggcgttcccgttgcaaaagcctcaaggacggacattgggaacagctcttcataagaaggcaataagaaaacatcggccatattgtaatagtcaatcattgtctctcgtggcataatcccagtgaaatccaagtttgccggggcttctgctacggccttcttcaaatggtcgtagccttcagtaatgcggccaaaagagaacccacctgcccaaacaaaacgaaattccggattttgttttgctaatttgataaaatcgctgacacccttacgatcctgcacctgacccgcgccaaaaatgacaaaatcatcaggtttaaagccattggcatgtcgcaaagcctgccgcttttcagtggatactggatgaaacgttcgttgcgatacgaaattaggaatataagtcactttgtcgcgactgatcccataagcttctaacttaggaataaaattcgggttcaccaccactaactgatccattcgcttataaaaagccaacgtatacttatcaagcgtccaccgcgccactcgcggcaacttcagactcgcatccagtgtactcggcacaaagtggacaaagccaatcttgcgaccccgttttttggagaaagtagataaataaaatttaggatcaatcgtatgataatggctgatgtcactacgcgtataacgattgacgttaacttcaaattcatttgaaaaatcatgtttcagcaagcccatcagttctgtgtagactgcgccaactccttgtcctgcaaccttattggcagaggaaaacatattaataacaatcatatttaacctttcatggtccgtttactggaatcttcatcggtccatggtgcagcttcatcggcctcattaggcgaatagtgtgacaaaatgtcttgatagaaatccaaaacccgatcgccaaatcgatctgcagaaattgccgctaacttttcttgacgcggcttagcatcatcgtaagcatttggatgtttcaagtaattcacgacctgatgcaccatttcagtctcagttgaaaatgttgtccctaacgccggatcatccaaaagttgatccgtataatcccctgtcaaggcaaccactttgcgatccgccgccatcgcttcgatataagttaacccctgtgactcggagtcacttgccgatacaaacacatcgccaacccggtaatagtcaccaacatcatcatggtcaatttcaccggtgaatcggacatgctccttgagacccagctcagcgacttgcgcctctaagtcttcacgcgcaggcccatcgccaacaattaacagcaccgcttggggcacctgttccagaattttaggcatggcactgatcaccttatcaattcgcttttcatacgcgacccgactgagtgagaccaaaaccgggacatgcgccaacccgagcttgtcacgtaaatgcggatctttttgctgggcaaactgagtcaaatcaaccccagttggaataattttgatctcagttttgacgccatatcgtcgcagcgtatcataaacgcgttcagaaggcgcaacaacgccactgacatgataaagaaaagcccgcgtaaactgcttcacatgataaggcttcagcaaatgaccattcaggacataatgcagataatcctcatacatagtgtgataagtatggattgtcggaattttcaactgcttggcgacaaatttgccgatataccccatcgaaaattcagtttgtgtatgaacaatgtccaagttcaattccttcgccactgcgtaagcatgaaaaagcccacgaaccgcaattcgccgatccgtgaatgagacaaacggtacactggtaaatcggaataaattaggttcaacggcgtcgtccggcacatgcggatcagtcgttgtaaaaatataaacctgatggcccttacgctccagatcgtccttcaaggtcttgatggacgtcgcgacgccactgacttgtggaaagtagctatctgtaaaaatcccgatattcacctaatcccctccagacgtcatttgtttagtataagtataaagataggcatagctaaatgcaattttccctcaaacctttaaaattatcttaccttgtcgccatcacaccatcatcaggcaaaagtcgtaagttatgccatctagcattttatcaaacgagccttcaccaccggcggctcaaagcatctgcggcaatggccaagaatcagaatgtcttccatcataccaaaaaacacgtcgatgatcatgtttctgaccagagacgtgttttttctaataaaagttgctactgccgcggcattttaactttgtcattcacccttgcagcgcgtcggaaatatttagagaaaatgtgactattaattccccaagcataaaagcccaaagcaccaacgataatgacaacaaaatctaaaggatagtgaatccaattcaaaccattaaactcactactgccaataagtgagatgagtgacaggaatagcaaatataccagcatccaagctgccgctttcaattgcttaagcgtgcttgcccagcctgatcgccattcatagaacaaatagaaaggaatacccaagaaaataacgccgatcacttcaaccgttgtcggccattttgcccagtaagccgctaatgaggttagcacaaatgacaatggtgccatcacccgcaagaggctcgacttcactggccgcttaaaatccggagccatgtcacgcaaggagatgaccgtaataggacctgtcaggtaagcaatcaacgttgccgtggagatgacgctagctaacgtaccccaagaaggaaaaatcgaaaccatagccatgctaagcaacgcattcaccaccatcgccactcgtggtgtaccatacttttcatcaagtttcccaagaaatttgggaatatagttgttgctgaccatcgcctgcaacgcccgcccagatgaagcaacaaatgaaacgccagttccaaacggtgaaacaaaggcatccatatataacaaaactgataaccagtgaatgcccagcagaatcgccaagtcagcaaatggggagttgagattcaacccttgccaaccatgtgctgctaatagcttcggcgaaattgtcgtgataaaaacgctttgcaataaaatgtaaatgaccgcactaatcagtaacgaaattgcaattccgcgcccaatatttttttgcggtttcttaacatcgcttcccatgttgatgacggtttgaaacgcgttaaaggaaaaaataatcccagaaactgaagtggccgcaaagataggtgcgctcccataaggcatgaaggtcgctaaagaatgcccataattgccgggatggaagcttgaaagtgccaacagcgtgatcgtcagcaaaggcaccccaattttgaagatcgagatgaagctcgtgaatcgtgtcagtaatgagactgaccaatagttaagtaacgtaaaaataatgatgaaagcaaacaccaccagcaacccctgcgatgtgatgcgcccattagccaaaaaaccgtgcgtaaagctagcccactgccacggccatgatgcaatatattgcacggcagccactgcttcaatcggcagcaacgtcactagcgagatccagttggcccaagaagcaataaagccaactaaagaaccgtgcgagtactgagcatatttgctcattccgcctgattcaggaaacatggtcccaagctcaatgtaattataagcaatgatgccaataatcaagccgccaatcacccaagacagaatcgccgccggaccagctactgctgctgcttcccaagaaccaaagagccagcctgaaccaatcaaggaacccaaagctagcataactaactgaaatagaccaattttattattttctctgtttgaagaaattatcgaatacctccctaaaaaagtgacttgtttaatataacgtatgtcataatcaatgtaaaattgattattctttataaattcgctattttcccgatggtatcgcatatgaaggcgccaacattattttttaaaaattgccgttctaagatatctaaagctgccttcacgccattaaaatatcatcattttttgtcataccaattttcaaatcatgcttgtaataacacgctctccaaacaccgaatcaccaattaacaataggtcattctactggcccctttctattcctttaaagatgtcgtgactcttaaaaaaatcgtgaaaaaaatactaaaataatgttgtcaatattgccccaacatatgcctttggttgtaagcattctgttcccctaaaaaatattcatgaacgattgttcgctattcaattggaaacgctttattgtagaatgaaaaagctagtaagtcgggggaggaggagatatgaaagccacagagttaacattaatcaatgaagcaatcacaaactcaactgcattcagccaattgtttaagcaatatcgaccgctagtcctaacggtgttaagaccgtaccatctcagggatttttcacatgaagactggttacaagaggccaggattgcgatgctcaaagcaattactcgatatgatggctctagcggatcccaatttggtccctactatcgaatggtattgcagtcacacctgcgttcagtcttgcggaaacactttgcgcataaacgccgcatcgacgcgaccgcaatcccagttgaagacagcgcacttgaatctcttcaagaacgtctggctctcagatcgtatgaagatggtctactcatgcgaatcgagtttgcacagtttctggcacggttgtcacctttggaatacgaggccttcgaggcagctgtcatcagtcagacagacagttctgaagatcctttgctgcagcgtcatcgtcgcgcattggaacggtctcggatcaagatattgaagttctctcgcgaagaatagcaagtcaactggcagcaatcgtcaaaaaggacagtatcagataacgaaaaaagactcaggagcatcttacttttacgtaggatgaagaagcgctgggtctttttttcgtgtgtcagaaatcatacaattttcatgcaaaaacagcggccccatgatttgtgccaaactgtacacttttttaaatcgggtgtgatcaaagatgtattgggaacatctttgtttgggcgctacgatatttggagttgataggcagcttgcctaccagctcctttttctacgctgatgttgttaggcgacttcgagaccgctttttgggctcgaagcgccgtcaccgctctagctccgcgtcgccaccccatctggccggagattgcggagtttggcacggcaagaaagttttagcctgaattcattcctacgattatttggcactaaacaaatcataagtcccaggaggaaattggggttttttctcaaaaataaccgacatcaactacttgccttttcttcatccactgtctatactgtgtatatattacatatacagtatagacacatcaaaggagatgttcgccatgctcactgtcacaggcttaacgaaacgatttggttcaggaactgctgttcacgatgtttccttcacgatccaacccggtgaaattcttggcttgatcggtcaaaacggcgctggtaaaacgaccacttttcgcatgctactcaatttgcttcaagctgatcacggtaatatgacttggaacgatcaaccgctatctttgctcagccgtgagacgattggttatctccccgaagaacgcggtctttatcccaaaatgaccgttgttgatcagatttgtttttttggagaattacatggcatgaaacgcgctgcggtgatggctgttctggatcaatggcttgatcaatttcaggtcaaaggtaagccaaccgatttgatcaaagatctctctaaaggtaatcagcaaaaagttcaactcattgcggccatgattcacaacccgcagttcatcattttagatgagcccttttcaggcttagatccggtgaatgctggcttgcttgaagctggtattcggcggttgcgggatgctggaagtgccattatttattctagccacgacatgggcaatgttgaggccatttccgataaattggtgatgttgaaaaatggcgaagtcgttttatcaggtgctctcaatgatattcgcgatcaattcggccaaactcgcctctacattcaatctcctctcacccaagaacaattgctatccttccccggcgtggtcggtttcgcccaacgctcccgagggtttctcgttaaattggctgagcctcaagccggtcatgacattttcacagcagccactcaacaaggttatattcctgaattcagtcagcaagcaccttccctagatgaaatcttccgaatgaaagttgaggcctagtcatgaaaaaaatggatgtgattttccgccaagtcttcttcaagaatcttaaaagtaaaacctggttgtggatcgtgctcggtccgttggtgctggccgctgttttcggcggggttttttggctgatgaatcaaactaatcaaactagcaaaatcggtgtcgtgacgtccagcccggcattgaccagcacactgaaagcaagcagtgatgatgatcaacgctacatcagctattcgtcaacggcagcggccaagcgcgcgatggctgatgaagatcttgatggggtcttgaccatcagtacgcaaccaaccacccatgccagcctcattgaacgaactgatggcaatggtatcaaccaaacccagctgcaaagcgtcttagcacaggcacatactaaagaagttgcggctcagttgaaattatcgaccacgcaactgcaaagtcttttcgcgacaccccagctggccaccagcagtgtctccgttgatagaggaaaacttgtcagccggtctgccaagactcaaaaatcaggcgctatggtcgggtttattctcggcatgctgatatatacctttgtcattagctacgcttccatgatggcacaggaaatcggcactgaaaaaggctcccgcattgaggaatccatcctcactgccatcacgccgcaagcacagttttttggtaaactgctgggtattttagccttgatggccgtccaaatggcgatctacggcgttgtgacgcttgccggtggtctcttactgcaacgtttaccgaagaatccgctatccagtttgatgacgaacattgatctcagcggtatcagcttaaatatgctgattttcagtctcgttttcttttttgtcggcacgctcacttacaccgttttagctgctttaactggctcattggttgctaatcaagaacaaatcggccaagccacgaccccaatcgttatgctgggaatgctaggctatttcggcgctttgattgttgctggcggaacctcaccaatccttaacatcgccagctacatccccttcctatcgaccatgatgatgccggttcgcctaggcgcaggacaggtcactgctgttgccgggtggtcagcattaggcatcaatctcgttttcctaatcttattcacttggctcaccgtcaaattttaccagaccaatgtgttaagctattcagatggcggcatgttgaaagctttcaaacgctcatggcaactacaacgcgccgcccgcaaacctaaacctgttaaatcatgaaacgaggttaaccatgcggatcgttatttcgaatcaatccggcaaaccgatttatgagcaaattgaagaccagatcaaaactgcaattctttctggtcaattaaaggtgaatgaacaactgccatcaattcgcagtctggcaaaagatttacggatcagtgtgatcaccaccacccgcgcttatcacgaactcgaagcagccggattcattacgaatgtgcaaggcaaaggcgcctatgttttgggtcaagacagtgcacttgtgaaggaaaacgctttgcgtgaaattgagacctatctgaatcaagccatcgatactgccaaaatggcgcgcattgcacctgaagaactacacacgatgttggatacattgatgcacacggagggagacactgacaatgacaactgatctgctaaccgttacgaacttgaccaaacgctatgccgattatcaacttgctaatgtcagttttagtttacccgctggctacatcatgggcttcattggtcccaacggtgcaggcaaaacgaccacgatcaaagccattttggatatgatcaaaccagactcaggcaacatttcggtacttggtcaaaccacgccacaagcccgcgaaacgattcgcgatcaacttgggattgttttagatggcgcggtttatcctgactcatggccagcagaagctgtcaatcgttatgttggaccgtttttccctaattgggacacggcttatttccagcaactgctgcgtgactttgatattccaaccaagcctaagtatcacgatttgtcgatgggcaccaaaatcaagttacagttagcggccgctttggcacatcatcctaagctcttgatcctagatgagcccacttctggcttagatccgattgcgcgtgatgaattgattgccattctgcaagattttattcgcgatgagcaacacagcgttcttatttcgacacacagcatcatggagctcgctaaagtggcggattatgtcacttatctgttggctggtaaaatcacgttcactggtccactcagcgatctccttgaccgctatcttttgattaaaggcggaccgaacgatttgactactgcaatcaaagccaccttaattgggttgcaggaaagtccggtcggtttctccggtgtgtggccagccgaccaagcggcaatgttgcccgacaacatgattcaggaacctgtcgatttggaaacgttgatgatcgcgtttggtaaaggagggcatccccatgcataatgttgccaaacttgtcgccttagacatgggtgcgctttactccggcacgcataaataccgctggtggtcatatctggttgcttttctgatcgtgctcattgccttcttgaatggtgatgccgccacaccacttgctggcgctatcaccggtactagcgttggtatcttgatgatgccgtttgccagtgttgatcgacatggcttggaacagttgtacacgatgctgcctatccgccgccgagagattgtcgccagtcactacctatttggcttgctcgtcatgctgatgattgatctttatgccgcattcatcgttgcagtcggcatgatcgctcgtttcaacccgatacatgactaccatgccattatctggatgctatttttcgcaaccggccttgtcttattacaaatgacattgtcgtttcctctaatgattgggcttggcttccaacgtgccccgttagctgcttatttaccgattggcattgtgttactcgccgtttttattgaagccggcttagaccttgacttagcagtcttgcggccctggctcacggcgttctccatacttttgatcgtcgcctttgcgttttcttggtggctgagtacctatctatataaaaggcgagaattttgacctttaaaaaccaaaaagccgtcaccttgctgcttagagcaagatgacggctttttggttgctttattcagttggcaaacaagcaaggctcgtgcatgaatcacgcctcaaccttgaccatctttaaatgccggatataaagtcatcccgccatcaatgaataaagtaatgccagtcacataactggattcgctggatgccagccatgctgcaccagctgacacatcttcaggtttgccaattcgattcatcggtaccattgaaactgtctggtcatactgcgccttatcagcaaatttctcggcgttaatcggcgtttcaatcgcaccagggccaatcgcattgacccggatcccttgcttagcatattccatcgcaatcgtctgggtaaaaagtttgactgcacctttggccgccgcataactcgcgaaggttggccacggaatttgttcatgcaccgaggtgatattaataatgttgcctgcctgatggtgttcaagaaaatagttcagtgcagcccgcgctcctaaaaagacgccggtttgattaatggcaatgactttgttccagtcctccaaagagacttgatgcgttggttccttgatttccatgccagcgttattcacccagacatcaagtccgccaaaatgcgccgttgctgtttcaactaagctagcaatgccatcttctgtagaaacatcagcatggatgctcaccgcctgcccgccgtttttgatcacggtgtcggcgacttgctttgcaccttcatgatcacctaaataattgatcacgactgacatgtgctctttgccaaatcgttccgcaatggcagcgccgatgccttttgaaccacccgtcacaattgcaatctttccgttcaagtcttgatacatgctcgctcttcctctcatgcgtgtggtcacgcagcggtcacctagaaggtaggccctaaattcagtgtaggggtatggtattagattgtaaaacattgtgctgcactaggatgccttttcaaaagaaatctcaaattccgtctaaaaaagccaaaaaaaagccaaaataaatcaaaaacgatttatgagaatcatccatcatttgtaaacacgtgtcttttaggcatttgggattaaatacgcgcaaatattatttagaaacaataaaaaaggctctgtatctttctcttctcaaaaaaaccttatcaagaccgattaaagttcccccgaattattgagattttagtacttagaattaaagagttctaaaatcattatccaaagttcacttagtcacaagtcttttatgcctcttttgcgtcaacaatgtttgatatttaaggccaacattcttctttatacatgttctttaactaccggcgtgtagaggatgaattaagtatccggtgagaaataatcggtaaaactgtaagcgggtacattttatatgtgaggaatatcacacagttgttgtgctacttgttgtgaaggccttaacattgctggtggaaagaacggactgattgttgtgaaagttggcgttgtgaaagagcaaaaagctggcgaaggtcgtgtggctgtcacaccagaaaatgttaaaaagctggttgatgcaggagcgactgttttggttgaaaaatcagctggagtcggtgcaggttttcctgatgctgattacgctgcggctggcggcactatcgtcagtcacgctcagagttgggatagtgatctcgttgtcaaagtcaaagaacctgacgaggaagaatatcagtatttcaaaccaggtcaggtcgtctggggattccaacatttggcctcctcacctgccactgtgaaagccatgcaagctgccggcacgacagcgatcggcggtgaaaccatcgttgaaaatggcgagttggcattgctaaaaccgatgagcgctatcgcaggtcgccggtccgtcatcatgggcgcttattatcttgaagcacagcatggcggtgaaggcattttattgccaggcacaccggaagttgcttcaggcacggtggttattttcggtggtgggaacgctgcttttaacgccgccagtttggcattagccatgggctgtcgcgtcacaatcatcgaacttaaaaaagaccgccgtgactggttagcgaagcagtttacaggtgaagccttgacgctgctgccatcaacgccagagaatctcgccgcggctatcaagaccgccgatgtgttcatctcaaccattctgattccgggcgcaaagccgccgaagttggtcacaacagcgatggtacagtcgatgaaaccgggcagtgtccttgtagatgtagccattgatcaaggcggcacggttgaaactattgatgcaccaacctctattgatgatccggttttcaccaaatacgacgtcattcattatgccgtgccaaatcaaccaggcgcggtaccgcgcacagcaacgatggcactggcagttggcaacatcaagtatcttttggcaatcgctaagtctggaattgatgccgccatcaaaaatgatcctgcgctggcttctggcgtcaatctttatcacggccaagttaccaataagggccttgccgaatcattaaacttaccggttgtttcattagaaacagcgctcaaaacgcaacattaggaggtggataagatgatgaccgcaacgcaaactgtgagtataaaagatgttcaagaggctagtcatctcattcatgaggttggccgagtcacaccgctcattcaatccatgtttcttagtcgcaccgttacccatggtgatgtgtatctcaaactggaaaacatgcagctcacaggttcatttaagtttcgcggtgcttataacaaaatccgccatctcagtgacgccgaaaaagctcgtggtgtcatcacggccagtgctggcaatcatgcccaaggcgttgcattgacggctcacttactcgacattgatgcgacagttgtgatgcctaaaacagcgccattagccaaacaacaagccacgagcggctatggtgcaaaagttgtccttgccggtgatacttttgacgaatctcgtgccttcatggaacaaaaggccaaggaaaatggcttaaccatcgttgacccctacaatgatccattggtcattgccggacaaggctccatcggcttagagattttagatcagctgtgggatgttgataccgtcatcgtaccagttggcggtggtggcctgattacggggattgccaccgttctgaaacattttaatccctatattcacatcgttggtgtccaatcagaaaatgtccacggtatgacggcctcgttgcaagcaggcaaattgacccgacaatgtactggcccaaccctagctgacggcacagcggtcgccatgcccggcgatatcacctttggcctagctgaggaattagtcgatgagatggtactcgtctcagaagaagaaattgctgaagcgatgaaagaccttctccaacgcaccaaaaccgtggcagaaggcgccggtgcattaccaacagcagccctcgaggctcacaaaatcgcaccgcaatggctagtaggcaagaaagttgttgcacttgtctctggtggcaacgtcgatttggaacgggtagcagataacattgatcatttctttaaaagtgatccgactgggcacttcatcggataaaaacagagcgtgagctagcgcggtttctgcactagctcatgctctcaccataacgcgataacgcgctcgccagcgctgaaacctgcgtgtaagggccttggtcgcaatggtcaaactacgaccatcacgcccaaggccgcttacactccggtttcacccgcgctggctcgcgctcactttcaaaaggggggaagcaccatggaaaagacgttttcgaagcataccgttgccaagacacattatgtgccatacgcaacggatggtgccaaggaaaatagcggcggcagcacagcgatcatgatcatgggcgccattttggcaacgatcttcgcagcatctaccgcctattcaggcatgaaagccggcctaactgttgctgctgggattcccggttcgattatcggttccggcatggtcggtgtctttgccaaaaagaaaggtatttttggcaaaaatcttttgcaaggcatgagttcaggtggtgagtccatcgccagcggcatgatctatgtcttgccagccattatcattattggtggaaaagtcaacttcttcgcaggcatcgcagttggcgctttggccgtattgtttgctgtcggtgttgcgagtttagttgaaaactacttacttgtcgaagaaaacggcaagctgatgtacccagaatcaacggctatctccgaagccttagatgccagtgaagcaggcggcgattcgcttaaacatatgggcatcggcggtatcatcactttgttgaccactcaagttttcggctgggtgaacagtgtgatgaccttcgtcggcaactcgtcgtatcgctggaaaatttcaacagaggtcaatcccatgctagccggcatcggctttgtcgttggcttggatgtttcgctcaccatgttcgccggctccattttagcgaacttcgggatcaccccgctcatcgcttatttcactcaaatggctggtggcggtgcccatgtttggaatgacacccatatgttgatgtctcaaatgaacatcgacatggtcgctggctcctataccaagtacatcggcgccggaatgatgctctgcggtgggatcattggcgccattaaattgattcccgtcattgtcacttccattaaaaaaacattgaatgcacgcaatgatgtcggcgaagagaagaattcgctcggtgtggtctccctactcgttgctgccatcgcgatcttcatcgtcggtgctttcttagctggcaacatcgtgatcgctatcatcgccggtattttgtcactcgttttagctttgctgtttgtcatcgtttcggcgcgactggctggcacaattggttgttccaatgcgcctgtatcggggatgaccattgcaagtctcgtggtcatgaccctcgtgtttgccttaatgggctggaccgccaacgcgcataatgaaatccttttgctctttggtgtcttcattgtcaccgccatttcagtcggcggggcctatacccaaacgcaaaaagttaattatttggtcggtggccgccgctccgaaatgatgaagtatttcatgattgctgccttgatcggggttattgttgtcgttggtacaaccgtcatcctcgcaccgcaactggccattaagagtgctaacccgccattcggtttaccacaagctaacctgattgcgaccctaactactgggattctctccggtaatctaccgtggatcatgatcatcgtcggtatcatcattgcgattgtctgctggatgcttggtctctccatcatgaccgttgccttaggtttctacctgccaatctccacgacatccattatcctcgtggggggccttgctcaaattattgatcgaaaaactgacaaaagacaaggccttacgcgaaacccggttatcctccggtgtctcgctttccagcggtttaatcgcgggcggttccatcattggtctgatcgggattatcctgcatgtcactggtgtgttatccaatcgtgttcctgcaggctttgctggcagtaatggcatggctgtcatcttgctcatcatcatggcggcaaccatcgtcatcccactgatgcaaatcaaacaaccagcgcgcaaggctcaaaagcaataaagaggtgtgacacatgactgcgactgacacattacaacatttgatttatgaaaaaaatttagcaattcagtacactaaaaaaggcggaaaaatcacgatcatccgtccacagaatcacccaatccaaaaattctgtcggcattatctgcacatgaagattcctgccgtcagttacctacacttagatgcatacggtagttttgtgttcagcaagatcaatggtcatcgcagcgccgccgttattggcaaagaactagccaagaaattccccgaagcagacgatcaccgcgatgaccgcctgatgatctatttgaaccaaattgccaaaaatgaccaccttattcagcgtctcaacgcaaatacacgataacgcgctcgcagtcgcagaaacctatgcataaggaacttggatccaataaccaagtttgggccatttggattcaagcccgcttatgctccggtctctaaacgctcctgctcgcgctcaactattggaggaaatcaacatgattgatcgtattgaaatttcagcttgcacatccatgatggtcggtaaaaaagcatcccttgacggcgcgacctacatttcccgcaacgaggatcgcttagtcgcaatctatccaaaacgttttgtggttcaaccagctgtaactggccgcaaggaaacttatgtatcgccatataacaacctgactgtgccactccccgaatccgggtatcgttacacatccacgcccgatgctgaccaaagcgccggaccaaatgaagaagacggttttaatgaaaagaatgtcggcgaaagtgctaccgaaagtgtttatgccaacgaacgggtacttgcttatgatcccttcatcaaaaatggactcgcggaagactccatgacaactttagtgttaccgtttatcaacagtgcccgcgatggcgtccggtatctcggcgaactggtcaaaaagtacggttcagctgaaggcaatggtgtccaatttaacgatcaagacgaagtttggtatatggaaattgtcaccggtcatcaatgggttgcggttcgcattcctgacgattgttacgcagttgctgccaaccaaatcgcgattcaggacattgatttcaatgatccggacaactatatgtgggcagatggcattcaagatttcgtcaaagatcacaacttgaatcctgacgccgatcgctggaacttccggcacatttttggcaccgacactgaaaaggatcaccactacaatacaccgcgggtttggttcgcccaacgctaccttaatccagaaattgagcaggatccggaatcagctgaattgccgttcattcgcaaggccaaccgcaaaatttctgttgaagatattcagtacattatgaaatcccacttcaatgaaaccaagtttgatccgttgggtcacggcaatgaacacgaccgcaagacttatcgcgctatctcacttttgcgcacggccaactcgcatattctacaaatgcgcgatgccaatcaaaatggcgcagccggcgtccaatgggtcggcttcggtatcccggccttttgcccgcacgtaccgtttttcaccaatgcaaccgatacggataagagttatagcgagttcccaaagaagatggatctgagctcagcttattggctctatgaagcgctcgcgatggttgtcgaatcgcattatgcagagttcatcgaagacgacttagcttatcaaaaagatctcaatgaatgggcacgtcgtaaaattgctgaagttgatcaagctgccgccgggatgagtggcgaggacttaaccacgtatctgactgaacaaaatcatgccattgccaagcactacaatgacacaacccgtgatttcctgttcaagctcatcacgatgggcactaacttatcaaagctcactttcaagatggatccaaatctatagtcaaatttaccaacattcaaaaagacatcaccgcagcagttactgctaaagcgatgtctttttgaatgccgcttatttgttaaaaaattgccgctacagcctcaccgaattttatgccaagccgcagcactttcagaagggaaaatatgggccatttgccacatttgttgcttactgaagtggaagacaattgctggtaataaggtgttgatcgcatcttccgcttgggcactgaattcagttgcgccaaccaaatgatgatcccgatcaaagatgaggatgctatcccccatcgtttcctgatcggtttgatggtaccagtcatcgggaatatgattgcgaacaacttggtaagcgccatcagcagcttcttctggcgtcacaccaactttcgcaattcgcggagttgtgtacacagtcgatggtatcgctggatagtcaatgggttcggttgtctggccgctgagcaactgatacaggtaataggattcgaaagtggccgttggggtcaacttgggttgtggcttgtcgagcacatccccggacgcgaaaatgttcggcacattcgtctgcaaatgatcgtcaaccgggatgccgcgttgattaaaggtgacacctgcagcttctaacccaatttgatcatcattaggaatccgaccggttgcatctaacacccagtcaacttgttgttcctgatgatcgccatattggatcgcaatgccttgcgccgtctgtttcaatgcctgcacgtctgcacttgggataaacttgacgcctcttttggtcatgtctgccatcaccgctttgacaaatggctggtgaaattcgcgcaacgctttgtctgcatgcatgaagacgctgacttcagctccggcagcattggcaatcgtcgcaaattccatactgatgtaacctgatcccaaaatgccgattcgttttggcaatgttttcaagtccatgaacgcgcggctatcatgtgctaattcagttccggggatgtcgaggtgatgcggacggcgcccagtagcgatgacaatattttcggccgtataagttttgccagcaactgtgatgctatgcggatcaatgaatttcccatgcccgtgaatgatcgtcacgccggtttgtttgaggttactgccgatatttgtcggcagcggtttgatcactgcttgtttatgtgccactagctccgaccagttaatcgtgatgctgccggacacgatgccttgcatgcgttcggccatacgttgcaacacgaccggtgtgtccagcgtgatttttgcgttacacccataattagggcaagtgccgccaatcatgtcgctttcgatcacgccaactttttttcctgaagccgctaacggtccagcaccatcgaacgcgccgtgaccactacctaagtacaagacatcaaaatcgtattcactcatattgatcctccttgtgcagtgcgtctgtgacaacggcttaagcataacagattgacgacgactcggtcacggacaatgaactttattttctgataaactgctcctagctcataagccaaaaagaccaacaatttcccgctgtacagggaaattgttggcttggttgatggctattaatgaagtcccgttctgtttctgatactaattaaaggtcgcgacttgcctgtggttttttgacttggaaggcaacgatgagtccgataatggctaggatcaagacgaacataaagccaaaatgcgaaccaattgtcaggccagtttgtccagcggctttggccgaaccgagcgcgagcatacttgtggcaacagcagtcgaaacggcgccgacaatttgctgcagtgtgttcagcaaggcactgccgtctgcgctttcggcaccgctcaaactattcagcccatatgtctgggcaggtgacatcgctaacggcgcgccgatcattaagacaacatgccctaaaataatccaccataacggactttgtgcaccactattaagcaatatcaacacgcctaggatagcaatgacaaaaccaccgcgggataaccatttagcaccgtggctgtcatacatccgacctgcaatcgcagaaacagcagcgttcacaatcccgcctggtaacatgacaagtccggtcatggcaactggcaggcccatcacccgttgcagatacatcggcagtaaatacatcgaggccagaatcaccccaaaatcaagcatgacgagtaacgttccgacagtaaactgtttattagcaaaaacgcgtaaattcagcatcgggtttgttaacgataattgccgccgggcataaagaactaaaccgataaccccaacgagcaaagcaagtccgacttccagcgaaagccagccagcatcactcgccatcgttgtcccaaccacaatcccagcaaagccaatcgacgattcaacaattgacaaccagtcgactggtgtttgcgtttgatgataaacattttccatcgaagttaatgtgaaaatgaaagccaaaaccaagaatggcacgaatagccaaaaaatgtagtgccaagtgaatttggcaagcaccagcccggtaatcgttgggccaatagcaggcgcaaacataatcaccaaagcagccatccccatgactgtccctaatttatatggcgggaaaatctgcatggcgactgaaaacatcagcggcaaaatcagccccgtgccaatgccttgaatcaatcgcccaataagcacaaccggaaaaacagcgcccatcgcagacacaaccgagcccagaataaaggcgccaagtgcaaaaagaatgatctttttagtgttaaaccattttgataaaaggctggataacggcatgcagatcccgataaccaacatataacctgtgactagccactgaatagtgccctgtgacacattcaacgccgtcattaaactaggcaacgcaatattaagcgacgtctctgaaaacataccgacaaacgccccaatcatcaagccgatcatggccattgctggatgggctacgtgaacgcgagcttgcggcatttcttttgtttgtgataattgcatgataacttcctttttagtgagcgcgagcaggagcgtttagaaaccgaagcataagcgggcttaagattaactggctggtctttggccagttaatcttaaggtccttatgtgtaggtttctgcgactgcgagcgcgttatagtgagcgcgagccagcgcggttagcaaccggagtgtaagtgaccttgggcgtgatggtcgcactttgaccattgcgaccaaggtcctcacacgcaggttgctgcgctggcgaacgcgttaaatgataaaaacaaacaactggcattggctttatgcggccaatgccagcttgatcaagcgggtcagttgatccgcggtttgtcgcaacaagtcaggattgtttttggttgcggcaagaataatggcgccctcaatgctggcttgaataaattggccaagtggctgggcacggtcaggcggaataccggctgacgtgagctttttgatgtacagcgtttctaactgggtaaaaacagcgctgcaagcggcctgcaactcaggatcatcgcctgtttctaaggctatcaagctaattgaattgccaccaagatgccccttttcctgcatttcggtcgccatactttctagttgtccagccagcgcagcgtcaggcgccttataccgatcaaggtcccgttgcacatgctcaagaatgtgctggccagcataagtaatcgcggcttcaatcaattgcgctttaccgtttggaaaataataataaagtgagccctttggtgtaccactgaccgttaaaatctgcgccaaaccagtagctctgaccccttctttttgaaagagactggcagccgttgccaccagtttttcgcgtgtatccatttgctacctccactattataacaaccggtctatataatactgcttattttctgaaaatgtcaattttattttttatgcatgaaaaaatgaccttctcatcagaaggtcactttgcaaaacgattattaacctaaatccgttcccccagtttacaattcaagtgcaacaccctgacgactagaccataaaggccatcaagcagtgagcaagcctctttctaggtggtaactttattattgcaatctagggaaaaagtggctgattttgccaccgccgactattatctgacgattggttttgaccacgggaaaacgagcttgtatgcaggcggccccgacgagcagctgacacctttgattggcggacgtcggcatgtaactgattacgctttaacgccggatcatcacggggttgtttttacggaaagcacaatgacggttccaagccgattgagctactttgatttggcgactgaagaagaacacgtgatttatgatcctaatcgtcgggtaacacgcgatatggggttggtgacgccacaaacatttaacttccagcgcgatggttttgagatcgaaggttggtatttcccgccacagcaggcgacagcttctcatccagccattttatatgttcacggcggaccggcagttggttatgggtataccttcttccacgaaatgcagttcttggctgctcaaggctacggcgtcatctgcccgaatccgcgcggtgggttagggtatggcgaggcctttacagcggccgtgattaaacattacggccaagacgattatgaggattgtatggcatcagtggatgaagccttgaagttggataccaccattgatcctgatcgtttgtatgtggctggcggatcatacggcggctttatgacgaactggattgtgacgcatactcaccgatttaaggctgctgttacccaacgatccattgctaactggttgagtatgtacggtacaagtgatatcggctactttttcacaccttgggaactcgaaggaaaatggaccggtgatttatctgatgtgaaaagcctttgggatttttcaccgctagcccatatcgactttgcccaaaccccgacgttggtcatgcacagtgaaaatgatcaacgctgtccgattggccaaggcgaagaattttatattggcttgaagttgcatggcgttgatactaagttcatgcgctttcccaatgccacgcatgaactgtctcgcagcgggctaccgaatctgcgactagcgcgattagcagccctcgtcgattggttcaagacccattcagcaacagaagaaagtcatcaagcataaaggaggcaggccatgacaattggatttattggtgccggcaatatggcacgggcgatcatcactggtttgttagctaaaaatgcggtcacgcctgaggaaattgttctgcatggcgggcaaccgattcactatgaaccgtatgccgccaaaattggcgccaaagcggtcgcgagcaatcaggcagttgcagacactgccgatatcgttttcctagctgttgcccccaaacttggtgtgccgattctaaagacaatcgggccaacgctcaaacaacggcaggtaccgattgtttcgatgcttaccggtgtttcactggcgacccttgaagatgcccttggcagtcaagatcaaccggtcctgcgaattatgcctaatgtgaatgtggctatcaacgcggggatgacggcttatgctgctaatgatagtgttgcgggtcaattagatggcttactggacttattgaacgtcttaggtaaaactatggcgttacctgaggatcaattttcgacatttgtcgcgttggcagggtcatcaccagcttttgtttacttattcatcgatagcctatcgcgggctggcgttaagtatgggttaactaaaaaacaggcaacagccattgctgctcaagcagtgatggggagtgcccaaaatgttttggccagcgagcaatcgccatttgatctgattgatcaagtctcaagcccaggtggtacaacagtagctggcttgttggcgatggagcaagcagggctcatgtctgccgttatcaagggagtggacgcaaccattgctaaggatcgtcaaggataagtatggcgttgtacgacgaaggtatagcttgtaatcttggtctataccagttatactggtatatgttatctgtcgaatgaagcattaaacaattaggagtggtattgtgacggttacagtattgaaacacgcaacgatctatactggattagaacgcatcgatgacggctatgttcgtttcgatgacaaaattttggcagttggcgacatgtttgattatcgcgcccaatctggtgaacagactttcgaccttcaagggaaaaccttgattccagggtttattgatgttcacgctcacggcggttatggctttgatgccatggacggtgatgccgatcagattgatgaaatggcaacgaaaatgatgacgcacgaaggggtgacgaccctttttgcaacgaccatgacgcagtcaactgagaatattgacaaagccatgcgtggggttaaacaggcggctgaacgcaaccacattattcaaggcgtgcatcttgaaggcccattcatcagtaaggtcttcaagggtgcccaacctgaagaatatatcaagaatcctaatgttgatttagtgaaacagtggcaggaattatccggtggtctggttaagctcatcacctatgcgccagaagacgaagggtcacaagcatttgaagactacttgttggcgcacaacattgtgccttctgttggtcacagtaacgctacccgcgaacagatgctgcatagcaaagcaacacatgtgacgcatctctacaatgctcaacgcggcttgcgccatcgcgagcctggtgttaccggtcatgcgatgcttgaagacaacatgtattgtgaattaatctgtgacggcttccacatcgtgcctgatatgctccgcctcgcttttgaccaaaaaggaccagaacgaatcgaattggttaccgactccatgcgtagcaaaggcatgccagaaggtaagagtgaattaggcggtcaaacagtttatgtcaaagataagcaggcacgacttaaagacggcacacttgccggctcagttctgatgtataaagatgcctttaagaatgcgatgagcttcatggatgcttccttgtttgatgccgttgaaatgtcatcggtcaaccaagcacgggaattcaacctgacatcaaaaggcacgcttgaagtcgggaaagatgccgatatcaacgttttggatcgcaataacgatttggttgcaacctacagctatggcgttaaacacgacaccgaagactgaaccacgatttggaggcgatcattcatggatgcaccagtttatattcaaattcataacgcgattcgggcagatattgaagcaggcaaatggcgcgttggcgaccgaattccttctgagcgtgatttagctgtcacgtttaaagtgtcacggatgacgttgcgccaagccattcaaacattggtcgatgaaggcattctcgaacggcgcgtcgggtccggcacctatgttgccaaccagaaagtccaagagaaaatgtctggcgtcacaagctttacggatctgatgcaagcacaaggcaaggtgccatccagtaagacagtctcctaccacgtggcccagccaacaagttctgaagttgaaaaacttaaacttgagcctaaagaacaagtcttgcgcatggaacggattcgttacgcggataagattccgattagctttgaaacggcggctgttccatacaacctcgtcaaaaactttaccaagaaagaaatgacagccagtttttaccataccttggagaaaaaaggcggttatgtgcttggcggtgcgcaacagactgtcagtgcgatgctggcaagcgaacgaatctcagagtatctggacatcaaacgtggcgaagcgatcttacgtttgcgtcaggtatcattcttgcaagacggtacgccgtttgaatacgttcgaacgcagtatgttggcgaaagatttgaattttatctagaacggtaatgtttgctgcttggttataaacgctaggcatttggaaaggtcaaagagcaagatggcatcttgttttttggcttttttcgttggttttgatgctttttgaaaaggaatctgagcctaagctatgctgatttcgaaatgcgcgaacaggcgcagaagcctacacataaggatctcagacaggaatgggcaaaggccagacgtcagtgtgctggttctgaaacgcgcgaacaggcgcagaaacctgcacataaggacctcaccaaagcccagccatttaggcttgaggccacttatgctccggtttctaaccgcgcctgttcgcgctctgtcccattttctctgaatggtatataatgatgaactataaattaagcatcactgcgcctatacgagcgcttgtttgttgttgccacttatccggaaggggagccatgatgaccacacagttgggtgaaggacttacactccacaccgatttttacgaattaaatatgatgaataccttttttgaacaggggattagcgaacgcaatgccgtgtttgaagtcttttttcgggatttaccgtttggttcggggtttgctgtttttgcgggattggaacatgtgatggactacctgaatcatcttaagttttctgaagatgatttagcttatctgcagtcgcaaacagactattcggatgcttttattgattatttacggcatcttaagttcacttgcactgttaagtccgctttagaaggcgacttggtattcaacaacgagccgatttggcaaattgagggacccttggcgcaagcacagttggttgagacagcggttctgaatatgatcaactatcaaacattggttgcgaccaaagccgcccgtattcgcagcgttgctggtgcggaccccctgatggaattcggcacacggcgggcacaggaaacggcggctgctttgtggggcacacgggccgcttatattggcggcttcaatgcgactagtaatgtattggcgggtaaggaattcggtattcctatcagtgggacccacgctcattcgctggttcaggcctatggcaatgattacgatgcttttaaagcatatgcccgcagcaataaggatgttgttttcctcgttgatacatatgacaccttgcgttctggtgtgcctgcagcaatcaaagttgcgaatgagtttaaaggcaagatcaactttcttggtgtccggatcgatagtggtgacatggctttcatctccaagcgggttcggcaacaattggacgatgctggttatgaatctgctaaaatttacgcctcaaacgatcttgacgaaaatacgattcagaacttgaagatgcaaggtgccaaaattgatatttggggtgttgggacacgtttaattaccgcctatgatcagccggcattgggcgccgtgtttaagttggtatcaattgaagatgcagccggcaaaatgcgcgacacgatcaaattgtcgaacaatgctgagaaagtttcaacgccgggcaaaaagcaggtttggcgtattacgcgtcaagatgatggcaaatctgaaggcgattatgttgccttggcagatgaaaccattgatacacaacgaagtctttatatgttccatccgaactttccgtacatcaataaaacggttaaaaattttgaagccaagccacttctacagacgatttatgacaaaggccagcaggtttatcacacaccaccgttacaagaagtccaagcatatgccactcggagtaccaacgcattatgggatgaatatcgacgcattctgaacccacaggactacccggtagacttgtcgcaacgggtttgggacaacaagatggatctgatcaaagcagtcaaatcagcggtggctgaccgcgaggaataatctatgagggcatcgaaaaggcgatcgcagcatcgttggctaattcttagcctactagttggtcttgtagttggaatagctgcttatgcgagttacgaccatttttatttgaagccacagattgaggctaaggaagagcggactcggcgtaagtatgaaacagaattgaaccgacatcgggcggttgagcaacgcctccaaaatgaaacgcgaacagcgacatccgcgactgacaagctcatgcagccagttaatcaggcggaagccaagccgtttatgaaaatattggaggctaatcattttagtggtactgcgttgatgatcagacgtggcaaaattattttgaacacaggacttggctatgccgatgctgaatctggacgtttaaatggtccggagacactttatcaaattggttcgattcaaaaagggttgactgccgtgttgctcatgcgactagttgaacaaggcaaagtgcatttgtctgacccgatcagtaagtacttgaccggcattaggacaggcaagcaagtcaccttgcgcatgatgcttaacatgcgtagcggcttatcattgacgcgtgcgcagagtgcttcgctttctgatgctggcattgtccgttggtcgattgccaacttaaattatggaacggttcgttatgattaccaaccagtgaattatgttttgttggctggcgtgattgaaaaagtgactggccgactgtatgccgatttgattcaacaggaaattttcaaaaagttgaaattgactcactctgggtttatgccagagttgtttcacgagtcgaatcaggcgtttggttatagtggtcccattaataatccctacgcaaaacggtacacagagccttctgtgaactataatcgggaactgggtactggcaatatttatacaagtgcgggtgatttgtatcagatcatcaaggcggtgaatcaggggaaaatcatttcaactgcttcattgaaggcactgcggaatttggataatggtcagtacacagcgggggtttataattttggaggctacaccttaacgcacggggtggtggcttcgcaatctgcaggtaccatgattgataccagcggccaaaacgcggttgtcttgcttgccaacacggacaagataacccaaggtctcattaaaaatttgtatctgaatatgattaaaggagtttgactatgcgtccattacaagcagaaatcatcaaagcattgggtgttcaagcaacaatcgatccggaaactgaagttcgtcgtagtgtagactttttaaaagcttatttgaaaaagaacacttttttaaaaacttatgtcctcggcatttcgggcgggcaagattcgagtcttgctggcgctttgaccgaaaaggccatgcaggaaatgcgagcagaaaccggcgacgatgcttatcaatttattgccgttcgtctgccttatggtgaacaagccgatgaagccgatgctatggctgctatcgactttatgcacgctgatgttgtcaagcgtgtgaatattaagccgagtgttgatgcaatggtcgcggcggttgaggctgatgggtcaaagatttctgatttcaacaaaggcaacatcaaggctcggatgcggatgatcgcgcaatatgcgattgctggcaataatgccggtgcggtgattggcacggatcatgccgctgaagccgtgactggcttttacaccaaatttggtgatggtggcgctgatttgacgccattgtatcgattggacaaacgacaaggtgccgcgcttttgaaggtattaggcgcaccggcacacttgtatgaaaaggcccctacagctgatcttgaagacaatcgcccagcactgcctgatgaagttgcgttaggcgtcaagtacaaagacattgatgattatttggaaggaaaagacgtcactgatcaagctgctgaaacgattgaaaagtggtatcaaaaaaccgcccacaagcggcatttaccaatcacggttttcgataatttttggaaataacgcttaaagacagccaaggcatcaccgatagcaatcagtgatgcgacgggctgtctttttgctggataatgtggtatttttgcgtccagaaaagttaaatttggaagagcgtgagcaggcccggtttctaggccagtgagcgcgtttagataagagcgtgaactgagccggtttgaaaccgaagtataggagcggccatttaggtttaaggtccttacataaagggtttgcgcttgtgaatgcatttaaaggagtaggttttaagatgtcgggtaagcatcgttatatttggttgggcgtcatgctaattttatgtgcagtcagcattggtgcgggaacgtacttgtggcagcaaaacagccgatccgccgtgaatacgaaggcaaaatccgcaaagacagtcacaaaagcggtacgtcaggatcggggtaaatcaaaagaagaaatattggccatgaccttggatcgtgccgcgacgacgactgaaggccaaccacttgagcaagagttgaccaatgacaagtttattggcagtgccctgatcattaagcacggcaaagtcgtgtttaacaatggcgttggtgatgccgatacgacgacgcatcgccgcaacggtccaaccacgctgtttcagattggttcaattcaaaaagccgtgactgcggttgcgcttgcgcaattggccgcttctggcaagctcagcttggatgatccggttggcaaatatctaactggcatcaaaaccggcgatcaagtgactttgcgcatgatggtggctatgcgcagcggctttagtttgcgtaagtatcaaccaactgtaatggatgatgctaatattattcaatggtcgattgccaacttaacctatctgccgcaggataattacgcttatcaagcagttaattacgtgttacttgctggtgtgatagaaaaagttgctggtcgttcatacgagcagcaagtcaaaaacaatattttcgatcggctcaacctgaagcacacaggctttttacccgcaatgctgacagatcctgagcgagctatcacttacactggcccggctgctaatccttatcaaactgcgattggtgaaccagcagtttggtataatcgagaactaggcacgggcaatgtctatacttccaccggtgacttataccggctgttgcgtggtattgatacagggaaagtattaccgctttcaactttaaaaacattgcgtaaccgcaacgatggtgtttacaacgcgggtatttataaccatgctgacttttactcaaccaacggtgtcgtcgccggtcagatggcctcaaccgcgataagtcatgatggccaaaatgccgtcattttgctcagcaactacaattcgcatgcactgaatctgcatgacttagcggttcacctatttagtgagttgggctgaatggctgcctaataaggccacttatgctggtttctaacccgacttgcacgctctgctctgattaaacgcgtttgcaggcccagaaactgggcctgttcacgctcttcgcaagtaagccttgcgaagcatgacccgcacctgatatactttaaccaacataggggagtaactagcagagtattctgcgacaacgtcaccaacaaggctatgtctggtgttgtcttaaatagtgagacttatggatctactgctggtagtccataggtctctttttggctaccggcccaaatacgaaggaggcactactttggcaaacaaaccgccatatgcattaagcagtgaggcagtcttaaagcaagaacagactagtctaaccgggttaacgaaagaagcggcacaaacacggttaaatgagaatgggccaaatgaacttgcgcaggcagaaaagaagggcatgttagcccgtttcttagatcagttcaaggattttatgattattgtcttgttggttgccgctttgattgccggctttttactcagtgagtgggcggatgccgggatcatcttggccgttgtcttattaaatgcggttttcggcgttttccaagaaagtaaagctgaggaagcgattgatgcgctgaaggaaatgtcgacccctaacgcccatgttcgtcgtggtgatcaggtgctgaccattcctagcagccaactggttttaggggacatcgtgttacttgaagctggagatgtcgtaccagcagatttacgactagttgagagtgccaaccttaaaattgaagagagcgcgttaacaggtgaaagtgtgccggtcgataagacgacggcaccgttagatgctgatgatgtcggaattggcgatcgcactaacatggcattcatgaacagtaacatcacatacggccgtggcgtcggtgttgtgatcgctacaggaatgcaaactgaagtcggccgcattgccgggatgattaattcggcagaagaaaccaacacgccgctgcaagagaacctcaaaagtctcggtaaaacgctgacggtcatgattttggtgattgcggtgattgtgtttgcagtcggtatctggcgtcaagcggcaagcttaccagaaatgttcctgacagccgtttcattagctgtggcggccattcctgaagggttgccagccattgtcaccatcattttagcattgggtacgcagaaaatggccaagcgccatgcactggtccgtaaattgcctgctgttgaaaccctcggcagcacggatatcattgcgagtgataaaactggaacgcttactcaaaataagatgacggttgaaaaagtttattacgacggtcagcttaatgatgcaagcgctggtattcatggcggcaatccattaatgaccatcatgaactttgccaacgacacacaggtgcaagacgatggtaagttactaggcgatccaaccgaaactgcgcttgttgcttatgggaaaacccagaattacgatgttgccaaagcactcactggcgaaccgcggatcgcagaagtaccgtttgactctgaacgaaaattaatgacgacagttcatcgacgcgcagatggcaagttgctagtcgccacaaagggtgcgcctgatgaattactcaagcgggtgactgacctagcaactggcgaaaatacggcgccgttgtcagacagtgaacgcgatgccattttgaaagccaataaagacatggcgacacaggcgttgcgtgtgctggggatggcttataaggtcatcgatactttaccggaaaaagttgattccgatacggttgaaaatcacatgatttttgctggattggtcggcatgattgatcccgaacggccagaagcggaagctgcggtggcagaggcaaaagcggctggtattcgcccgatgatgatcaccggcgatcaccgcgatacggctgaagcaattgccgttcggttgggaatcattgaccaaggcgatgatgatgctgtcatcaccggcgctgagctagatcagcaaagtgatgatgagtttgcaaagaacgtggcaaagtacagtgtatacgcccgtgttgcgccagagcacaaggtacggatcgtcaatgcttggcagaaaaaaggcaaggttgtggcaatgaccggcgacggtgtgaacgatgcgcctgctttgaaagctgcggatattgggatcggtatgggcatcactgggaccgaagtttccaagggtgcttctgatatggttttggctgatgataactttgcaaccattgttgtggcggtggaagaaggccgaaaagtcttttccaatattcaaaaggcgattcagtacctgttgtcggccaaccttggtgaagtcttgaccttattcatgatgaccatgctaggttgggatttgctggcaccggtgcatattctctggattaacttagtgacagatacgttcccggcgattgcactgggggttgaaccgactgaaccaggtattatgaagcaaaagccgcgcggtcggaagtcaaacttcttctcaggcggcgttggccccgcggttatctggcaaggaattctcgaaggtctgctgacgcttggcgtttactggattgccattacctatccagtgcacagcggctcaggtgcgattcacgccgatgctttgacgatggcctatgctacgctgggcttgattcagctgttccatgccttcaacgtgaagagtatccatcaaagtctgttcacggtcggcgcgttccggaacaaggcctttaactgggcgattctggcttccttcgtgttgttggcagtcacgattttagtgccaggtttcaatggtctgttccatgtgacatcgcttgattggcatcaatggatcacggttctcggggctggtgtggcgatgatcgtcattgttgagatcgttaaagttttcgaacgtgctcgacgcaagcaacgcgcataagacaccacaagattgcttacagtcaaaaaacaataggagtagccttgaccgtgatgtccgtgttgtaacggtcatgacagtcaaggcttttatgcgttaattaccggctaatgagccgatgaaaaggatgaagcacatgaataaacaacaaatgaagttagcaaactacgggacgaccattaatgcggtcgttgaagccacacaagacaaccaagagaaaatggcgccgttgtttgaaccgctgcgcaaggcgattgatgagaacaagttggccgattacgaccttgaggcttaccaacaaacgcaaaccgtgtttagcgaggggacaagtaactatgaagcgttgcttgtcaagttgcagcaagtcgcggcgccagccagattgttggggccgcatcatacacttgtacatgattttgccgctttcacagaggcatgtaaggcgatgaccgcaagtttgcacgcggatcggcaagttgatgtggcagctttcaacgcagctgaaaaagctcaggacgaggcaattcaaaaattcaccaagcaaatccaaaaaatttcagtcatgttgtcttaagctggtcaaaattgtcaaaaaaagtttaagcttatacttgacatgagaactttactcacgtatctttaatctaacaacaaatcaattaactaggacggaggaaaccgacatgacagcattgcttaccttttctgcttggcaaagccaactttaggtaggttgcagacgcaacctgccagacgcgcaggttgtgtctatgttggccctctgttcaatttgtccgcatagataccccaaaagtgggactatgcggacttttttattgccgcgacgagtcctcacctgtcgcggcaatttttgtaagcgtgagccagcccggtttctgggctggcgagcgcgttatgaatcataactgattaagtccaagcgggcacagcatgaattaatttaaaacggaggcggaaacatgaaacgaatgctagggttgatcttcattatggcagcattcttagggattgcctattttcaaaccggcacgacaacaccacagacacaggcaacaccaactgtgggtatcctgcaattgaccacacatcccgcattagatgcgattcacaaggggattattgatggcttgaaggagaagggctatgttgcagggaagaatgtgaagatcgattttcaaaatgccgaaaatgatcaaagcaatctgaagtccatgtccgaacgctttactgaggaacatgcggcggcaacagttgggattgctacgccatcggctcaggcacttgccaatgtcaatcagaaaacaccgatcattcttggcgcgattaccgatccagttgcggcaaagttagtgaagaatgttaaacggccaggtggcaatatcacgggggtatctgatcaggcaccgattgccgcgcagctgaaattaatccggcaaattatgccgaatgccaaaactctcggtgtgattgcaacgtcgagtgatgattccgctcaaacacaggctaaaatggtcgaaaaactagggccaaagcaaggcttcacagttaagaggtacgcgatcagttcaacaaatgacttaaatcaggtggccacacaaatggttagtcaagtagatgcgatttttgtgccgactgacaacactgttgccagtgcgatgcaaactttggttgcggtggctaatacgcggaaggtgccaatttttccaacagtggacactatggttgatcaaggcggattggcaacgattggtcttgaccaacatcatctcggcgttttaactggccggatgctggcagacatcttgagtggaaagacaaagccagcaacgacgccgattcattttgaaaccaccggtaaactgatcttgaacgaaaaacaagcaaaactgttaggcatcgacttacctagctcgttaatcaaaacggcagaggcgaaaggaacggtgatcaaatgagtatcggcgtatcagcgattggtcaaggtttattatatggtttaatcggacttggcttattcttaacatttcgggtattggatttcccggatatgacggttgaaggtacctttccatttggcgcggcagtagccgtgagtgccattactcatggcatttccccgattgtcgcaacgctgttggctaccggtgcggggatgcttgctggattggcaactgggttgttgaccacgaaaggtaaaattccagttttgttggccggtattttggtgatgaccgggttgttttcaatcaacttgcggattatgggacgcgccaatctatcgctgttgcatcaagccaatcttttccagacagcgttcttaaaagatttaccgccatacttcaatagtgtggttatcggcgttatcgttgctgttgtggtggttggcttgctaatgctgtttctaaatactcagttaggccaagcgtttattgcggcaggcgacaatccaagtatggcgcgcagtctcggtattgatcctgatcatcagatggtacttggtctgatggtgggcaatggtctcgtcggtttggctggcggtttgctggctcaaaacaatggctatgctgatgtcaatatgggcattgggatcattgtcattggcctcgccgcgattatcatcggggaagttgtatttggcgaattaacactctcacagcgtttggttgcggtgattctcggtagcattctttatcgcttcgttttgctggttgtgcttgcactagggttcaatgccgacgacttaaaactgatctcagcggttgttttggctatcgcgatcatggtgccacaaattgatcatcgcttgagattacggcgcgtgttgcagaaaggggtgcaagcacatggctgagctaaccttaaccaacgttacggtgaatattcccattggtacagaagtgaaaactttgcttcaggacgtgaacctcaccgttgctaaaggtgaatttgtaacggttttgggcaacaacggggctggtaaatcgacattattcaacgcgattacaggcgatatgccagtcagcggtggcaccattacgctggctgatcaaactttgaatggcaaacgaccggaacaacgtgcgcggcatattgccagagttttccaggatcctaaaatggggacagcaccacgaatgacagttgccgaaaacttgctcttagctagtcaccgcggtcagcggctaacgttgcgatcacgcgggatgacggctagcaaagcggcgctgaagaccttagcagcgaagacgggcaatggccttgctgatgccctcgacaagccgactgagcagctctctggcggccaacggcaagcactcagcctattgatggcaactatgcggaaaccggatctgttgctgttagatgagcatacggccgcgcttgatccgcataccagtcaggcgatcatgcaactgacgaacgaaatcgtctccgatcagcagctgacctgcttgatgatcactcaccaggttgaagacgccttacgttatggtaaccgcttgattgtgttagatgctggtaaaattgtggctgattttgaccaagccaaaaaagcggcgatgagccgtgatgatgttttggcctttttcagttaaactaaaaacgagtcctcgagatggctatttagccatttctcagaggactcgtttttgatatttttagccaagtttgagtaaccaaaatgtcatgatgcaactacgggtgacttggagtaaactattggctcggaggtagatatgacagatcaagaattacaggcccgcgttgaggcgatctcgttgaaagcattccatcaaccttttcgccatcacgctgtttttaataatcggctaaaaacgacgggtggccgctttcatccggctgatatgaacttagacttcaaccccaagctatttgcggtttatcctgcgagtgtcaccgatggcattattaaacatgagctggtgcattaccacctatatgatcaccatcgcggctatcagcatcgcgatcacgactttaagcagctcttgactgcagttggcgggtcacgttttgcgccaccgttgccagtgaacggccatcagtacgtgtatgtatgcacccattgcggtcgccaattcgttcgtcgccggcacattgatgttcggcggtacgcgtgtggtgtctgtcgcggtaaattgcgcctgcaaaagacgttgcctagttaagcggtttttgcaaaatcagacttaccggttcaaacccagctttggcatagacttgtttggcagtctgattggcattcaaaacgtttaactgaatgaaagtggcatcatggcttttggcaaaagccgtaaccgcgtccataagctgtttagccaatccctgatgccgttgcgcagggatcacataaagatcgatcagctgggcaaaatgttgcggaacaaattccgcattgtcgccagtgcgagccaaaacgacaagtgcaaacccacttaaagtaccagccgtttcggtcacgaaaagccgagcaaggtcattttgcaagtagtcggcaaaatattgacgattgtcgctagttaatggacgataagtttcaggagccatcgtcgccatttcagcggttagttgttgatagaggtgaacaatggcaccgagatcgataaattgagcttcgcgaagcatagagaaactcctttcaatgacttgtgtgacatgataattgattaaaacagctgctagagagccttgccggtagttagaaaatctaaggtggcaaaaaagacccgaccaacaagatgtcctgttgatcgggtcttttgtgatgcgggcaagaagactcgaacttccatgagcaataatgctcacaagatccttaatcttgcgcgtctaccaattccgccatgcccgcatggctaattaagcacaagaaatattataggaaattagggatttaaagtcaaactttatttttcaagagcgttcgccatcccggttagaaaccggagtgtaagtggccttgggcatgatggcctgggtttggccattgcggtcaaggtccttacaggcaggtttctgggctggctcacgtgtttagaaaccgacggataagtcaatgaccggttttcagtcatttatttatgaggtctttatgtgtagtctcctccaactacgagcgtgttttgtgcaacgccatcgcgggaattctttgacagccaaccttttccctagcgtttccggtaaaagtcttcctcccagcatcactttcctcgaacgtgtataatttgataaaatcaaacttagacaatttggaggtagcagcgcatgacgcaacgcggaaaagcttataatattgcgattattggtattcttggtgctttgattattcttcaggcttatattccaatggtcggatatgtgcagatttttccggcttggcctgcgatttcaacgattcatttgactgtcatcattggtggtattgtattaggctatggcggcggtgccagccttggcttattatgggggttaaccagtctgattcgggcgtatacatcagcgactgatccagtgaccctgctgctgtttagaaatccgattatcgccatcgtgccgcgtgtcatggttggtttggtggcggcatttatttttcatcaattgttcaagaaaaaacaaacaccgttggcgcaaacagttaaaatggttttcgccggtgttgtcggtgctttgacgaataccttgctagtcattgggtttacatggttgatgtttgccagtaaagcagcgcaaattgtgccgggtgcggatgcgaccaacctaggatggttattgatgacggctttggcgattaacgccgtagccgaggccttgctgggcggtatcgtgacgccaattttgggccatgcattattacgattcagacggaaataagcgttaaatgttgtactgaacggctgtccgaagccaaacaaaagcagaatacaaacaatcataagcggaggccttatcttgacagaagaagaacaagtcgttgatttactcagtgccatggtaaagataccaagtgtggcagcaaaagaaggtcaggtagcagacctgattgaaacctttttagcccctgagttgaaagccggattgattaaacgggaacgcatcagttatgcgcccggtcgtgataatttggtgctgacgatcggtaatcctaatgcccagcgctggctcggtgtggatggccatatggatgtggttgaccctgggaacgtcaataaatggcagtttccaccattctcagcacatgtagaagatggcaagttgtacggtcgtggtgcaactgacatgaagtctggactggctgcagcggttgtggcattcaagcaagctgcccatgaaaaattggatcatgggatacaattgatggcgacagttggtgaagaagttgataatgacggcgcacgccaactgtctgctgccggttacggagatcgtttaactggactgcttgtggccgaacccggcaatagcaatgttgacgctgctgaacgcggtattattgattacacattgaccgcgcacgggaaagcagcacattcgtctcggccagatttaggggcaaatgccattcatgggttgtttgcatttgcgaatgcagcgctaactgcaacagcgccgttgcaggcaaaagaggaccccattcttggtcatgccacgcataatattgatattatccatggtggcaatcagatcaactcgattccggagtccgcatatttgcgcggtaacatccggacaaccatgattgcggataatgatgcgtttattgcggcgttgaaacaagcagctaaaacgacagtgcctaagggtgttcggttgagtctgtcaattgattccgttttaggggcagctgcggcttcacctgataatgatttggttcagttggtacagacagcccgtcaacgtgcggggctgaatcgtggtcaagtggcctatcgcaccggcatcacggatgcggcgttgttctatcatgacggtcttgatttagctatttatggcccgggaaatgaaacgtctcatgagacggatgaatacgtcactttaaaagacgtctttgacagtgttaaagtcttcaaggaagtttttatgaactattaatcatcaatgattggaaaaaaggtttgaccccacaacagataccgtggggtcaaacctttttagtttgcgttgctagataagtgaaattccgcatgatgccgccaagttgcaccggctggcaacacccacggcagagcgtcttggttcatttccggcgaaaagccgactgctacattgggttggccgagaataccgttaaaattatttccggagttgatgccagcgtaagaatcaattctcgtgaatgaagcatcgcttagatatgccaactgccaatcggcggctgcaagggaatagcgttgcgcagtctcacagcgggcagttttagggacaggggtaacatgttcatcggcagtcaacttggctgaaagcattgtttgggcagggtcggcagtgagcagccaaggcaaattgagccggggatgtattttcaagtcggcagtggttgccacctgcatgtcaatctgccacaaattgtcatttgtcaatcggtgggtaatactgagttctcgctggcctggctgaccgtcagcattttcaggtaatgttagggtgaaggtgatggctagatcggtttcttgactggttttaactgcccaattccagttttgccatgaacccggggctagctcagcgtcagctgcctgtaaagggccggtaaaggcgcctaggtaaccgggttggtgtaagtagtcttccagcgtgacgaacccgagcagcagattaggatcgtcacctgcagcatttggcaggcgaacctgttgaacccgagcaccaaacgttaaaaaacgtagcgtcatctgatggtcattgactaaagaatactgggtaatccgttcgctaccgactttggcaaagatcttggcacttagttgcatgacgaaaacgcttcctctctcaatcccttaagcgtacagaaaaattggcagagattcaatgcaattacgcggtgaatctgctaggcttaaagggaaagagaggggtagacccatgagaacgttactcaaaaaagcctatcagctgttgtgggggctctttattttggcactcgcttacagcttttgggcccgcagttttctgccccgccaactgcggcaatatggtgatccggctagttttgggatcatcagtctttttgttgtgatcaatgccatcatgctttatcatcatcattttcgttttcgtgatttgaaaatggaaactgtcgatatcatggagggtgaaaagtttgagtctttttgcgcgtatctgttgaagcgcaatgggtttaatcacattcaactgacgcaggcttcaggtgatcaaggaattgatattattgcccgcaaaaaaggtaaaacgattggctttcagtgcaagcgttacaccggtttcgttggcaacaaggccgtgcaggaagtttgggcgggccatcatttttaccagctcgacgaagcagcggtgatcaccaatagcgaattttctgattcggcaatcgcgttggccgacgacttgggtgtgatgctgattgatcgtaaaaagttgaaacgtttaatgcgccggttgccaagttaaaaagacaactgaaatttgaaagtgcaagtaggagcgcttcgaaagcttagcagaagccgcttagagccttggtcagcgatgcttaacgttcttatgagcaatttttgggatcatgagcgggttttgaattaaggaggaaaagtgtacatgctattaggcttaaaggctagtacagatcagcggcagattcgtgatcggctgcaatatcatcctgatgtatttgaatttcatctcaccgaaaatgattttaccgaagctggatggtcgcattttgtacagatggcagcattagttcagagtcaggtgccaacggtggtttttcatcatccgatgcggtttcgcggccagcgtaatgagcttgccatgaatccgacgaagtatcctacacgctatgactttttaatgacaagttcggttaaactcatgaactttgccaaaaaaactaacgccacggctttgattcacggcggataccgtgttgacacgcctggtgattatgctggctggacagatgtgggcaaagcacaagacgttgccttggcgcgcatgattgcttttgcccaggaagcaccgggccatgtcgtgtttgaaaattccatgtcaccgattttccgatatggtgatcccacctttgaagaccgtttgttgcgctggcatttacctttagcctatgataccagtcatacgtttattgtgttacatggcgataatgatcggctcatggccagcctagcgcatctgaaaccgctgattcagcactatcatcttgttgattccatggggcaaacgcatgatagtttaccgcttggccgcggacggattaattgggcgcgggtcttgccactattgaatcaaaatgcgagtcggatttatgaaattggcttaaaggatcagtttgattgtcgggaaatgattgaaagtcatcattatttggaaagcgttgctaaacggttagctgcgaccaaacatccagcgtaatcaattgagcagcaagccaatttgccgtttaacaaatccaaataacgcacgcggttcatcaacatcagctagataaacgaatcgttgctgtaaatcaggttggttcagtaagagttgcaattcccaaacgcgcaatgcggctttgcgctcaggattaggctgaaagaccagttgcggttgatcattaacggttgttaacttaaaatcgtcaaaacgacttggtgtcggctttgtgtcgagtaacaccgaggcgtttttattttgatcggctagtaaagccagcaaatcggtgacacgcatgaggtagccttctttcgaaatgattcattaaggattggtcaagatggttgttgtctgggggaacaatcgcatacaatctatttaataaacggagatgagtagcgtttttaggcgatcgccaacccaaaagtcggtgtaaccgggttggctcacgctcttattatatcagtgcgtcatctgaatgactgtgataaactgaaacggtttatctcagcatatgcttgtcgaaacgcgttcatagccacagaaaccggcacatcagaaccacgagaacaatggctcggccattgccctcgttcttgattatgcgccggttggctgttcacgctctttaggaggtcatcatggaagaagttgtgattctaagtgccaaacggacgccgattggtaagttgggtggtgatttggctggcgccagtgccgttgatttaggggttgcggcagcgcaggcggcaattaaggctgcacgaattgacccagcgttactcaaccaggcgatctttggtaatgtcatgcaggctggttctgggcagaatgttgcccgacaaatcggattaaaaagcggtatggccactagcagcacggcgatgactgtcaatgaagtctgtggctcaggcctgaaggcagtgcggcttgggcaagctgccattcaactcggcgaggctgacgcggtgcttgtgggcggtaccgaaagcatgagtcaagtaccttattacgccgaagcggttcgttcaggccacaaatttggcgatacaacgctggttgacggtttgagtcgcgatggattaaatgatgccttcagtcaacagccaatgggaatcacggcggaaaatgtggcgacacaatttaacgtcagtcgtcaggagcaagatgagtttgctctccgttcgcatttacgcgccgcggccgccgcagctgagggtcggtttaagagtcagatcgccccagtgacgattgctgcccgtcacggggatgtcatcgtagatcgtgattcagccattcggcccgatacgtcattggctaaattagcccaattaccgcctgtttttgaagtcggcggtactgttacagcaggtaacgcaagcggcattaatgatggcgcagccgccttgatcctgatggcaaaatcgaaagccgaacaactggggctccattatttagcgacgatcactggttttgccgaggtgggtattgatccggcaattatggggtatgcgccaaaactggcgatcgataaaatactgcaggcaaccggcggctctatcgaggcaattgatcaaattgaattgaatgaagcatttgcctcacaaagcgttgctgtggctcgtgaccttggtttaaaggatgaacaattcaatatcaatggtggcgccttagcgttggggcatccattgggagcttcaggcgctcgaattttaatctcattattgtacgatctggctgaacgtaatcaacgccaaggtattgccgcattgtgcgttggcggtggcatcggtatcgccatgcaaatcgcgatgcatgtctgagggagatcgtgatgaaattttacgagttgtctccggaaaaacgccgtgatcaattggttcaagaagggtggttaacaacacaggatgctgcgttgttagctggtacgcatagcttgcctgaagtcacaggagcgcgtctgatcgaaaatgccatcggcgagtttcctttacccctaggcgttgctcgcaatttgttggtcaatggacagctacatcaagtgcctatagcggatgaggaaccttctgtgattgcagctgccagtaatggggccaggcttgcgactgcaaacggcggcgttaggacccatgtagcggcgcatcgagtggtcgctgaagtagtcctgactaacttgaccgacttagtgcaagcaaggcaaacgattttggctcatcagactgatattcagaaagtcattgcggttgcgcatccttcgatgattcaacgtggcggtggtcttgatcagttaacagtcgaatcactaggagcgcagttcttgaaaatccgtttaacgctcgatccgcaacaggcaatgggggccaattatgcgaatacagttgccgaagcggtcgcagcggcggtgacaagctgggtagacggtgatgtgcttgtcagtattctaaccaacgcgccaacagaactcgtgacggctgaggtttcgcttgagccggtttctttagcgacgaaagctgtttctggagatgtgattgctaagaaaattgttcagcttagcgatttagcctttgtcgatgctgagcgggcagtgacccacaacaagggcattcttaacggtattattggtgctgtattggctactggcaatgatacacgcgctgtcgcagcaagtatcggtgcatttgcatgtgcgtctggcaggtatcagcctttatcgcgctggtatatggatcagggccatttagttggtcacttacagctgcccttgccgatgggggcagttggcggggcgatcggtgctttaccaatggcgcaggttgtccgtcggctcggtgggtatcagaatttagctatcatgcagcaagttattgccgccctcgggttggtgcaaaatcttgctgcgatgcgagcattggctggaccggggattcaagctggtcacatgaagttgcaagctaatgccctcgccattgctgccggggcaacagaaacagaattgccgatgcttgtgaacgcacttcgtcaaggtagtatggatttaaaacatgcgcaacaatatttaacaaccattcgtttaaacaagaaagtaggccaatcaaaagatgaaaatcgggattgatgcaatcgctatggacaccccagatttctacgttgatttagtaaaactcgcgcaggttcgaggtgatgatccggacaaatatacgattggcattggccaagacgagcaagcggtaccaccttctagccaagacattgtcacgatgggtgcgaatgcagcgacaaagttgttgacgccagcgattcgcgctagcttgggcatggtcttggttggtactgaaagtggtgttgatgccagtaaatcggctgcattgtttattcatgatttattggcactccctgagtgggtgcgggccgttgagttaaaggaagcttgttatggcggtactgccgcactaatgatggcgcgtgactacatcgccgctcacccagataaaaccgttttagtcattgctgcggatatcgcccggtacggtttggcaacagcaggagaagtcacacaaggtgcgggcgcggttgccatgttaatcaaagcagagccgcacatcatgaccattgaagacgattcggtttatcggtctgaatctattgacgatttttggcggccggtttatcaagacacagcaattgcacaaggaaagtattcaacggaacaatatttagctttttttcaagcaatttggtcacgataccagacccaacgccatcacacagcaagtgattttgctgcgatgacattccatttaccgtataccaaaatgggcaagaaagctttaaagcttgttcttccggacacagatgaagccactggcgagcgactgcaacggcgctttgaggcaagcactcggtactgccggcgagttggcaatatttataccggttctttgtatttgggtctgctgtcgttgttggacaatgatactagcttgaaagcgggtgaccggatcggtttattctcgtatggctccggggctgtggcagaattttttagcggcatcttgcaaccggattttgccgcacaactgcatgcagccaatcacgctaaaatgttggctgatcgtcaggaattaaccgttcctgaatacgaagctgttttcagcgataaggtgccttatgatccagaagattatcgtagtgatccgacttattatcacggtcagtttgttttgaccggtgtgatcggtcaagaacgtcaatatcagcagcggtaatgcttgacagctaataagatgatgaacaggaccgtccctcgacggtcctgtttttgatccatgatcctgatcatcattaagttaatttgtgaaaaagatttaccaagcatgttatggcgtggtgatgctgtattagttcacttgtttgactgttatggtgccgtcgcttgctagtttaagcgctttatgcgctaaggtcgcaatttgggcgttaaggttgcttaaaccagatgaaagggcttgcattgttatcaataaattgttatactcgtaatcgtaaagaacttacaaaatgtaagtaataatattggaggcaagtgtcatgacagaaaaaataaacgccgcagacgcaatgatcaaggtgctcgaagactggggtatccataatatttatgggttaccgggcggttcttttgatagtaccatgaatgcgctgtacaatcgccgtcacaccattaattatgttcaggttcgccatgaagaagtaggcgcattggctgctgcaggtgaagctaaggtaacgggtcgaatcggggcgacatttggttctgccggtcctggtgctgttcatcttctgaatgggttgtatgacgcacagtatgataatgtgccagttttggcattggtagggcaagtaccaactgctgccatgaacaccaattatttccaagaaatgaacgagaacccaatgtttgctgatgtgtctgtatacaaccgtacagccatgactgctgagcaattgcctcatgttgttgacgaggcgattcgtcaggcttataagcataacggggttgccgttgtgactattccaaaggatttaggttggacccagattgatgacaattatgtatcatcagccaatctgtaccagaagccgcttttgcctgatccagacccggatcaggttgccgcagcttgggatatcttgaaagatgcgaagaagccaatcttgtatgttggaaatggcgcgcggggtgcgcgcgacgagattatcgctttctcagaaaaaacgcatattccgatcatcacgactgccttggctaagggaatcgtgcctgattataaggcaaacatgggctcggcaggccgtgtggcttctaaacctggcgttgaagttgcgcgcggtgctgacaccgtcttgttcttgggatcggatttcccattccagccatactttatagcaccaaatgctaaatgcattcaggttgatattgacggtagcaagtttggccgtcgtcacaccgttgacttagctgttttggcagatgctaagaagttcatcaaggcactgagcgaaaaggctgatcaattgccagaaagcgcttggtatcgggctgctctggccaacaaggaaaattggcgcgagtggatgacttcatttgaagatgatggctccacgccactgcgcgttgaaccaatcttcaaattgatcaatgagatggccgaaaaagatgccattttccaagtagacgttggcaatgttaccatcaatgggatgcgttatctgaagaccaatgatgatcaagtgttcacgacgtctggctggtatgcgacaatgggttatgccttgccagcagcgattggtgcgcaagcggaattccctgatcggcaagtttggtcaatttctggtgatggtggatttgccatggtcatgcaggatattctgacacaggtcaaatatcatatgccaatcatcaacgttgttttgacgaatgagagtttgggctttattgaagctgaacaggatgacacgcaacagccgcactccggggttgatttaattgatgccgattatggtaaggcagctgaagcgttaggtgctcaaggatttgaagtgcacaatctggacgaattgaaagccgcatttgctaaggcaaaagatcgtaagggtccggttgtcattgatgtgaagatttctgatcttcggccaattccggttgaacaacttgttttggacaagcaaactcaggatcctgctgctgtggatgcttttgtgaagaaatatcatgcagaaagtctgattccattccgacagttactggaagatgcggagaaaccggtaacaaatgcttaactggttgacttaaaatataaattacaaagctttccagcaattaatatgccttgctggaaggcttttttttgcttaccgctattttaagtcttcattattagttgccgggcttttgcgataaggcgtagagacaaaattttaaaaaattaaagaaatcgtttacaagaaagcgatttcttggtattataaaagtcgttcgaacgaatagtcattcgaatgacttatgatatggctcgttaagctagcgagtatgctgatattaaaaagtcattctgtggtgaacaataattttgaaattttgaaagcgaggaaaaactaatgggtaagaagacaattatgttagtttgtgcagcaggtatgtcaaccagtatgttagtcaaaaaaatggaagatgcagcgaccaaagatggtattgaagcaaaaatctttgctacttcggcttcagatgcccatgacaagttagattcagaaaaaccagatgtcctgatgcttggaccacaagtgcgttatttagagggagatttcaaaaaggatcttagtatcccagttcaagtgatcaatatgcaggattacggcttaatgaaaggcgaaaatgttctaaaaacggctcttaagctgattgacgagcagtaggaggtcaggatgaacgagcaagagcaactagtgatcatgcagctaattatggccggaggaaatgcaaaaggatcttcttttgaggcaattaaagctgcaaaagtcggtgatttttctaccgcagaagcaaaattgaaagaggcagacagctttctgtcagatgcacataatgcacaaacaggtatgttaaccgaagaagctcaagggaaaaaacatccagtatcattattgatggtgcacggacaggatcatgttatgaatgcaatcacatttcgagacttagcaggggaaatcgttgacctctataaaaagttagctacgaaataagtctaagcgaaaggaatgtgacacgcatgtcagaccaaaataaagcaagatatgacaagagtcggagagaattaagcttaactagtatgtactttaatcgctatttattaatccgttacgtgaccgctggttttttctttgcaaatttatattggttttttcttagtttgggcacacagggcgcgatgaaatgggtaccgttttgtttgaccgttataaatgcagtggtagcggttgaacaagtaagtaagtactggcgaagagatagcaagttaccatttactaagttcggttatgtagttcagttaataagcaatttcctgagcttatccataattgtcgctggatctgggacaaaactgtttccatttttaggacaaaagggtttatctctggcaacgactgttctgttaattggtctaggcatatgtttttatctcttagtgcgtatccgtttgattgaaaaaaatcaggatcggtatttacaacaaataaataaatttgctcaaagcatacaatgagctcaaacaaggagacaaaactatggattcaagtaataataaattgtttaaatttatgaacaatcatttgatgggaccaatgggaaaacttgcctcgttcagaatcgttcgcggagtcatggctgccggaatggcatccattccatttaccatcgttgggtcaatgtttttaattattaatgttctcccccaaagttttccggcattagtcggtatttggaagggttcttttgataaggttgcaaatttgtatatgcttgctaatggcgcgaccatgggcattttagcactttatttctgtttagtttttggttatgaatatactcgcattcaggctcaggaagaaaaaattgatattaatcctttaaatggtgcattgctttctatgatggcgttttttatgtgtatacctgaattagtctttaaaggtgggacagcgaccttggtcaccgaaatcaccaaggacaacaagattatagatggttatgccatcgcaggtggggtaactcggctgggaacgactggtatctttacggccattatcatgtcgattattgcagtaaaactttatgcgtggtttgttaaaaagaatattgtggtcagtatgccggataccgtcccagctggtgtttcacgttcctttacagctttgattccgaccgctgcgattgccttaactgtcattatcattaatggtattttgatggcattcaacaccgatatctataagattgttgctattccgtttggttttgttactaacctgaccagtacatgggtaggactaatggtcgtctactttatcatgcatgcgctttggatcgttggcattcacggcgcaacgattgtgacctcgttccttaccccaattgttctctccaatatgcagttgaatcagaagggggcaaacatcccatttgccggagaatttaataactgttttgtgactataggtggatcaggcgctacgcttggaatggttatttttatcgccttctttgcaaaatcggcacagcttggtgcattaggcaaggcatctgttgttccagctttcttcaacattaacgaaccaattcttttcggtatgccagttgtttataatccatatacagcgattccattcttcttagcaccgatggcatccatgagtatggcttacttcgcaatttcaatgcattgggttaaaccgatgattgcacagccggcatggccaacaccacttggtctttcagggttcatcggcacggcaggcgattggcgagcaattgttttagctttcgtttgtgcgcttgtagccttcctgatttggttcccatttattaagttctatgatggcaaactatataaagatgagcaggcaaaaggtgcagcggaggcggcggcttaagaagcggcagaccaattgtaaatggttcgaggactaaataaggaggattattttgacagcatttcctaaaggtttcttgtggggcggcgcagtcgctgctcatcaattcgaaggtgggtggcaagcaggcggtaaaggggtcagcattgctgatgtgatgaccgcaggcgataatgaaactaaacgcagaattacagacggtgttcaatcaggcgagaattatcccaatcatgatgctattgattattatcatcgctatcatgaagatgatcagctctttgctgatttaggattgaactgttttcggacaagcatagcttggactagaattttcccgaatggtgatgaagaacagccgaacgaagcagggctgaaattttatgatgacgtgtttgatgatcttttatcgcatcagattgaaccagtgattaccttgtcacattttgaaatgccttatcaccttgtcaaaaaatatggtggttggcgtagtcgtaaggtgattgatttcttcgtcaaatttgcgactgttgtgtttgatcggtacaaagacaaagttaaatattggatgacttttaacgaaatcaataatcaggttggcatgatgaatgaatggtctctgttcaccaattccgggctactgatcaagcctgatgaagataaagaagcagtcatgtttcaagccgctcattatgaggccgttgcaagtgccttggcagtccaaattgggcatcggattaaccccgattttcaaattggctgtatggttgcgatgggtcctgtttatcccgcaacaccgaatccaaatgatgtgtttaaagctgagcgaacgatgcagactaattattatctggcagatgtccaagtaaagggcaagtatcctgcatttttggatcgttattttgatcgacatgcgtttaacttggacatcacacttgaagatagtgatgttttattagctgggaaagtcgattatattggattttcttactatgcttcccatgtcactgaagcctcacaagatgaacctacagactttattaccatgggacacaatcgagaggttaagaattcgacgcttcaacgttcagactggggttgggagattgatccagtcgggttgcgttatgcactcaactggtttagtgatcgatatgaggtacccttatttattgtcgaaaacggttttggggcatttgataagatcaatcaggatggccatattcaagacgactatcgaatcgattatttacgtcaacatattaatcagatgcgacttgcagttgaggtcgatggtgtcaaactgatgggttatacaccgtggggcattattgatttggtttcggcgggaaccggtcaaatggaaaaacgttatggcgtgatttatgttgataaagatgatcaaggtaaaggcacacttgcacgaagcaaaaaagcctcttttgattggtttcaaaaagtgattcgtagtaacggggatgatctcgcctagcatgaaaatgcatgtagtcaaaaaaaacgcctttcgaagggcgtttttttactggagacgtggagctagtccggaacagtaaatggcggtataataacatgaaatgactgagcttagaagcaaagttgaaaggcggaaataaattgtctcagcgggaaagtagctatgatattaaaacactcgagaatcaattaatcaaggcgattcaacaaggtgctattcaagatgaagatggtcaactacctgctgagccggaattgatgcgtcaatatcaagtcactcgttacacgttaagacaagccttaaaagatcttgccaatttgggctacatttatcaggcacatggtagcggcacttttgctcgcccacaccacgttgagggggccatatcgcttcaaaataacgttgggttgacggaagaaatggcgagacagggacgagttgttaaaacaacggcaattcatcaacaagtcattacgctagatcaggcagattttttgcctgaaagccagaaattaccgaatgagacgacattaatttcggtgacccggcaacgaacactagacggtcaaccgttcttagtagaacactcgtattatttaagatcgattgtggacaacattccgaatagtgcattaaaggggtccctatttgcttttattgatcaaaagcctggtctgaaagttggattcattgactctgtaattgagtgtgaaatgatttctggcttaccagccaaattctttgggattgcagacggaagtccaagtttagttgttcgtgacgattcgtatctaagttctggaaaattatttgcgttttcgaaaattttttatgactttcgtaaaaccaaattttttatgcttaagaaaatgcattaattttcttaattcggctgatagtgacaagtaaaaaagcctgctaacatattagcaagcttttttacttgtcactagaatcggatttaagcacgggatttgatactggcgatcaagctatcctcatcagttaaaatagcgccgttaagtttaattaaaccagtggtatacagattgagatagtgaaactggttttctgcaacttgttgcaaagcaccgagtttttgttgattggcggcgcctaaccgtcgactgtccgtgtaaagacccaaaataggaatcttagcagcataggcaacgccgatttcactagcgaccccgttatcaatcacggggccatcgagaatggcaatcatcaagtcagctgacagcagccgcttggtgtcggcttcggcaatcattttcgaatcggcgtatgcctctttgttgttgatcgcggcattttcttgaggcacgtacatgtcaacatctggtaaggcgcggcgaatttgggcagcgagttgcgcattgtaattaaaatcagcatgactgaacaaggcgttagcaaagtaaattttcattttttaagacctcgtctgtagtttgcgggattgttggtttaggtggggtgccgtgaagtggtggcctgatgaaacgcgttcacagtcgcaaaatctgacacatacagaccttgaacctaaacggccgcttatggttcggcttctaaacgcggctgttcacgctctttttgaaacgcgttcacagccgcagaaacctgcacataaggacctcaagccgtaaccagccaaagcccggctggttatggcttgaggccgcttatgttacggttcctaaacgcggctgttcacgctcttgtaaattttaccactgcttcgcatcgtgctgtttgtggaaacatgtcgatgctttgaatccagtcgactttgtagcgtttagtgagggaaacgagatcacgggccaaggtggaagggttgcaggaaatgtagacaaatttgggtggatcgagttcaaggagggcgtcgatgaaggcacgctctagtccagctcgtggcgggtcaacgatgaccgcgtctggtttcatgccttcctgaacccattttgggaaaatgtcttcagctttgcccactgaataatgggcattggtgaggccatttgctttagcattggccttggcatcggcaatgccttccgcaatggtgtccattccgtaaataggttgattgccttttgctaaactaatgccgactgttccgatcccacagtacgcatcaattaaggtgtcgtgcggccctaaatcaagtgcttttgcggccaatgtataaagtgtctctgtttgttttgggttcagttggagaaatgcttgtggtgagagttgaaaagtccggcctaacagtgtttcttggatataagggagacctgccagtaggcgactttctttgccccaaattaaggatgtttcgccaggattgatattctgggcgatgctgacaaccatgggaagctgagtggcgatggcattgagcaattcgccttcgtgtggtaattttggactgttcgtgatgaacgtgacctggacttctttcgttgcaaatgattcgcgaacaaccaatgttttgacaattccggagcgctttttctcgttatagatcgggatctgaagctgttcgagaatctgacacaaggttgtcacgactttcattgtcagcggtgcttgggtcagaaacttggttaaagggatgagatgatgtgagtttggagcataaagacctgcgcgtacgtgaccatcaatgacccgaacaggaaattgggccttgtttcgatagtgcgttggttgtgccatgccaatcgtcggccgcaaatcataatgggtccagccagttggcttaaatttggcaagcgattgtgcgacgacatctcgcttaaatcgcaattgcgccggataagcgagatgattgagttcaaccccgccgatttgtccaaatagcggttctgctggggttacgcgatttggtgacgccgtccgaattttatgcactttggcctcaagatagcggtcgtgaatcccagtgacctctgcgacgacgacctcttgaggtagtgcgccggtaacaaacgtaattttccgttgataataaccgatacctgcgccattaatgtctagacgcttgatggtcaggggaaagcgctgaccgattttgacagtgactgccatgaaatgctcctttgctttgagaaatggtgacgaggcttaagaatgtttagtataatgaatcatcgggaggatttaatgtgaaaatcaattattcgaatacgatgagtagaaaaatgacagcaacggtgtggcaaaatgacacgccgcatacgatacgagttggcgagacgctagacttaaaggtgcaacgcggcgataagattacttataaagttggtcggtttaatgcgatccacacgattgactatcaaagtccggatgcccaatttgaaattcaaatcaatcgcagcctacaaaatgcctattttgttgtgatgtttgcgatggtagtctttctttggtttaatcgcaacttcagtcaaacgattctaattgcagcggtcattttgggacttgctgggtatgaagccctagtctactttgtcggctacacggcaaaaccgattcactgacgagtctgattcgtatcggctgctgttcgttgctcgcgctgtaggcgttttctgcgttgaaaaaggtgaaaatagtcttgatcgctgggttccttggaccaagtgatcaagggaacagttggatcaaacgggtggcccatgcaagggatcacccgttttggctttgtcagcgttgtaatgatcaagtcaggattgatcgcctcggttggaggcacaacgcgaataaagcctaaatcgtttaaaaagtttaagagatcccgtttgacgaaagaatcatgttcaatcaaaacgttaacgaccatttgcatgtcacgattgagttcaggataattatcattgactaatatatagagaccattaataaattggcttgtaaagtctgcgtagattgactcaggcgccattttgcgaattcgtttcaaacagtcgcgaattttggccgtcaattggcttgttcgtgcttcgtcatgcaatgtcgaagcaaaatcaagcctctgactaaaatgaccattcagcacatactcggtgaaacttaatcggtaaagattggctatcatgacttgattttcggcaattaactgacttttggtttcttttaattggttattcaaagaagtgaccagatgtcgcacaaatcgattcactaagttatctttactttgaaaatgggtcatgatctgataatcaatttgatgtggttgccgagtgacggtcataaaatacatacgcgaaaaatagtaatactgtttttctgcttttaattcagaagcagataaattgggaaagtagtctggcgtaaaaatcaaatctggcaattcagtttcaccgtcaaacaacagctgcattcgccggtttggtaaaagggcgtgcccacagttgattcgtaacatctgaatggcgagaatcagtaaagcttctttggacattggttggattggtgacaccaagaaagcctgctttgtttggttgattaccttgagaagtgcttttgcttcccgctcttctgcacttgaaaatggccatcctgccccgcgataggctaatgtaaaaaaggtgaacatggctaagcgtatatgcaattcatcgccttcaatggcccaagtagtactatttagcgtgacaccattgtcagctaagtagtctcgaaacggcgaaattcggcgccgcaacgttgaaatacttgtttgatggtgctgcttgaaggcgtgaaagtccgaatgcggattcttgaaaaccccatcgaaaaattcaaatggtagactgttttttaatagcgagaaccgataacgaccaatcgaaacatcaggcaaaactgctgcgaagtttgattcgtcaatctttttgtcaggtaagatttggttgagctgtgctaaaacggtctgaaatgccgtataagtctgcgaatacgaaagcccagtattgcggctaagcgtattgatcgacattgtcgtctgttgtagggtcttcattgcccggaatagttgataattaattaagctgtgcccgtcaaagaaactggcttcaaacataacgagcctccaaatttatttataaaaagtataacatagaatggcaacgtgattagagaggtgacaggggttcatgagtgaaattacaaagataaccgcccaaaaaaggcgtgggcgctataatatttttattgacgggacttacgcatttccggtgagtgaaaccacgctggtggattaccgcttggccaaaggaatggtattgacagcagagaccgttgcccaaatcaagagcagtgaagtcaccgcgatgggactagagatcgggctgacctacattagccaccaaagtcggacgagcaaagaggtcagtgatcggttagctaaagaagacttaccggctgatgtgattcaaaaggtgctgactcgtctgaccgatctgggctttttggatgatgcagattatgcacatcgttacattgaagagcatctgaaaatgggtgaacttgggccgcgaacgctgcaacataagctacaacaaaaaggcctcaagccagacttgttggccaatgagttagctgctattccaacaacagcatggctagatgcggctgttcgcgctggtcagaagaatcttcggcaccaccagcatcgcgcttataaagaccaactgcaacgtctcagagtcgctttaatgcaaaagggattcgatgatactactatccaaacagctatcgcaaccatcgacccgcaacccgatcctgaggcagaaagcgacttgcttaagcttgaggcagccaaacaatggcgtctaaaagcgaaatatgatgatcgagagcgcaaacaaaaagttaaaacaactttgtttcgtaaaggctttgatgtggaagctattgatgaagtgctagacgacttggcggaaagttgatcgtatttttttgaaagatcaagctatccttttgcatgcccttgtaagctaccgactcttgctgaaaagcgttcactgctgcaataagtcaacctcaggcacaaatgaacaaagtctggccatcacacatgaggctggcttatacaccggatttttatcgggttgcttcacacgcttgctagtttctaagcgcgcctgtccatgctctgctataataaagaacgaaatttccaagaaagcgggttttgtatgcggatccctaaagaaggcgactcgtttgctattcaaagttataaacatgacggtagtctgcatcgcacctggcgtgacacgatggtcttgaaaaccagtgaagatgccctgatcgggtgcaatgatcacaccttggtgacggagtcggacggacgccgttggctgacgcgggaaccggcgatcattttctttcataagcattactggttcaatgtgattgcgatgatccgtgaaggcggcgtgtcgtattactgcaatctggccactccgtacacaatggatcaagaagctttaaaatatattgactatgacttagacgtcaaggtgtttgccgatggtgaaaaacggctgctggatgtggatgaatacgaggcccatcgcaaactttggcagtatcctgcaaccactgatcggattttaaaagctaatgtgaaggtgcttgtcgattggatcaaccatggcaaaggacccttttcacaagcctatgtcgatttatggtaccgtcgttacattcagttagcgcaccggatctagcccaaccggtcaaacttggaggcaaaaatgaaacaaattccaaaacaacctgctcaactttttgcgggtcatgcctataccgtcgaaagcagtgatcagcttggtacatttcaaccagcgtggcaagactttgaggcgcaacttgggtttaaaacgctcgatgatttagccgagatacccaatcgatcggcgatggttgtcttttcgccatatgacacctttttatattggatcggcagcttgttaccggctgatgcagtggttcccaaaccttatgaagcgtttcgcctacctgaagcaacggctggtcaggtcaggcagccagctacaagtgtgctgttgaaacaattaccacttgcaacaagctttaataagggtctgcaaatcattgaaaaggcagggtatcctttgccagaaagactcgggcaaacagatcatccttattatcttgaaagctatctgattcaagatggcgcggttcatcaagtggcttatcgtctatatattgatcctcatcagttaaaaggtgtggatgagtatgagtaaagtgcatgaaaaataagaacaagcaggggattagcctgcttgttgaattgatgcgatcccgatatcttcgtgttgggatcgcatttttctcacatactcatggtttaatcaagtgaagctgataaatttgaatgatcgtcaagccagcttgagtatcatttcacggtggcggatgccggcatcaagaaattcagggcgatcggtcaattgaaaaccgagggctttgtaaaagccaatcgcctgaacttgcgcacctaagcgtagcgcttgaatttgctgggcgcgagcataagtcatgattgcttcaaacaccatcttaccaaggccatgcttgcgataggctttttcgactgcaacacgctgaacgtggtaggcgtcgccctcaggcagaatgcgcgccgtagcaacaggcacacctgcatcgtaaatgacaaaataggtcgcctttgcttcatcggcgtcgacttcgagctctggtggcacatgttgctcttccacgaaaacgtgggtgcgaatctggacgctgtcttgatgaatctgtgaatcaagggttgttgtcgttttgacttccaaaagttgaaccttctttccgttttaataaattgtttgctattatagcactagtaaaatgctgctggggaggtcgaatatgtttgataggttacggcattcaaaattaatgttttggtccgttgaaattctgattttgatttttgtggtcatcgggttgacgcaggtttcgttcttgtttgcacctgtggcgacttttttctcaacgctactcattccgattttatctgctggttttttgttctatctcttcaatccgattgttaaattattgcagaagttccacatcagtcgcaatatttcgattttattgattttcttggtggtcatcgttgccttggttctggtattcatggccgtactgccaaacttgatctatcaggtcactcagtttgttacgaatattccggatttcttaaaaggcgtccggtcattcattagtaaggcgtcacactatacttggtatcagcggctaaatattggcaaatatgttgccagtcttcaaatttcgccaagcaaggtgttgagcaaagttctgggcggcttttccaccggcttgccaacggttatcggatcagtagccagcatgatgatcagtatcattacaatcccggtgatgctattttactttctcaaagacggtgaaaactttgtgccaagtattcaaaagatgttgcctcatcggtatcacgaagaggttgcaactgtttttacgcgtttaaactcgacactgtctcactatattggcgggcaggccattgaatgtttattcgttggcacttttacttttattggttatctgattattggcatgccgtatgcgtatctcttaggctttattgcggggatcgttaccattattccgtatttgggaccctatattggtattgcaccagctttggcaattgctgccactgagggatggacaaagatgctactcgttgtcgtcgttgtcgtcattatccagatgacagatggtaattttatttatccgaatgtgatcggccgctcactggacatccatcctttaaccatcattattttgctgatggttgcaggcaatctatggggattgttaggcaccattctagctgtaccgacatatgctgtcatcaaaacagttgtgacatacttatacgagctttatcgtttccatcaggaacataagcatgacgaggatgctgacagtgatgaggaaaatgctggagaagctcatcagatcaaggatcaagccgatccacaattgaaaaataaataaagacttggtatactgaaataatcgaacgaagcggggatgattccccgttttttttacgaaaggttgtgtttttgcatgggcagtgacccagacggtcagatatggggacaattgatcctcattgtgattttgaccttaatcaatgcagaatttgccgcggcggagattgccgtggtttcaagttcccgtactcgtatgaaggcccaggcggataaaggcgatcgaaaggccgccaagcttgtgaccatcatgaaggattcgagtaattttctggcaacaatccaagtcgggatcacttttgccggtttctttgcgtctgcttcggccgcaacaacgctggcagatcgggttgcaccaatttttggcggctggtcatttgcgcatgaggcagcggtcatcttagtcacgctgatcttgtcttatttttcgttggtttttggcgaattatatcccaaacaggtagcgttacaaatgacagagcgggttgctaaaatgagtgtgaccccgatcagttggctagccaaagtgatgcgtccgtttgtttggctgctttctgcttcaaccaagttgttaatgaaactgacgccgatggaattcaatcatgaaggggaaaccgtgacccgtgacgaaatggtttccatgatcgaaagtggtcgaaattctggggcaattgatcccgatgagtatcaaatgtttgagggaattatatcgttgtccgatacgatggcgcgcgaggtcatggtgccgcgaacggatgcttttatggttgatgcgcaagaacctgatcacacggcgattgacgcgattttgaacaatatctattcacgaattccggtttatgaagaagacaaagatcacgtggttggcattgtgcacatcaagaatctgctaaaggaagcacgccgcgtcggctttgatcatgttaaaatcgaatcggtcatgaccgcgccggtttttgtccccgaaaccattacagtcgatgatttgttgactgaaatgcaagtgaagcaacaacaaatggcgatcttattggatgaatatggtggcgttgtcggcatcgtgaccattgaagacttgcttgaggaaatcgtcggtgaaattgatgacgaatcggatcaggttgaaaaattgttcacgaaacaaggggaacatgatttcgttgtctcagggcggatgcccatttcggacttcaatgatttgtttaaaactgatttggatgcaccagatgttgacacgattgcgggttatgttctgacgcaacttggtgccattccttcatcgcatcacagcgaaaaaatgcagctggcaccaggtgtgttgttggcgactggcaaagttgaagggtcacgactcgtcaatgttcatgttcatctatcatcggaaccagtaccagaagaagcctcccacgaggccgatagctagcgatgcagtctgtgtaaataggcaacgttgttagcaaattttgtcaattttggaaggaaagcacgatgaaaccacaggaactagcaaaagaagtcgcaaaacgccgcacatttgcgattatttcacatccagatgctgggaaaacaacgattacggaacagcttttattgtttggcggcgtgatccgcgaggctggaacagttaaaggccgaaaatccggacattttgcgaaatcggactggatggaaatcgaaaagaaacgtggtatttcggttaccagctctgtgatgcaattcaattatcagggcaaacgcattaatattctggatacccctgggcatgaagatttttctgaagatacctatcggaccttgatggcggttgatgccgcagtcatggtcatcgactcggcaaaggggattgaagctcagaccaagaaactgttcaaagttgtcaaacaacgtggtatcccgatttttacattcatgaataagttggatcgtgatggtcgcgaaccattggatttgattgctgaacttgaagacttgctgggtatcgaaggctatgcgatgaattggccgattggtatgggtaagggactcaagggtctctacgatcgagtgaatcagcgaatcgagctttatcggcgtgaaggtgatgatcgatttttgccgttgaatgatcaaggtcagcttgatccaagtcaaccattgacgcaggattcgatttatacgcaaacattagatgatatcgaattattgaatgacgcgggtaaccagtttaatttgaaaaagatcatggctggtgagcaaacaccagtgttcttcgggtcggcgttgactaactttggcgttgagacatttttgaatagcttcgttcaatatgcacccgaaccgggaccgaagaaaacagaacaaggcggggaagtgaatccgactaacccagagttttccgcatttgtctttaagattcaggcaaacatgaaccctgctcatcgcgatcgcatcgcttttgtccgaattgtttcaggtgaatttgaacgggggatggatgtcatccttcatcgaaccggcaaaacgatgcgactgaataactcaaccgaatttatggctgacacccgtgaaacggtttcaactgcggttgccggtgatattgttgggttgtatgatactggtaattttcaaattggcgataccatttatcaaggcaaggaaccgattcaatttgaaaaattaccgcagttcacccctgaattatttgttcgcgttacgccgaagaatgtgatgaagcaaaaatcatttcataaggggatgcagcagcttgtccaggaaggggcagtccagctttacaagacctataacacgaatgattatattctaggagcagtcgggcaacttcaatttgaagttttccaattccggatgctgcatgaatatcattcagaagtgattatgaccccgattggctcgcgaacagctcgctggatcaatccagatcaattggatgaaaagatgagcagttcccggaacttattggttcaggatatccacggcgacccgttgttcctatttgagaatcaatacgctgaacgctggtttgcagacaagtatcctgacgttaaattaactgccaaaatgtaatagggtgtttgggtatgagtatcgtggcacacaaaaagcggctgagcgatgtcagccgctttttgtgtgcgcttattaatctagcaatgtgcaaaaatctcattggtattggcaatggtactatcccctgtcaagttgacacttataaaaacgaaaacacaatttttctagcccagccatttaggcttgaggccgcttatgctccggtttctaaccgggcctgttcacgctctgcctgtttgcctattgtcaacgttcggattatggcgcaaaatagtctggttgaggtttttttaatgaggtaaattgatgattgttattcagcgtctgatcaaagatcgggtcctgcagatcaccgccttgttggtcgtcataagtctgttcattggccggccaaaagcaagcgacataagttttgccacattatggtcaattctcgccatgatgacggtgattcaaatcttcgagcacctacatattcttgattactgggcctatcgactgacttcccgggcgaaaaacacgcgacagttaacgtggtggtttctttttcttgcgatttttgccagcatgtttctttcaaatgacgtgaccgtcttgaccttggtgccgctctatctgcgggttgccaagaagtatcagttacccgagattctcccggtaaccttgattggcatggccaccaactttggaagcgccttcactccgtttggcaatacccacaatatctttctgatgcaccaatttcaaattgacttgcgccagttcttcggctggtcaattccgttacttgccgttagctttttagtgttagtattgctaagccttttcttgcgtaatgtgcctgtcccgaatgtcccagctgaacacatccatattcaaatgcggccgaccatgtttgccattgccgttgcgtgtgtcgtcttcgctggggtcattggtcttgttcctgcttggttaggggctgttttggcgattgccttatccttagcactggaccctaaagatatgcgagacgttgattacgcggtggtcttaacgtttgctggctttttcattattgtcagcgtcgttggccagattccatgggtaatacacttccttgctggtttagaaaactcagaggaatctgtttatcttagtggtgttttcaccagtcaggttatttccaacgtcccgtctacagtgctgctggcacgctttacaggttatgtcgaggctttattttatggatcgaacatcggcggtgttgggacactcgttggttcaatggctaacttacttgtcttcaagcaatacatgatttatggtaaccggccacatactcgtttttttgtcggctttacaatttttaacttaattggtttgattttgttgggttgtgccggttactggttgacggttcgttaagaagcaataacctacctcaaaaaagtcagccaattcgacatgcttcgttaaaaatcaggtcatgacagtagtcaaatattacataacaccggtaatgtatgcgttttcattgcttttctccggcaacgtgctagaattaggatttgctaaaaggaacagcgacattcgaagcgaaccaccgcgacaggttatttatggacctgtcgcactttgtttgtacatcagttgagctgttctataatgcgtctgccaatgaagcaagctgtctatctgcctcctgatgtgatgatcaaattttaatcatcacatcaggaggtgttggcaccttgtccgctaaagatattggttgacgctcgctcttaggaggaagtatttatgaagcgcaggacgttgttttcgatcatcgtcatcacgctgaccgcaggattttttaccttattttacggtatgcatagtacttggacagatacccggtcagcgcaggccgttcaagccgctaccgaccaagtcaatgatttgttcaaggatcaatcgcatcaattaccttcagaccagctaaataagcaggctatagcagctgccgagaccaaattacaacaggctcgtcagaaggccaatgatgcagaccacgctgccgcacttgccagcgcacaagccgatgttgatgccgctaaacatatgctgattgttaaagatgctgtcactcaaaattcaacaaaactggatgagctaaaaacgttgtcagatgagtcgcagcaagcattaaccgagcttgccaaacagaaaccgacatttgtccaaacctatcaggaacgggtggcacaactgtctgatcaagaagcggctgtcgcgaaaatcgccagtctttttagtgataccgattttaaaacgcctaaaccaaatctgaattcggcgcaagtacaggccgcattaactgctgttgaagatttggacaataaacaattcgccgcccaagtcatgccgctgatcagtactgctcaaaatgccacttccagcgatgacagtcgtggccccgaaccgtcagcatcatcagcgctgcctagttcggccgacagcagcccgtcaaccgttgccagcagcagtgatcaagccagttcagcaaatgctagcggcagtgaatcggagcaaagtcaggcatctagctcaacctcgacagcaacttcttcatctagccagaatccgtgattttttggatcactaaccgataatcaggcaagcgttgcctgtcaaaaaaatgacgataccgcacacatgcaaacttgtgcggatcgtcattttttattggcctccgctaaaagtcagtgccaattaatttgctgttttcgtcttggccaattgcggcactaactgggtcaaatagtcgataaagctcaagtaatcagcaatgaccacattttcgttgggaccatgggcggcagaatgggcattgccaatgccgcatgaaataatcggtgcgtgattgatatcataaaagtacttcatcggtccgctgcctggagagttcagctcaacttgaacatcatcatccccataagtcgtacgcgccagttgcaaagccgtctgaacacgtggatcgtcaggatcggttctaaatggcggctcgcctaggaagtcagacaccatcacatcgtcataaccgccagccgtcaacgcttctttgactagccggacggtctctgccggtgtctgatctggcaccaagcgcagatcaagcttcgccagcgcggtgtgcggcaaaatggtcttgccaatgccgggaccctcatagccgctggataacccgttgatggtcatacttggccgattataaagggccgccttaatgtcatcggctggcaccgttgccgggcgggtaatgccgtagttcttagcaaacgctgtatagtcaaaggcggcgtcttgaattaacagcttttgagtagctgtcagcggcttgacgacatcaagaaaatgcggaatcgtaatctcatcctttgcatttttcaatgttgctagagcctgaaccaaccgccatgccggattttctgtgatcgcccctaaactggaatgaagatcaaaatctgccgttttaacgctcaactgaaacgcgacgccacctttcacacccagcgagatttgaaacttgccttgctcatttcgaccgccagattcccataggcagaagtcagcagctaacagatcagcatattgcgctaacaggtagtctagattcggactgccttgttcttctgccccttcaaccaagaacttaatggtacaaggaagactgccttgcgcttgcaggcgctgaagtgctgccaagcgtgccgccagttcacctttatcgtcatttatcccccgagcgtacagatgggtgtcggtcattttcaactgaaagggatcactttgccataaggctagtggttcagctggttgaacatcgtaatgattgtagaacaagattgtgggggcatctgctgtctgcgccggaaaaaccgcgtacacagctgggttggtgcggtctgtgtgcaagatgcggcttgttgttgcgcccagcttggtaaactgggttcgtagaaattcggcggtttctggaatttcattttcctctgctaaagagacggaatgaaactgtaaatacttcgttagaaaatcctgcatgggtattgtcatttttcgacctgctttcttttgtcactatttgaagtaagcgtgccggtattccgccggttgtaacatgctgtagtgaagcccgccaaccttagtattgatcagccgactattagcactttggaaaacgggaatgtatcccgcaacatcaataacccgcgcattagcggccaattcttcctgataacgtgccttcgcgctttggccattggtgttatttactttagccatcaaggcagtgaactggctatcactgaacttggaaaagtttgaaatattagtggctgtggcggtattgagatagtcggatgggtcttgaatcgttgagttccagctcatcagtacggcatcaaacttaccatcaagtgagcgttgaattcgggtcatttttggcaagctgctgacggtaacttttaactgcggtagaaccttggtgagctgactttggatgtactcgccgacttgtttatcggtgtcaacatctgaggtcagaatcgcaaacctgatgctgtcggtatgcaattctttcaaggccgctttgagataagccttggctttagttggtgaataagtcagtggtgtgtcagcatctgcggtgaaatctttgccagttgatggattcgtggctaagccttgcggaacaaaggctttagcaggcttggagccgtcctgcaacactttagttgtcatggcttgacgatctaacgccgcagagacagctcgccgcaaattaacattgttgagctgtgggttcttggtattgaattgcagataattcatgttggccgccactgttttggtcaacgcaggatttttggcttctttttggattaagttgcccgacaacggtgcatcatcgagcttgcccgttgcaaaaaggttatcgatcgtgctggaatccttcaaaaccgtcacatgaactttagcgattttgacagcctttttggcaaaatattcgggatctttcacatagtcccagctatcactcgtggtattaaagtttttaattttatatgcgccattggtcacgattttatccgcgctcgttccgaattgcttgccataccgtttcacagcggcttcattagtcggataatagccagtcatctgactagcaaaatagggggttggctggctgagctgaattttgagtacatatttgcttggtgccgaaacacctaatgtatcaggggatttcttgccagcaacaatgtcctgatagttagcaatcgcatcgtattgatatgcaaattcggttttcgtcttaggatcaacgatgcgcttcaaggagtaaacaaaatctttggctgttaccggggtaccatcactccacttcacatctttgcgcagcgtcaacgtatatgttttcccgccatcagttggtttgacaacctttgtcgccatcgccggaatgatcttcccgtccttatcatggtcgtaaagcggcgtcataatttgttccaaaataccgccgctggttgcatcaacggcatgcgccggatcaagtgaactggcctctgtgctgacggcaacgtttagcgtacgctgggtcgttgcagccttggtttgctgtccgcatgcagcaagtagtgcggtgatcccgaataagcctaaacccaagaaaacatgctttttcatttttgtgcacctcgtttggttgatttgtgtcgcgtgctgccatcaagcatgttttgcttgatggactagcttccataacgcgctcgccagcccagaaaccgggctgactcgcgctcacaaaaaaagccgtccataacaaacatcttgttaaggacggtttcccgcggtgccaccttagtttgatcaaagagactgcgcctgtgtgatggtagcatctggcagtgtttgatcacgcttagcccgaggccaacaccccggcgacaactgacgtatgtcaacacgtttccccgtactcgaaaaactttcgggggaaccctcagtggtccatttactgacctgcgttcggccggactcgcagcatcgccggctctctgtacgtgcacaatcagcttgatctccacttcaaaggtttgcatgaacggttatttgattgactcaaacactaaccgaatacctgcatggttgtcaagcatccaccaattaaataacgggaaacgcttcgcgaggcttataaaataacggcttttcatttcctcaaaaagtgtagtcatgctgatccagcaaattttggcatcaagagcattcagttcggattatcaggaaaaaactaaacagcatgaaaaaaggtgcaagttcattctcatttttgaatgaacttgcacctttttagtaaaccccttatattacaaatacattaatgtgtaacaaaaagaagttgtttcgtgacctgtttgcaatggtcttgttaagtccggcccgtatcattaggatattggaggtgccatcaatgaagcgaaaacatattttccaaatcttgatcgtaaccctgcttgcaggttacttaaccgttttttacgggatgcggaatacgatcgatacctcatttgaacaacacgccgtccaagcggcaacgcaacaaatcagccaactatactcgtcatccaagcgaactttccctgcgaaacacttatcacgatccatggtgaccgcagctcaggccaaggtcaaccaattagttcataacgtggaaaatcgcgatcaaaagaaaattgtcgccaaggacaaacgggatgctgacgctgccagtaacatgctaacgattcaagaggcaattaacgcccagagtagtaatctggcgcagatcgaatcggaaggtacccgagccagtgcagcctataaggccattgtcgcaatcaaaccggcatttgcagctgactatcagcaagctgtcacacaactttacaagaaatctttagcgattgcgcagatcaaaaaactttataacgaccagaatttacagcacccaaaggccgatctgagcagcagtaacattgacctagccatcaacgccattgaaaatgtcgaaaatcaggactttgccaaaaacgtgttgccattggtccaagtagcgaagaaatcacaagctaacaatgatacgaccgtggcaatggaatcgacagacacatcttcaaccaagcaaaccgcaactactggtcggcaaaatcagcaagacactggtgaaccagctaacggcgtgtctgggaatcacgcgacaactgcaggtcaagcttctgatcaaacaagtcaaccgagccagaaagctccgagtcaaccgactacttcaccgagtgggacaagttcaagcaccgacaataatgctggtgcaagtgcttcctcgtcaatatcagcatcagccaacaaagcagagcccatgacggccgttttgagcggcggtttgtataaaacctatgacgatgcagttgcatccatcaaaatccaaggcaaagccgttgatgacatgacgatcaggtctgtcacaatgagcgacggttcctttcagtggacttggggaccaaacggcgacagtggtagcagtagttcaaaaccaagttcctctgcgccatcttcttccaatcccacagggcaagatgcaaacaaaaacagtaaaccgcagcattagacctttgctactttcaaaaatcgctgataatggcctcttcacccaccatcatcggcgtttcgctacgttatcatatgattcaaacaacgtttaagtctcacaaaagacccgcatcagttcgacagctacgtcgaattgatgcgggtctttgggttttctactagttgatctgctgaatctgttcacgttcagcagttgcccggacaggatccacaagtgcctgccgatgcaagccattgcgcgctcgcagagcatagagaatcgtcacggtatcgacaacttcttgcagcattgcgccaataattgttggaatgacaccgaagctggcgattaacatcaaacctgtacaaatcgcaatgccgatgaggaccgcttgcttggcaatgaccatggtttccttagcaattaaagtggccgcagcaactttcgccaaatcgtcgcgcagaaccacggcatcagccgattcgcttgccgcggttgccccatgtgcacccattgcaatgccgacatcagcaatcgccaatgaaggtgcatcattgacaccatcaccaaccatcacaactggccggccatccttagggacgttatccaaaacttcaatcttctgttgtggcaattgttccgcatagacttggtcaatgccgacctgtgccgccactttatcagcgattgactgctgatcgccagaaatcataatcagcttagcatcatttaattcgtgcagtttcgtcatcgtttcttttgcttctggacgaatctgatcggaaaatgtgatcgcacctgcgtactggccatcaacattcacatacacggcagtcgtatcaaccgtagccttcgtcccagcaaactcggctttaccgaccttgactttgcggccatccaccgtggcattaacgccaaagctagttgtttccgacacatctgtcgctggcagccgatcagctgtcggcacagcatctgtcagtgaacgcgccaaaatatgagtcgattgaccttccgcacttgcggctagcttcaaaagctgatcctgtgagaaaccggcttgtggcaaaatcgtcgcaacttttaaaataccgcgtgtcacggtgccggttttatcaaaggcaaaggttttagcatcacttaacttttctagcgtagtccctgacttgacaatgatcccgttgcggctattacgactcatgccggagaccatcgcaattggcgcggccagaatcagcggacaaggcgaggccacaaccaatacctgtgcaaaacgaactgggtcgccagagaagaaccagccaagacccgcaatcacataagcaatcaacgtaaacggtaccgcataacgatcagccatccgaacaaaatgtgctggtcgcgcttcggattccttaaccagtttaataatcccttgatactgactatcttcagcccgttgcgtgaccttaacagttagggcagcgtcaccattgacggtcccagacataatgtcactacctgcgtttttggcaaccggtttagattcacccgtcaaactggcttcatccaccaaactctcacctgccaaaaccgtaccatcaactggcacgacttcctgcggcttaaccaaaatcgtttcgccaacttggacggcctcaacttcaacatcttcaacgtgtccatcaaccatacgatgcgcggttgtcggtgcattttcgagtaattgctttaattcactgcttgcttttgttgctgcgtagctttcaagcgcatcgccaccagtcagcatcaataacacgatcatcgcagcccaatactggccaaccgccaaggtggcaacaaccgccgtaatggcaagcaagtcaacaccgaagttaccagaacgaattgtcttcaccatgccccagaacataattaaagcaatgattgaccccatcaccgtgatcagcccttgcgcgatcaatggttgctttaaaccgaaagcaaagactagcgcaatggcacttacagcaagcaccatcattaattgccagttctttttcatcactgccactccctttttctaagtacgccaattataaccattacaatctgaaagcacaacctattttagaacgaatataatctgtcccacttagatgctcgacattcatggtttctattaattgagccatggctaaactcttctaccgaaaattaactcaagtgtccatcatccccaaccagaatcataaaccggcaatgattgaccccgttaattttatggcttccctaatattcacttcatattatacgcttctcatatgataagggtcacataacttgcttttttaacaaaataaaagaccgcaccattaaaatcggtacggtctctcgtatataaatgaagctaggcaaataattcgtagatcaatcaatgttgatctgatgattgcccttttggtcgcttgtcatttttggcagaacgatcgtcaggacaccatcattgaccttggcgctgatctgaccttcattgacatttggcagccaataactacgactcatgcggccatagctacgttctgacattaacatgttaccgtcgttgtcagcatgatcagcctgctcctcatgtttaacggcaatgctgagcacatcacgatcgtaactcagactgatattttgcttctcaatgccaggcacatcaactttcacaacatatgcctgatcgttttcctgaatatcagtctttagaacccgactgcgatcaacatttgttggtgtcaagctgtcaaaaagatgacgacccaaatcgttaaagaaaggatcgctcagccaatcattacgacgcatcaaatcattagccatattcgaatacttcctttcatgtcttccctacaacacctttagtataccacaaaaattttaactcgcaaacgtcgagtcctaattttgtggtcctattcaatgactggttgatgcaaaaagtgacttaatagcccagagctaccttagcaaattttgccgcccagttttgtcatgtcatcccgacgttgtgcatcattttgtggtaaggcagcgtccttattcaaggtcacagccccatcaagaatgccgctgtcatcacgcagagccaacgatgcgtttttgaaatcaagtgtcagaccactgccgaaataatccgtttctgggtcacccgttgtcagtttgaaaccagcttcgttgtccagtggcagcgcataatcttgatcatcctcatcggcaaccactaactgatatttatttccaatggcacaagaaccgccaagtttggaatatttgcttgagccgtcatccagtgccaagaataaccgttgatcctgattgacatgatccttcaagtaagtgactgctgctggtttgattgagatttgcatccgaaccatcctctctattgagttgtgaacaaccttttaccttctttatcgtactcacatttccaaatgaagtcaaattccgagtttttcgcaacgaccaacaggttatccacacgtcttatccacatgttcataacttcatacgccaaatatagtattaagtattcgaattgacaccaaataggcgatttaaaaaattcaagcaaaaaatttttaaaaagaagtcatccacagtttttgatcgttcgatttcacaaacttcagctcacgcatcccgttccagccgctgggaacaaacgttttgtcacaagttaaaaaagtttatccacaggttatccccaagtcagtgaataacttagtcacaccccagaatattagttatgaacagtatccacagagttatccacaggtaaagcatcaactttaggtaaaagttacccactcttgacaaatctttttcttgaacttttccacaggttggccccttgaattttcggataaaagctaaaaactgcagagaaaccgcttgccactaacttcgcaagtgcatcaaaaaatcctcgagccagaaacgaacattttctgactcaaggattatctatttgtgtgatttagttcttaaggtcgcttgtcgtttgcgacagcttcacagagactgtctgctgttctccggcacgatacaaagttaatttaatcgtgtcgccaaccttgtgcttgtatagctgtgtatgcaaggctgctgtgtttgaggtgcttaccccatcaagggccgtgatcacatcatactgcttcaaaccagcagatttagcactgctgccgctggtaaagccagcaaccacaacaccatccgtcacactagcaggcaacttcagaaccgatttctgctgtgttgcagaaacagtggataagtcacgaacttcgatgccaagcgctggtcgaaccactttcccgttagcaacgagttgattgatgattgaaacgacttcatcacttggaattgcgaagcccatgccttcaatggtggcattactgccagagttgccggataatttcatagagttaataccgacgacttgccctgaaagattaatcagcggaccaccggaattcccaggattaatcgctgcatccgtttgaataaccgttgcctggcctgttgtgttaccactgtcatcagtgacatccactgtccgactctttgcgctgacaatccctttcgtcacacttgtcgcgtattgggaaccgagcggagaaccaatcgctaagacagtttgaccggtagcaatcttgctagaatctccgaagctggctactgtattgaccttgctaccatcaattgtcagcactgccaagtcagacgtcgagtccgtgccaacaagactggccgttagtttcgtaccatcgctcaaaatgacttccaacttatctgaaccactaacaacatggttattcgtcacgatataagctttgccatctttcttttgataaatgacacccgatccttcactggcctcttgaagactggacgaactgctctgcgaactactactgctttgactgtcttgtccaaaaataccttcgagaccgccaaatgtgtctagaccatcactgttgctctcggctttttgcatattcacaacggaaacgacagcgcctttaaccttcgcaaaggcttgttccgatgcactgttttcattaacagaaacgttggaaatcttggtcgtaccggctttccctgacgtatcggttacaccgagactttgactgtggttgattgccaaataggcagtcccgccgccaacaccgccacctatcaaggctgccacaacagcaacaatcgcaatctgcctccagccactattcttaggcttttttggtgcccgctgtggctgttgctcgttttgtggtgtctcttgaaagttatgacttccattatccataacggaattcctcctttaaacgcgctcgtttgcccagaaactgactcataagacctagccgtttggctgaggccgctgatacattggtttttacctggactagttcgcgctctatgggcagttctaactcgccctgattacatttataattgtaccccagtttacaattcaagtgcaacaccctgacgactagaccataaaggccatcaccgccgtctaaaccatcaacaccttctagctcggtgacaccgccgtctaaaccgtcgtcaccttctagctcagtgacgccgccgtctaaaccgtcgtcttcatctagcgagccttcaaagccggctgcttcatcaacccctagccatcaggaaagctcatcttccgtatctagcagtgatgtgatcccttcatcctcttcagaaagtgattcttccgcaaacgtagaagttgtcacgccaagccacaacaacacccatcatctacctgacacaggtgagcgtgttttaggctggctagccattgcaataggaattcttttatcaattactggtatccttctattgattaaagattatcaataagcgcgtttcaaaaactgcagcatgacgatgaaatgaagccatcgcctgctgcagttttttgctgctttaaattttgcttgcgtgtacgccatgaatacgctacgcttacaaccgtaaccattacgctttccaacaaaggagcttttgcccatgttcaaacgattattgaccgccttcagcgtcatgttgttggcaatccttgctgtcgcttgcagcaccagcgccaaatctggcagcaaccaaaagattcaagttgtggctaccgtcgatttttacggtgaagtagctaaagcagtcggctgcgatcaggtgagtgtccaatctatcatcgacaatcccgccattgatccccatgactacgaacccaccactaaagtcggtaaacaagtggccaccgccaacctcatcgttgccagtggtatcggctatgatggctggatggacaaactcgtgaaatccgaaagcaagtccaaacaatacttacgtgtggccgatgacctcatgggcaaacacgaaggcgataacgaacatatttggtatgacccacgcaccatgcctaaacttgccaatgccttggcagacaagtttgccaaacaggacccatccaaaaaggccatcttcaaagccaacgccaagaagtacattgcctcactcgataacctcaatgctttgattcagaaactcaagcaaaacgttcatgatcaaaaagtcgacgtctccgaacctgtcttcggctatgcgctggactatttaggctacaaggttaacaacacccacttcgcccaagctaccgaagaaggcaccgattacagtgccaaagacatcaacggtgttcaagacgatattaaagaaaagaaaatcgccttcttcgtgaacaacagccaagccagctcgaaaatcgtcgacggtctcgtcaaattagctaagcaacacgatgtccctgtgctcaacgtctccgaaaccctgacaaagggcaaaaattatcgcacttggatgaccagtcaataccaacagttagaaaaaatccaagcaaaggcctacaaaacaaactagtctctctgtcctaccccccaaaaaccacttcgtcttcaaaaatcgcaacttgcatcaacggatacctctctaaaagaaggtaaaaaatgcatggcctgctgttcattttgtgacaattgacatcttttcgtaaaatttttgcaatgaattcgttttcaaaagccctataccaattgaagttttgcttggcgactcttacaatgtagttgtaaacaggaacaactaataggggagatgttttaaatgtcactgatcaagcatacttttaaacgcgttgagcacatgatcgcagcaccacgcgatccccacgaagaagaacaagcccgtcttcaagaaaacctgttctatacgaacctcagtagtctgcaaccaaaaacgaacgctaagttttgattgaatagatatgaagtgaatgaccgcctcaacggcatgttgagacggttttttaatgcctgaaattgtcttgactgaattcagagttttgctaaatcaaattgattttaaataaagagttcgctacctgtttcggtgtttgagagacttaagactgacgatatcgtgttgcattcacaaagatacctagaccataaatgatagcagccacatatggaagtgctttgataacgccaatcagattttgaatatcgctgtaactcattcctgaactatatgccgcctctgccgctctcagtgatgacgaaactggattagcgtacacataactggcagcgatggccgccccaacgcaaattgcaatacctagaaacttgagcacaccaccgccttgcaactgccgccggatgtctttgataatgccacccaacgtcatggcagcacctattcccaagagacaaacaccccaaatatataaacagccactcgtactcagtgagccactctgaaaaagtgacatagcttgagaactcaacgatccaacactttgcttacccatttgatacatgaagaaaccagcaatcagcgcaatgatgccagttatcaactcgccattcagccgaaaaccagatacagctgaagaagaccgtggtaaaggctcatttgcttgagatgacttaacctgcgtctttggttcaagctgtgtcttctgattaactgtcggcatagcatgatgtaattgattcaaccccttgttgatgctagcattcaattgcttgagattgtccttatcctgtagccaatcatccaattttttgtcccacgctactcgttttttcccagttaacaacggataacaatagacaaatagtaaataaatcatgagtagaccaaaacgccaagtaccgttaagcggtaaaaatgtccccagcataaataaaacgaaaagtgtcagcgcattattttttaagaaagttaatgctgtaatgaaatgtttgcggctcggtacaagtttggtcaattgtccagcggtagctgctgcatgggcttctatcgttgctgaaccagtcttattgttacctgttaagtcaaacccacattttggacaaaatttttccgtgccgtccaactttaagccacaattaggacaaaactttgctgatgtcatcctatcaatccccctatgatgttactgccgatagtgctactgactgcgtgatcaagctgtttgttgctgcgatgaaaattttacgaatgcaaagatttttcatacaaatcattgataggtgcgcctaaattccaagttgttttgatgggtgttactgttggtttcgcataaagaccaacatcagtacctgctaattgcgagtaatcagtgtttcgaaagcgccagatatataaccaccctttctcaggagtttctgatcgagcagaacctttccctgtaaaatcacaagactccggcgcagcattttgcttcaattgtgtatcatcctcataactaacattcaaattagcaatacattttgtcaaagaaatatgaccgtcctcgcccataaggtaatcatctgtttgactctgaatattggcattgttgttggagttattaatgagttgttgtgtcagtgtgtgatcatcattaaattgcacagcataggtcacatccccatcagttgctgtataagtttttccgacatagctcggtgtcggcgagcttgatgaactagtagccgtgctagatgcgacactcggttcggaagagaccgctgaccgacgactgcttatgctgacacttgacgactacttgagctcaccgattgattctgccgctcccctaacttaaagacaagaaggccgataacggcgattaaaatcactacaagactgcccaataaaatgacagcaccatgatgttgacgacttctcatatcattcacactccaagttgaatttctagtctaaaaaagtagccatctcgtaaatccactgacacacaagatgactacttcaagttacattgttattgtcgtaacgcttatttggcttgttttagctttcctttatgatgttgatgcaattgttggcggacaaaccacctccttgctaagccgttggaataagggatttctttggtttaatcattgaagtcttaagcctaaaaggccgagtttgcaatgccaagccaaacctttccaagtaaccctgaatattttttgacaagcaaactacagactgaggccattcccaattttcaatgttgccattagtacaacgtaatccccacgatcatgttagttactaatggtcacaactgttgcttacttgtccactgagcaatcaatctcatttgaaaacttgcatctgctttaccgaaaaaactaatacaattttttgttcatgattgcttctatcatccgactgtgtctaccctcatcactactcaccttatttgattcctaaatccttttttacctagctcattttcattcattcccgtcaacccattgccaccgagcattatgctgtcacaatagatagaaccgaaaatccaagacaatagcaatcccgatgaaagctacgatctaattgttaaactttcacgtttcaaactctttttcgacaagtcaccccacgtgacttgtcgaaaaactcttacttgcaaggtgagtcataacctctgcagttcgatgttgcgcctgaatcatgagaatgttactttgcatggcgatactttctgatgcctgcaaagccaagaactgcaatgactgctgcgccagcctctgccaaaatggcccctgtctggctctcaccagtcgctggataagcatgtttaccgttcttctgagccacacgactcatcggctgaccgctggaaggctgctttgccgcgattggtgtgactgttgcactggatgctgctcgtttagctgcgcttgaggctgccgaactcgcagcactggatgccgctgaactgcctgcgctggatgctgcggaactgcctgcactcgacgctgaggaacttgcggcactggatgctgccgaactgcctgcatttgaagctgaggagcttgcggcactggatgctgctgagcttgctgcacttgatgccgccgaactgccagcactcgacgctgaggaacttgtagcactcgacgatgctgaactaccggcactcgacgctgaggagcttgctgcacttgacgaggccgagctgcctgcgctggatgctgaagaactactgccacttgatggctttgttggttcaggacctggatccagttgagcaacttgtgccgttagagttttaataagatcctgaacggcagcatcttgctgggcattgtacgcacgaatctttttaggaagatcaatcaatgcggaatcatctgcggcgattttgttgtaaagggcctgttgtgcatcaacataggcagaatatgctgattgataatcaatgttttgttgggcctttaaatcggcaatgctggttttaacggccgcaatcttctgattgatctcgtaattgttatctgttgaggtgctttcctgcacaggaacagttgcaatattcgtaccagaaaatttttcagttacgccgttgaaattgagcacccagtcaccactagctatcttttgataagcccaaccacctgttgctgttgatatactttcacttaatagaatgcgacgatggccttgcttactgtcagcatcaaagttaaaaagatcattgatagattctgcaacagactgcaaaacatctatcattgttgggtcacctttgcgatcacccatgagccagtttggatcatttgacgccaaacactcactccagccaccatgtccgccaaagatgctttcaataattccgccatcatgatgcatttctgtatcattcagcatcgaattacctcgctgctgtactaatgttaagaaatcagcagtcgaaacgagcggacttaatccaagtgcttctcggtaattatttgttagcatcattgcgtactgatttacttcgtactgttgagctgtgctaagtttttgatttttgacaagatctgttagcgcccattgtggtgtgttctcatcgtcattaattgtataaagttttgaattgtcataatacttatccactgaatcatcgtcaagattgccataatcgttgacctgtttatcgctcaataccggcaaattctgaacaagatagtttccattccaatttttactgtttcgatcggtacgagtgctaatattgttccaagcaccatgcttagcaacataatcaaaagtgcccccatccccaacttgcacggttgtcgaggttcgttgagagttcaattctgctattgtttcatctgcagcttgactggcggcagtatagctgcttgcctgtgagctttgcatagccgccatgctcgccgaaccacttgctttcagttgttcaaatgctgatacatccttattcttttgttcctcagcttgttgggtcatttgatcagcgtatgaactttttgctgcctcagcttgagccttagctgcagcttcgctttgcgctgcggctgacttagcttgctcgtacttagccttttgagcctgccactgttcttcagtcatgcttgatggtgccgctgcaggcatgctggtatttgcattagccgcaagactagctgcttgataagcggctgacgctcgtgcacccgaatcggctacttgagtcgtctgatttgcagcggctgcttgttttgcagatccggtttgtgtagttgttactgcatctggcttagccgttgttgcctcttcttggttatttgaagtcggttgtgcaacttgtgccgtttgcgcagaagctgctgagctactctgcgtgctagaagcagtcacagtgccatttggctgtttcgttagtgtcacaggagaaacagttagtgttgccgcatcaactgtttgcgcgggaaagttaagtgcagcgccaccaaacaaaagtacgaaggccgaggcaacgacccattgactgcctcgtttatacattttcttcctatcattgactacatgttctgtaaatcggttatataacatgtcttctcctccaataacatcaaattatgcccgatggaactaggtacaaaatttattatatttagtgattaggtatattgtgcctaggagagtctcaactgtatgttttcatagaatttgaatatgagccaactgacatttcggccagaaaaatagcgactttcatacccccttgactatataggaaatatgaagccgcattttgttgactaaaattttctacgcagaatttgcctgctgggcatatcctgcctatcgaattttttatacttagaacagtttaaaagttgggcgagtatttttttcaggtgcgcccgtttctaaggagaaggtaaatgtcaggcaaaattgtcggtaccatcgcattcatacttgtttttttaattttgtgggccatcatatccgtgataatgagtcgtcaaaaacctgagtctcaatcttccgcagacctattttgtccaaactgcggcgcaaaagtattaccagatgcgaagttttgtaccgtctgtggagccaagctgaatttggttccaaaaattgttaagaagaaacaccccgcttacatagcttttgcaatcacttccggaatgagtattttgttactactcggcatggcaggattctccgccttgtctccgacatctcaccaagcttcgaaacaatctcagataaccgatccaaatcaattgtcatttgaaaccctgagtcgaaaagatcaattgcgggagttagttttatatggatacgggaatagtaaaacatttcagaaattacatacttcaatcatgtatagcgctcctcgtctagatctttcagttgttgctgttagtcatacctcatatagtgtcatgccttacggaactggatctggtggttcaccagaaatccaaattgttcaggtgccaactaaagataaaaagggaaagaaaaccattgtctactttggaatggccggtcccggtgcatttaccccagatgctggatcgcctgtaaacgttagtgacgttgataactattgcaatgcccaaggtggtgttaaagctttaaaaacaatcaaattcaaatattacaaagggacaccgacaaaccaaaattaattcaacaacaagcttgaaataagcgtcctcgaatttaaaagcaaaaaatacagagaactcggcttaatttttttgttcagattttcgtttcaatattatgtgcaacttgattttttacattacagtcacagattgacattaagatattgtttaggggagttgggaaaatggatagctcaaataggaactttattttctgtccacattgcggtgaaaagaacttgattggagctaagttctgtactcactgtggacattcgcttgtaaatataaagaccggcacttcttttaaaagcaacacagcggcaaagaactctaaagaaagaaattcaaatactgcaacaaacaatcgcttagaaatgaaatcagctgccaatccgaatcgactgcgtaaagtgcgctggaagccattactcataacagccataggggtcgtggctgttacgtacaatagccttaaaagttgtcactttaagaaataaaaagtgatgacttttcctagaccactatcaagaattcgttatcatcgttgcacttgacttgaaaattgagtaattgcaaaaagacaactcagataaagctaaaagtttgccagataaaaaatccggcctcttttttgacagaaatgtacaaaatcgttcaatcaaattagttcacaaagaccctgttccccccaaaccaaagatgccggattcggcatcttctaagaataaggattgattccgataatataaattttcaattgtcggtcgaagtcgatgatttgttcactgttttttggagactcatcatattttttctgtgccaatttcacggtccaatcctgtccatatgtcatcaacccgatttgttgagttgggtcgtcgcttccaggtaggcgattggcataaccactagagataagcttgtcgttaaagtcgaaaataatgacaagcttttcctcactatattctttattttttaatgcctcaacgagcggcgaccctggcaatacggtggcaacgtgaaattgttcttgtatccatatcaggcatgaatttcctagcttaattaagaaatagtaagtgaaggctaatggaacagacaaaatcagcgtaactacgaaaagaccaaattcactccagaagctgtgaccaactgttccccagatttgctggtaaattgcgaggccaccagcagcattcagcatagatatcagaatcaaagcgatagtacgatctgcctgtcttgctggcaaatcgaaatgaatagcatctagcttatcgagccatatgaaagtcaagaacccagggatacccgctaagattagttgttgcatttccatgatttatactcacccaatttctttttgcatgaatttcattcacttaattatatcacaaaaagccacacagattgtagggggtaaaacctatgaaaccaattacagtaatctcttataagtttggcgaaaaaagctggaaaaattttgaaggagaaccgatcaaaaaatatgagcactcagttctcctagacatttcaaacaccgaagtcttcagcgataaagaaaaaacagaactaaactacaagatcgttgtccccttttctagaattagagaaaaacgattcatcaaagatattccactcagtaacgtaaacgaggcaattaacaagaaaaaagcaggcaggaaatagcgcaaaaagcgcctaccccaccgaatgggtagacgctaaaaagagcgtgactgtatggtgggtgcaatagcacccgtctgtattatagcacaaggaggtgtaaatgatggccagtattagtaaacgtggcaaaaaatggcaatatcgtgtctcttacaaggataatgatggaacacgcaagtatgtcaacaagggtggcttcccctcaaaaaaggctgctgatatagcggcaaccgaagtcgaacgtcagcataatcgcggtgcaaatttggatcttaacaagataacgttaatcgactactgggacaaatggattgagctgtacaaatctggtaagcattctcgtatcaccgaagctcggtacaaaacaattcgtaaacagttattagcctattggggcgaaagccgtgaactaaaatcaatttcaaaatcagactggcaggcatttatcaatgagtttggcaaaaaaagggctaaagatacagtcagcaaattgaatggctatgttcgctcaatggctgattctgccgtcgatgaccaaataatatatactaacttcactcataacgttgtcctcactggtaatgagggccaagcaggaatcatcaaatatttgcaagtaaaggatttgcgcaagctcgtcaattactgcctagaattttcagactacgagcatattgcttactacatcatcgcaaccggggcactgaccggagctaggtattctgaagttcttgggctcacgtgggatcatgttgatcttaaaaagcgcgttgtgcacattaccagaacgtgggatcacagatatggcagcggctttgctgctactaagaacaaatcaagtgtacgtgacatcgacatcacgagagaacttgcagacttgcttttgcgtctcaagaaagaacagcaagaggtctaccttgctcagggatatcgtgatagcaaacaactattatttcgtagcatacggcataacatgctatcgagcacggcaattaataaggatctaaggacgatcgagaagactctcgacatttcccccgcgattactttccatgggcttagacacactcacgtttcctatttgattgccaatcacgttgacattaactatatttcaagaagacttgggcatgccaatacaatgatcactcaaaaagtctacgctcatcttcttgaagatcaaagaaaagagcaggtataccagacactacaagcactttcgagactttagcttgtgcacattttgtgcaccgaaggaaaaaaacaaccgaaaataaaaggaaacaaaaatcccggaatgcctttataccagcattccgggaagctatagaaagcatctagaagcataaaaacggagagtaagggattcgaacccttgatacaggtaaaacccgtatacatggtttccaaccatgctccttcagcctctcggacaactctccataaaaaactccggttgtcaggctcgaactgacgacaacctgattaacagtcaggtgctctaccaaaagtcatcactttttatttcttaaagtgacaacttttaaggctattgtacgtcttagaaatccaatcatggttaagccgttgcctaaaatcatatttctagatatatacgctcccgttcaccagcccagaaacatacgtgtaaggatcttgaaaaaacggtcatcacgcccaaggccgcttacactccggtttctaagcgcgactgctcacgctctgatataaaaatatgacgaatcgtggctgattgtgttacactctttctgttaacaaaaagtaagtaaaaggggattgatcatttatggcaactttgacacaagatatgaaagacatgatcggcgcacaattgaactatttggctactgccgatgaaaatggtaatccacaagtgggtcccaaaggcacgatgcgtgtcttcgatgatcatcacctgatttacaatgaagagacaggtaagcaggcatggcataatttgcagtattctaagaaggctgcggttgcgacggttgattacaaggcactcaagggttttcgttttgaagggaccgttgaattccatcatgatgacaagatctttgaagatgctcaggcattcgcgacggcacatcatctgccagcagccatcagtgccgttttgattaatgttgatcgtatctataaactggatgccggtcctaatgctggcgatttgattgaaggttgatgggctgattcccggattttaacgcggaaaacgagcagctcatgatgccatgatttttaattaaacaatttatatgcctataactttgcaaatatgcatggttataggcattttttgtatacccagtaaaatactaattgttatcattagcatatttattgcttcgaataacctcgtttcgttaagcttaggatagtcagaagaaagtcaaccaaaagaaagggtgagaaccatgatgcattttatttggacactgatcatcggtgcggtgattggttgtattggacagctgatcgttgggcgcgatatgccactcggctggcttggtaacattatcggcggcttagtcggtgcatggctcggcacggcactccttggtgactgggggccttcattggccggaatggccttgatcccagctattataggggccatcatcgtcgtcttccttgtttccctgttgctgggaaccacacggcgcaaggcataggaggccgatgaccatgagacccatcacaaaaatcatgcttggcatcattgccgttggcggtttattgcaaagtgttggtttcgggttattgctttggccaagccgtgagtttacgcgattttatctgcaacaagtcgtttggctgcggccaaccatgataggcctgactgggcttgtcgctttggttttcctcatcatgctattggtcgccattttcaggcggtcaaccgctcagtcgctgattctagctggtgaagatggtgatctgacgcttgataaaagtgcgatcgaaaacaccgtggccaaagcggttgttgcgcaacattttgccaaatcggtggcggtagctgttagcattcgcaagaagcaagtcgcacgaatgcggattgaagctttttccggtaatagcaaggatctgaaggcagaggccaagcaaatcgaagaaactgctcgccagaagttgcaggcctgtctcggtattcctgtgaagcatgtgcgggtgcatctcttgccagccacaaaggtcaaagcgaaaacggcccgtgtgatttaacgatgacaacactgggacaacaagcaaatggcattcaaagcggacactttccaaagatgttgatgcctttgacgacgtgcccagctagaaggagagatgacaatgcagcgaggaatgatcggtgctgtgatcgggatcgtgcttgccttcgcctggatgcgattcgggtttatgggtatgctgctggtcttgatcttcggcgcagcaggctggctgattgagcgttacctagtacccaattggcatgcatttaccagttggttgaccgccggcaaagatgctttcagtaaaggaaagtaggtgaacggatggacgcagttgcaacaccgccagtagcagcatcaccagctgttacacgagaaacattgatggccaatagtcgattgacgtttgaagataaagtgattgaaaaaatcgctgcgctttgtgctcgagagattgatggcttgctaggaatggacggaacgataatggacaatctgaccgaaaccttttctagcggcgagaatatcaccaaaggcatctcagctgaagttggcgagaaacaagtagcgattgatatggatgtgtttctggcatttgacagtgatgcgcaagctatttttaaacaactctgcgaaaaaatcagtgctcagattacccggatgacgggcctacagctagttgaactcaatctgcatgtcaaagatgtactgactaaacgcgagtggcaaaaaaaatgatgttgaaccttcataagacaaaggagagataaacatggacaacacgaaaaacgctggcatcaataaggaattgaaattcgatgacgctgtcattgcaaaaattgtgggcatcacttgcaatgaagtcgaaggcgtatactcgcttgaaggcggcatgatggcaaatatgaccgatcttttccgcaaagatgaagatccgactaaaggtgtggatgtagacctgagcgatgatcagaatgtttctgtgtcacttgatgccaccgttcgatatggtgaaaatgcaccggaaattttcaacaaagttacgatggcaatcgtcaagaatgtccgccaaatgaccggacttaatgtcactgaggtgaagatgaccgttaaggatatgctcaccaaagacgaaattgctcgtaacgaggctaagaacaaagatgctgacaaagaaaaggatcttcagccagcataatcgtgatataaattgccagttcagtcgttgaactggctttttttgtgagcgcgaggcagcccggttagaaaccggagtgtaagcgaccttgggtgtgatggtcgggttttgaccattgcgaccaaggttcttatatgcaggtttctggggtggcgagcgcgttaaaatgagcgcgaggcagctcggttaggaaactagtgacgcacaagttatttttatagtttgcacgattgataatcccccttaacgaattgacgctgtcaacaacaacacgtaaactgctttcatagaacaaagggggatcctacatggaatacttaaaattacttggcattgtcattatcgttgtcgggtttgcattgaagtgggacacgacagcggtagtggttttggcagcagttgtgacagcagttttttcgggcatgagcatcccggctttgctgaccacacttgggcagagctttgtcgataatcgcatggtgtcgttattttttctgaccctgccgatgattgggttagtggaaagccacggtctcaaggaagttgccgtcaatggcattcagaagctaaagaaattgacacccagtcgtattttgaatatttatcttgtgattcgcgagttaggtggtgtctttggtatctcgttatctggtcaagtgcagttcgtacgaccgttgatcacgccgatggtaacggcggcggctgaaaccaaacgtaagctaacagataaagatatcgaccttattaaggcgcgttctgcggcgactgacaactttggcaatttctttgcgcagaacctgtttgttgcaacagcgggtgtcttgttgatcgcgagcacgatgaagagcctcaatcatccagttgagccgatgcaggtcgttttagcatccattccagtggcattgatcacgttggtcattgtggctatctacaatcgctggtttgatcgccaatttgaacagcagtcgcataagggaggcaaatgatcatggtcaatacccttttattgatcctttatgctctgattggcgtcgtgatggcgattgctggtattgaggcgtttcgcgcaaaagataatccggcacgtatcggaaccggtttgttttgggagatcatggcagtgatttttgcctttgggaccttgatgcccgcgatggtcgttggtgttctagttgttattatcggtattttggcgttgttcaagcagattcagataggcaaaattaagcccgttgacggcgcacacgcggcaacagcggccaaacggcttggcggttgggtattcgtcccaagcgtggtacttgcagtcgtttccatcggtgtcgcccagtttaccaaactcggtggtcaggtcggcattggcattggtgcggcggtttcgttaattgtggctatcatcatgacgaaggcgccaggcaaaatggtttataatgatacccagcggatggttcggtcagttggtgctgctggcattttgccgcaattactagcaaccttaggggcagtttttactgctgctggggtcggatcactcacggcgaaattgattgccggcttattcccaactggaagtcatcttggcggcgtgattctatactgtgtggcgatggcgctctttacgattattatggggaatgcctttgctgcgtttgccgtgattacagcagccgttggcattccttttgtcattgcgcaaggcgctaatccagcgattgtggcggctattggcatgacctctggctactgtgggaccttgctcacgccaatggcggcgaacttcaatagtttgccagtcgcgttgctcgaaatgaaggatccacttggtgttatcaaacagcaggcgccaattgcgatactattgttgatcattcaaatcggcctcatgtacttcttggcattttagaaaggaaatcttctcatgaaaattcttgttaccggatttgatccctttggcgacgataaaattaatcctgcgattgaagccgtgaaacgtttgccggatgaaattgctggggcacaaatcgttaaattggaaattccgacaaagtttaatgtttcagccgatgtcgttaaagatgctattgccaaagaaaagcctgactatgtgttgagcattggtcaggctggtggccggtttgaactcacgccggagcgagttgcgattaacttggatgacggtcggattcaagataatgccgggtatcagccacttaatcacacgattcatggcgatggcgagaatgcctactttacccagttaccgattaaggccatggccaaagccattcgggaagctggtgttccggcagcagtctccaacacagcaggcacttacgtctgcaaccacattttttatcaggtacagtatatgcgggataagatgtttcccgatattaaggccggcttcatgcatattccatttttgccggaacaggttgtcactcgtccggaaacaccagcgttgtcattggatgatgatgttttaggcatcactgccgctatcaaggccatcgtcgcccgtgacggcaaaggcgatatcgaaacgattgaaggcaagaatcactagatagttgtggatcattttttatttgaactgccgcagaccgcatgacgggtgtgcggctttttgagtgggctagaatgcttgctggccggtatttaaagaagcaaggcggtataatgaaggtgtgatctcaatagagagcgtgattagatgactatcggtattattggatcaggtaatgtcggcggggcattaggccaactgtttagtcatgttggtgagcaggtgattatttcacatcggcatggtgtggcatcattggcaccggttattgcagagatgcgctcgacgttcgaagctgggaccgttgctgacgcggctaaacaagacattgtcgtgctggccgtgccatttaatgcgttgccggaattgccgacaagcgtggatccgaagacgattattattgatgcgactaactattatcctagccgcgatggcgaccagccagcactggcagcacatcaagtcacgtcatcagaactcgttgctaaacattttggcacgaaaaaagtggtcaaggcattcaatacaattgcgatgactaaaattcgtagtcttgccaagccaagtcagccagcaggaagaattgccattccgattgccggggatgataatgccgctaagcagacggtcacgacattgatcaaacgaattgggtttgatgttgtcgatctcggcagtctatcagatagctatccagcacaggcggatggaccgttgttcttatttgctggcgatgctgatcaggttcgtgctcaagtgcaacactaaagggttaactctgggcgccaaagctatatgaaattcgtataaaaagagcattgcccgtctactgcggcaatgctcttttaattatgcaggctgacccatccgtgccttgtgatttttcacaatcatattggcgatcgccttcgcaatattttgatttttcaaaatgggaccatgggagtagctgccaatggtatttttataacgcataccttcgacaccgtcttcagggttattcccgtaaccttcaatcattttgcccaacggtttgagcttttgcttgtcgtcaaaataagtccggccactgtgattctcaaatgcggtaactgtcccgaactcggtttcgtacttggtatcaccgatcatgcgactgtctggcttgaaaactgtgtgcagcggcaaaatgccgaggcctttgatgactgatccttcgctagttttgtaataatcgccaagcagctggtaaccgccacagattgccagcatcggtttaccattttcgatataccggccaagtgtttggacatggcgcaacaagtctttggctaccacggtttgttcatagtcctgaccaccgccgaagaagataaaatcatagtcgtccgcattaaaatgatcgccaagactgacattatcgacatcgacttggtaaccttgttgatttaataaataacgtagaattttgacatcgccactgtcgccatatgtgttcatgaggtcttcataaagataagcgattttaattttatccgccattagccgggtccctccgtttgtttgactggcaacagcttaccacaagtgttggctgagaggaaagaaagtgcatagtgcggttttaattaaaaaaactcgaaacaggataagtgtttcgagttagtctggttattaacgtttgtgagccttaatccacggttgggctttttcctcaattgccttgtgaagagcatccatatccgcgtagtcactaatttcgaagacaaattcatctggttgatcgtggaaggttggcttgttgtttaacgtgatggtcaactggtcaaattgattatcgccagtatctttacgaatttgataagtgaaaaaggcagcttcatagttttgactattgtcaggttcctcgtacaaaacttccatgaattgatgttcagttcggtagttgtctttttttaacttatcccacaaagcctcatactgtttgtgcaaatcggccagctgggcatccgtcagttgttcattttctttgatttctttaccgtctaattccatttttctcgcctctgagtttagttaccatttcattatcgaactgtgaacgcgtttttgcaagatgacaagggaccgttcagacaaatcttgtggttgggtaattaggtgagtagcgcgactgcagctagcccagatagcgaatcttgatttgagcagtaaggcataacaggtgtgtcaaaaaacttgcgcttaacgcctgttctttccatataaagacggttgagcagaggcggcttttacgttacacttgacgggtacgtgaaaccctgtttgttccacaaaatcaagtttacgaaaatggaggcaggcatggatccagcagcttttgtccaagccttggctgatcacgggatcgttttaaacgatcaccaacaggatcagtttgcggcatactatcagtatctgatcagtgagaatgaaaaaatgaatctgactggcattacagctgaaggggacgtctacctcaaacacttctacgattcactaacgcttgcgttggtgctacctgagcttcagacacaagtaatgtcagtttgtgatgtgggtgctggggcaggtttcccatcaattccgttaaaaattgcgttcccgcaactcaaaatcaccatcgtggattctttacaaaagcgaattggctttctcgaacgattaacggcgcgtttggagctgacagatgttcagctctttcatgaccgcgccgaaacttttgttgccaaaaaatcgccacaccgtgccagttttgatttggtcacggctcgtgcggttgcggcattggatgtcttggctgagctctgtttgccactagtaaagccgcaaggtcgctttgtggccatgaaagccgcggcgacacccgcagaattaattgcggccaagtcagcgattggcttacttggcggcaaattggcccaagatgctgcgttgacgttgccggaaaccggcgatccacgtcatttgctggtcatcgacaaagttaaaccaacaccaaacaaatatccgcgcaagccggggataccgaataagcaacctttgggaggtgcataacgcgtgccattatcatccatttttggccataaaaagcctgacgacgaaacagttgttcaacaactgccaatgaccgcaatcgtgcctaaccaattccagccgcgcaaagtctttacgccggaatcgattcgggagctagcaacgacgatcaaggatcatggcttgttgcagccgattattgtccgtgaatataaaccggaaaagtacgaaatcatcgcgggtgagcgccgatatcgcgcgatgcaaaccctgggctgggaaaaagcgccagccattgtgcagaaaatggacgacgacgaaagtgcatccatggcactagttgaaaatttgcagcgcgaaggcttgagtgcgattgaagaaggccatgcttatgtggcacttatgaaactcaatcatctgacacaggctgctttggccgagcaactcggtaaaagtcaggcatttgtcgccaacaaaatccgcttattgaaactaagcgagccagttcaagaagctttaatgaagtcgcgtatcagtgaacggcatggtcgtgaactactgaagttagacgagaagcaacaggttgccgccttacaccagatttttgcagacgatctgaccgttaaagaaaccagtgcccttatcaatgagatgttgcggcctaagaagccaaccccaaaaccgaaacctaaagttcgacgatccgcggtgagtcatgatacgcgcattgcttggaacacattaaaacgttcggttaaaatgatccgggaaaccggtatgacggtcacagcaaaagaagaagatactgacgacgcttaccgaatgatcatcgagattccgaaagaaaagagataggaggagctcatggcacatatcatcgcagtcgctaaccaaaaaggcggcgttggcaaaaccaccaccacggtcaatctgggcgcctgtttggccaaccttggcaagaagattttgattgtggacgctgatgcacaaggcaatgcgactagtggcgtcggcgttcaaaaggcccaagttgaaaaggatatttatgatgtgctagtcaatgaagagccgattaccgaagccattctgccaacgaaacataagaacttgtcgattgtgccagccaccattcaactggctggcgctgagatcgagttaaccagccaaatggcgcgtgaaatgcgattgaagctgggattgcatcctgtggaggatcaatacgattatattttgattgattgcccgccatcgcttggccaattgtcgatcaatgcatttacagcaagcgactcgattttaatcccggtccaaagcgaatattacgctctggagggcttaagccagttactaaacacggtgcggttggttcagaaacactttaatccgagcttagcgatcgaaggggtgttgttgacaatgtatgatgcgcggaccaatctcggcgcacaagtcattgacgaggtccgcaagtattttggcgataaagtatatgcaacggtgattccgcggattacgcgattggcggaggcgccaagctatggtctgccaattgtggattttgatccaaagtcccggggatcagaggtttacgaggctttagccaaggaggtgctggctgctcatggcgaataagaataacaaaggcttaggccgtggtatcgatgcgattttcaaagattttgagagcccagatctgagtgccaataatacagttgaagaattaccgctgattgacatccgaccaaatccctaccaaccgcgtaaaacgtttgatgaggaaggcttgaatgaactgactggttcgatcaaacaaaccggcgtgttccaaccgatcattgtccgcaagagtgtttcaggctatgagattattaccggtgaacgtcgcttccgtgcgtctaaattggctggcaaggagactattccatccattgttcgggacttcaatgatcccgaaatgatggaaatcgctgtgctggaaaacttgcagcgggaagatctgacgccgctagacgaagcccaggcttatgacaccttgatcaagcgtctgaatctgacgcaagcagaagtatcggcacgacttggcaaaagccgaccttatattgcgaactacttacgtcttttgacactgccgcagcaagtcaaacaaatgttaagtgccaatcagctgtcaatgggacaagcacggacgctgttaagtctcaaagataagtccaaaatggtgagtgtggccaagaagacaatcaatgaaaacctgactgtgcgccagctagaacggttcattaatcagatgaatgctggcaacacgcgcccggcaaccaaagaaaagccaaagtcgccatacgtgcgggcaactgagaaccaacttggcgaacgctttggcaccaaggtgaatattaatgaaggcaacaaaggcaaaggcaagatcgagattgacttcacttccgaaaaagatttgaatcggatcttggccatgctcgatgtcaatattgactaactagcagagcgtgagcggcccgtttagaaaccggagtgtaagcgggcttgggcgtgattgccgggggttggccattgcgtccaaggtccttacacgcaggtttctgggccagcgaacgcgtttaatccggtccgacaagcacaacaacgctggaggtggacaaatgtatgatttacatgatctcgttcagatgaagaaaccgcatgcttgcggtaccaacaaatggaaaattatccgcttaggtgctgatatcaagatcaaatgtaccggatgcggtcatattgtgatgatgtcccggcgcgattttgaaaaacgactcaaaaaagtgttgggtcatgtagagtagacagactaaatagaaagtgtgaagtaaccaaatggctttaacagcaggtatcgtaggacttccaaacgtcggtaagtccacgctttttaacgcaatcactaaagcaggcgccgagatggcgaactatccattcgctacaattgacccgaatgtcgggatggtggaagtgccagataaacgtctggcacgaatcgatgaattgattccggccaagaagattattcatacaacttttgaattcacggatattgccggcattgttaaaggtgcttctaagggggaaggactcggcaacaagttccttgaaaacattcgtcaggtggatgcgattgttcatgttgtccgagcgttcgatgatgacaacatcaccagtgtaactggcaaagtcgacccgttagaggatatggcgacgattaatatggaattggccatcgctgatcttgatgctgtcaataaacgctatgctaaagttgaaaaagtagcgcgaacacaaaccaatgacaaagaagcgcaggctgaattcaaggtgctcaaaaagattaagcccgtactggaagatggcgggatggttcgcagcatcgactttgataaagatgagctgaagattgtcaaaggcttgttcttgctgaccagcaagccagttttgtatgtcgctaacattgctgaagaagcgatggctgatccggattcggctgattacgtcaagcaaatcaaggccgaggctgccaaagaaggtgccgaagtgattgcgatttctgccaaaactgaagaagaaattgctgaactggatgacgatgaaaaggcagactttttggcagcagaaggtgtcgacgagtctgggttggataagctgatcaaggctagctatcatttgctgggattggcaaccttcttcacagccggtggcaaagaaacccgtgcgtggacatttagacagggaatgaaagctccagaagttgctgggattattcattccgacttcgaacgcggttttattcgcgccgagacaatgtccttcaccgatttagacaagtacggatctgttcaggcggttaaagaagcaggccgttatcgatccgaaggcaaagaatatgaagtgcaggatggggacatcattgaattccggttcaatgtctaacgcataacgacttaggagataggagtttccaatggcagagaaacatgaagcagagacgaaacagacggcaaccgatgctgcagtaaatggtaaaaatactgctacgactgaacaaacagcatcaaaagtacagtcggcagccaccgatgagtcgtcagcagatcaagcaacggcggctaaaaatgcacatgtgaaacaggaaaagcctgcgaccactgtgccagagctgattgcacggctcacaaataaaaatgatgaatatattctcaaactacgccgtgagttaaaagacggcggtatgaacgcggcggacgaagaagaactactcaaaacgatgttgcccgagatcatcacagcgcaacgacaaggcaagccagccaatcagctctacggaccggttacggtaaaggcagacgaaattctgcatacgccaaaacctgagcctaaaaagccaatgtggttgatggtcattgaccaaagtctgttcttcatgtcgattttagcggttatgtatggggcacttgcctacttcgataccaagtcgcaaaatgccgccagcagcagttttgtttacttagtgatgttgagtctaatggctggtctcttcttcgtttattatgctgactggatgcagcaagataaaaagaaacgccgcagtgcttggcttgtcttgggcggcggtgttgtcttagtcgtgtcgatcacgttcattggcagtgccttggcgatgcttgacacgccgttcacgcgcccaatgccgtggttcgtcaatatcattattggcgccattgcctatgggattcactgggtcttacagcaccggtatcacctcaaaagctttttccagagataagctgatagtccgatttcaacatcgggtatctactttttaaaaaatccaacagtcgccgaaaatggcggcttttttgtattgccagtgagggaaaacggcaaatgttcttgtcattttacatgcgaaggttttagcgggtaaaaaacgaatgatattaaatgacgcgtcacaacacacgacaaaagccgaacattattttgagaaagctatagctgataaaattttgttcggttccatatgaacgattatgagactttctttcatttttaagcctatgataccggcgtttcgaaaaaaatggttagacttgtttgacgtgcctaaattccggtagtacattagtcaacaactaaaaattgaaagagggattacgctatgagtctttgggatacaaagtttgcccggcgcggttttacgtttgatgatgtgttgttgatacctgcagaaagtcatgttttacctcacgatgtcgatctgtctgtacaactggcggacaacttgaagctgaatatcccaatcatctcggcggggatggataccgttaccgagagtgctatggcaattgcaatggcacgccaaggcgggttgggcgtgattcataagaacatgagcatcgaagcacaagcagatgaagtgctgaaggtgaagcgcagtgaaaatggtgtcattgtcgatccattcttcctgacggccgataaaccggttagtgatgctgaagatttaatgaaaaaatatcggattagcggcgtcccaattgttaataacaccacagatcgcaagttgaccggcatcatcaccaaccgtgatctgcgttatgttgatgataaaagtgtgctgattgacacggttatgaccaaggaagggcttgtgaccgcgccggctggcacttcaatcgaagatgccgaagctattttacagtctcgtaaaattgaaaaattaccgttgatcgataaggaaggccgccttagtgggctgattacgatcaaggatattgaaaaagtggttgaattcccgcatgctgctaaagatgcgcatggccgtttgttggttgcagcagcggttggcgttacctctgacacctttgatcgggcacaagctttgcttgatgccggtgccgatgcgattgtgatcgacacggcccatgggcatagtgctggcgtgattcggaaaatcaaagagattcgggaacagttcccattagcaactctgattgccggtaatgtggccacggctgaagcaacggaagcgttgtatgatgctggtgtcgatgttgtcaaagttggcattggccccggttcaatctgcacaacccggatcgttgccggtgtcggtgtgccacaactgactgccatctatgatgccgccagtgttgcccgtaagcgcggcaagacaattatcgctgacggtgggatcaagtattccggtgatatcgtaaaggctttggcagctggcggcaatgccgttatgctcggttcccttttggccggcactgatgaggcacctggccagttcgaaatttatcaaggccgccgcttcaagacttatcgcggcatgggttcacttggcgcgatggcgcaggcccacggttctagtgatcgttatttccagagcggggttaacgaagcaaacaaactggttcctgaaggcatcgaaggccgcgtggcttacaagggcagtctcggcgatgtgattttccaaatgctcggtggtattgaatccggcatgggttatgtcggtgcaccgaatcttcaagaactccaagataatgcgcagttcattcaaattaccggtgctggtttacgcgagagccatccgcatgatgtgcagatcacgcgggaagcacctaactattccgttcaataaaagattggtatcacaaaaaggctcatactgccattggttgcagtgcgggccttttttggcgaacgcgctatgattaagaggctacattcgtgcccgatgaatcacgtcaagtagttccgtaccgaaagttgtggccaatgtcaatggccaaccgggattggtgggtacagttgtcagaatggtttgcagccattgtgcagttggcaaaagtttcactaactgatgactggagaattgcgtgaatagcaaattagcactataaaaatcaatcagactttgttgcaacttggcatcatggacaggtagcaataagtcattactattgttacgatcacccaagaaaagcggtaacggcgcaaaatcttgttgtaaactaaaaggggtcattttatgagtcgtggccatctcgggggtcaggcgcagcatgaagaccagtttacgcgacgctgtccacagcagcatgttggcaagggccgtgtcaattgctgtaaaggtatatgtgtttttggccgcggcaggactcgctaaggcttttgtcaacatggttatcgagtcgtggcgggctgatgatgctggtaagacaacctgtagctgacgaacacctcgtaaccaatggggatgtgtggcaaggcgtaaggtgagccattgggaggattgccttaatagccagtaagtacttccgcttgagcgggcaatgttaatgccagcgatgtgcatggttgagggtaaacttgctgtgaccatttttgtcaaatctttcaattagccgccttctttcgagattaaatcaacacttttgtacctattctagccctgttttcttaggcttttcgtaaagaattccccggtcaactttggtacaatggactttgatgtaacagaccctacagttcttctcataaacggagccaatacaatgaaaattttaattgttgacgacgataaagaaatcgtcgaattactaagtatttacgttaaaaacgaaggttacgaaccgattcaggcgtattccggtaaggaagccattactaagcttgtgaccaatcctgatattgctttgatgatcctcgatattatgatgcctaatatgtctgggatggatgttgtcaaagaagtccgcaaagattcacagattccaatcattatcgtctcggctaaaacagcagatatggacaagattcaaggccttattactggagcagacgattatgtcaccaagccattcaatccgctagaggtcatggcgcgcgtcaagagtttgttgcgccgaagtcaaaatgaggtgaccaatacggaaccggatgtgcttgaagtcggtccgctaacgatcaaaaaagatagtcatgaagtcaccacccttaccggcaagcaaattcagctaaccgcgctggaattcggcattctgtacttgctagctagccatccgaatcgtgttttctcggctgatgagatttttgaacgcgtttggcaacaggaatcaatcgtctcagcgaaaaccgttatggtgcatgtctcgcatctgcgtgacaagattgaagaagcgaccgatggcgagaaggtgatcgaaacagtttggggcgtcggctataaggttgaggcctaacgatcatgagcgaaaaagtcaaactaactggtaaggaaaaatccgaactttggattgaaggcatcgtgacggtgattctgctgttaatgcttaattttgccttgctagtgttgattaatcagatgatcgcgcacaatcctggtttggaaaatgctatctggggtgtgaaaacgaatctgacgtttggcagccgtggatttcatttgtggagctggtccaatcttttcctagcactgatggcgattgctgatgtcattgtggtgtattggcgacttgctcggcgatatcggcaaatgcaaatgcgtcacgtcattgcggagctacattttattgccgatggtcatcttgatcatcggattaagtttgaggtcaatacggagttgcaaaaggttgtcagcagcattaacgcgcttgttgattcaaccgtcaattcaatggccgaggaacggcggatcgaacagagtaaagatgagctgattactaatgtcagccatgatattcgaacgccgctaacgtccattatcggttatcttggcctgattgaagatcatcaatatcgcagtgaagaagagctactcaagtacacgcacacggcttatttgaaggctaagcagatgaaagtactggttgaggacctttttgagtacaccaaggttaaatcgaccacgaccaagctgaatcccgtacgttttaacatgattgcgatgctagagcaactggcagctagttttgagctggaggctcataagaagcatatgcggattctggtcagcggtgaacctgacccgttgatgatggaagctgataccgaaaaattaggccgggtgttcaacaatttaattgttaatgcgcttaagtacggccaaggcgggcgtcatatttttcttgatgcacaacgtatcggtagtgaagtcgttgttaaggtctcaaatgatggtgcacaaattccgaatgatgctttgagtcagttgtttgatcgtttttatcgcgttgaggaaagccgatcgcaggaaactggcgggactggtcttgggttagcgattgcccaaagtatcatcgctttgcatggcgggtatatttatgccgattctagcccggagataacaagctttgtgattcatttaccattaaaagttggcgcttcgctgacagacaataaaaataaatctaatgaggaagcaggaaagtcaaaatgaagaagttgatgcgcgggctgattgccgcagtggtggcggtattgatgattgggggtgctgcgccagcaatgtcggtatctgcggcagagagcagcgataccaatctagttgacgccaaggcagcagtagccattgaaccgactactggcaagatattatatgctaagaatgccagcagtgttttaccaattgcatctatgaccaaaatgttgagcattgagttggtgcttgacgcaattaagtccggtaagatcaattgggatgacaaagtgacactgaataacgcaatctgggaactcagtcagaatcgtgaccttagtaatgtaccgttgcggcgcgatggctcttattcagtccgcgaactgtacgatgcttctttaatttattcggcgaatgcagcgatgatgttattagctgaaaaagtagcgggcagtcaggagaaatttgtcagtcagatgactgcaaaactcaatagctggggtatcaccgatgcaaaaattgtcaacgtgaccggtttgaataacagccaattgaaaaatgctaaggtacccggtacagatgataacgcggagaacgaaatgtccgcaaaagatatggcccaggtggcacaacatttactgaaagatcatccagaagtccttaagaccacgaatattgctaaacagacattccgtaagggaaccagtgatgcgatcgatatggaaaattggaactggatgctcaagggcctggtgtcttatgataagaacctcccagttgatggtttgaagacaggtacttctgatgccgctggggattgttttacagggacggttgagaaaaatggcatgcgaattattacggttatcttgcatgcaaatggtgatgctaaaactcgccgttttgatcaaaccaaaaaattgatgaccaatgttttggaaaattggaaaacgatgacgttagctgaagctggtcaggggattaaagggtacgacagcgtcaaggtcaatcgtggtcaatcacggacaacgccgattgcgccgtcaaccaaggctgttgctgttgtgccatctaacagcagcaaacaatcacttcaatatacttacacgccagcaaaaggcgtgaagaagaatactgtcgaagcaccagtcaaaaaaggtaccacgattgcgcagctggaagttagcgccaaaggtgataaccttggctttgttggcagttcggcaagcgaaggcattaccttaaagaccaccaagaccgataacaaagcaaacttctttgtcctgatcttccgtggcattggcgatttcttcagcaatattttctagtccagcagttacctcattgatccaaaaacgaaaaagtggtgaatgtcctgaactccgaatggagatcatcacgttcaccttttttgcaacaagtagagagttagttttcagataaaaaagaaggcattgaaatggtcacctatcacgagatcacgccaacaggtttggctaacttgaagcaggaagttgaagaccttaaaactattcggcctgcaaagatcaagaacttggccgatgcggcagcgttgggggatcgctcggaaaatgcggaatatagcgctgctaagcgtgagttgcgccagctagaaggccgattgcgatatctggataaactcattcgttatgctaaagtcacgcacccggccgctagtgatattgccgatattggcaataggatcacacttaagttcgatgatgacgaggaccaagcgacttatgaacttgtcggccctgccgaagctgggatgggccaagacaagcttgccatcaattctcccttgggcgccgctattcggcagcaccacgcaggtgataccgtcacggtgacagcgccaagcggttcgtatcaggtgacgttaatgaacattgcatctgcataaaaaaagataatcaatgaactttgagcatgaaccaagacggcacacagatagttgtgacagtccgactggtttaatgccagtaccgcgcttatgctataatgaagcttgaattcacggcatataaaaaggagtagcagcccaatggcactatcacttagagcatgtatcttattattaaaggaacatcatctgctaaagagtgcagcaattcagaatactgaagatgtcgatatgaccggcatcgcctatgattcacgcaaggtctctggaccaacgctgtttttctgcaaaggcgacaagttccgaccaatttatctttccatggccaaggacaacggtgcgcgaacttatgttgccgagaaaccttacgttgaaggcaacggcttaaacgccttgatcgtgcggaatattactaaagcaatggcgattttgagcgctgctttctttgattatccgcaagatgatttgtttgtgatcgcttatacaggaaccaaggggaaaaccacggcttcctattttacagaagctattttaaatgaggctcgtccacgacacatcgcgcttttttctacaattgatacggttgttggccctgagcccgatcagcgtttcaagtctaatctgacaacgccagagagcctcgatcttttccgcgatatgcgcgaggctgtcgaaaacggtatgacccatctcgtgatggaagtgtcgagtcaggcatatttgcgcaatcgcgtttttggattgacgtatgacgtcggcttcttcctgaacattacgccagatcacatcggaccgaatgaacatccaacctttgctaattacttacacaacaagctgcaattgttggtcaatgcgcgcaaagtggtcattaatgccgaaaccgagcattttgaccaggtttatgctgctgcaacgaccaccacttatccagaaagcatctatctgtttgccagtgctggcttcagacctaaacgcgatgatatcgatattgattttcgctttgatagtcaggaagctgacgttgctgagagtcgtttcacattagtaccagtcacggaaaaagcagcagcattgaacatcggcggtcactactcgcttgctttgattggtgattttaacgaaagtaacgcgacggctgctattattggtgctggattggctggcgtggatgcatctgccgctgttccgggtattgcaaaagttaaaatccccggccgcatggagcatacgaaagttgccggacatggtgctgtctatgttgattatgcgcacaactacgctagtatgaaggcgttattgtcgtttttgaaacacgcttacaaggatcctcgattactggttgtggttggatcccccggtgataaaggtgtttctcgtcgtcccggatttgctaaggttctcactgagtttgcaactgaggcattcttgactaccgacgatcctgggtacgaagatccagcaaacatcattgaggaaatcgatagtaaaatcgatcatagcaaagttaaagtacacaaagtgcttgatcggcaaaaggccattgctgaagctattagcgacagcggaccaaatgatatcgtggtggtggctggcaaaggggccgacccctatcaaaaggtacgcggcgtcaacacaccatggccaacagacatggctgttgtaaagcaagtcgctaaatcgctacaggaaggctgatacgaatgcgtcaatttttcaccgttattggcggcatgggcacgccggcaaccgagagttatgtccgtttgttaaaccagcgtacccacgcgcacagcgatcaggaatatctgaattacattctggttaacgatgcgactgttcctgaccgtacggattacattttggatcatagcaagcctagcttttatccggatttgttggaagacattcaagatcaaagtttactcaatccggagttcatggtcattgtctgcaacacggctcattatttctatgaccaattagccgcagcgacaccgattccattgctacacatgccacatttagccatcagcgatatgtgtgagcgttttccagatgaaaagcgggtgggactgattgcgacccaaggaacgatccaagacggcatttacagtcatgaaatcgaaactagcgggcgtgaagtcgttcttggcgatcaggcgctgcaagacatggtcactgagttgatttataaatacgtcaaggaaaagggcgaagtcaacgcggccctgtatcatcgtattcttcaacggatgcatgatgattttaatgtcaacgtcattgtccttgggtgtactgagctatcgtttgcacaggaaaaagccggtgatcatacgtatcatgtgattgatgcgcaaagcattattgttgataaaacaattgcgttaggcaaagctttccgtcaaagtgaagcagctgggaaggcattgttgaatcaaatgatggcgcgttaatagcgtgttaaaagaagatgcttggttttgctagatgtcttagcaaccaagcattttttgaatgctaagaaagacgattgatcaggatatcgctatttttgactgatgcaagtgtgacgctaggctgctaacacattcaatcaactacttacttgtggtaagcttatagtagtacccagtaaaggagatgctcattttggcacatttaaccaaattgaccgacacatatacattaagtaatggtgttaagattccgatcgtcgggttcggcacttgtcagacccctgatggcgacgttgccaagcatagtgtcgaagcggcgttggctgcaggctatcgccatattgacacggcggctgcttacggtaacgaagaaagcgttggtgcaggtttgcgcgcatccggcgtacctcgcgatcagatcttcttaaccactaagctttggaatggtgatcacggttacgaggcgactaaagcatcgttagataaatcactcaagaaactgggcgttgattatgtggatctatatttaattcattggccaaacccgattaagttccgtgataattgggaagaaactaatgcagggtcatggaaggccatggaagaagcgtacaaagccggcaaagttcgagcaattggggtttcaaacttccgcgccaagcacattgacgctttgctaaaaacagctactgtcaagccaatggttaaccagattttcttgaatccaagtgatttgcagccagaagttgtggcgtataatgacgcccatgatattttaagtgaagcgtacagcccacttggcacaggcaaaattttccaagttgatgccttaaagaaaattgccgcacgctatcacaagagtgttgctcagatcgtcctccgctggtcattgcaacatggtttcttaccattgccaaaatccgttcatgacgatcggattaaggaaaacaccgagttgtttgactttgaactgagccatcatgatatgaccttgattgatgctttgcacggtgaagccggcttagcaactgacccagatacaacggatttctaaggcaaaatcagcgatattaggtttttagttttttccatgagaaaagcatctgccatgaggttgcggcagatgcttttttatatactttgaaagattgggcaagggcaaggcggtgagctcaagcgcttagtgccgcgttgcatcaattgttgctcttacttggcggaaaagcggtgctgtctgactatcggttttgatggcactgatcataaagagcgtgtccataatgctgatttcggcaatcagtgcatgaagcgcctcagtgcggtagcgtgattcttcagcaactgcaacaaaggcagcatctgccattttgactaaacgcgaagttggggaaccggtaatgacgattaaaggcacttgttgtttcttagctagttcagctaatgcaatggcatctttgtcctctcctgaatgcgatgtcaggatcatcgcatcgcgcgggccaagatgtgtggcggccattagctgcatgtggtagtcagacgcataggccacgggaatcgccgtgcgcaaaaatttatggtaaccgtctagtgcaacaagattactggcacctagtccaaaaagtccgagatactcggcataggtaatccatttaacagccttggtcaaagcatcagtatctaggtttgctaaggttgttctcagtgcatcaatgttggaggtgaaaattttttgcgctagcgtatcaacggaatctttgggactcaactcagcaaaaagcgcatgatcatcctctggtgaagtctgcgccaacgccatgcgtaaggcctgaaagtttgtgtaacctaaggctttagcaaagcgggaaatcgtcgctgtactgacgccggtcaattggctgagttccgagatgttggcctgactggcatggtccgggtgggcttgaagataggcagctagctttttctcctggccacttagattcggtttataaatttgcagttgtaccagaaagtcatgcatcttgatccctcctaaaaatacattcaccagagcagaaacgagaatgtcagaattttaagtcgcattgtcagagtgcgtttattgtctaaggctgatggctaattgcaccaagccaaacaccacttttcgaattcagtatagcatgaatgatagcggcgtgaaaataatttacggtcaaattacttgatttatgcaaacgatttacatacaatggcatcaggatataagataaccatcacagaagcggtttgtttttttgaaaacggatggtcacagggtcaaataacgaggaggcagcaaacatgcatattggcatggttggtttaggaaaaatgggtatgaatctggtcgcaaatatgcgcgatcatgatattgaagtgacagcatttgatttgaacgacaaagcgcgagaagaggtagggcaatatggggccaaggcagtggcaagcctggatgccttggttatgagcttggcatctccgcggatcatctggagcatggtgcctgctggcaaaccgacagaagccacgattagtcagctagctaaactgttgcggccagatgatattgtgattgatggcggcaactcctattatcaggattcaatcgcacacggaaagctgctagctgctgagggaattcatttctttgatgtcggcacttcaggcggcatggccggtgcacgcgccgatggcaatttcatgattggtggcgacaaggcgatctttaacaagattgagccgctgttcaaggcgatcgctgcaaaaggtggctatctgtatactggcccagctggatctggtcactatttgaaaatggttcacaacggtattgaatatgggatgatgcaggcgattggtgaaggcttcgatgtgttagcccacagtccgtatgactacgacaatgcggcggttgccaatatgtggaacaatggctcggtgattcgcagctggctgatggatttggccgccaatgcctttaccgaggatgcgaaccttgaaaagattcagggtatcatgcacagctcgggtgaaggtgcttggaccgttgaagaagccttacgtctacatgttgcaacgccggtgattgccagttcgttgatgatgcgctatcgctctgaagaagcagatacgatgacgggtaaagtggtcgctgccttgcgtaatcagtttggcggccatgcgattgatccaattaagtcaaaataacttgcaaaaccatcgtgatatcgccattttaataactaagtcaaaattgattaagtaaaggagataagcatggcaatcaaatatatgattggcgttgatctgggcactactagcacaaaggtcgttttgtttgatctcaagggtcacgcaattgcaaccgccaataatccctacccgttatatcaagatacgcccgacatggctgaggaagatccggaagagatttttgcagcgacaattggcggtttaactgaagtgatgcatcgcagtaatgtccaacccgatgaacttggcggggtttccttttccgcagcgatgcacagtctgattttgatggatgaaaatgataagccgctgacgcgcgtcatcacgtgggctgataaccgagcagcagcctatgcaacgaagctgaagcaaagcgatttagggatgacactgtttaaaaacacaggtgtgccgacgcacccgatgtccccattggttaaattgctttggttgagtgccgaacatccagaattggtcgctcagacttcccactttattggcattaaagactttattttgttccgcttctttggccaatatgtgcaggattactcgctggctaacgcaactgggctctttaatattcacaccatggattgggatgaccgtgcacttgatgttgccaatgttcggcgcgatcaattgccagaactggtcgacaccagttaccagttgacaggattaaatgccaactatgcggcggtgaccggtattgatgctaaaacgcctttcattctcggtgccagtgatgggacattgagcaaccttggcgttggcgcgattgatcctggtgtcttggcggtgaccattggtacgtcaggtgcagtacgggttgtgactgacaagccggtagttgatccgcaagggcgcctgttcacttactacctgtcaccgaatcactgggttgttggcggtccagttaacaacggtggtattgtcttccgctgggttcgtgatcaactttttgcaccagagaaattaacggccgagcaactgcaagttgattcctatgaaattctgacagaaattgccagcaagatacctgctggtgctgatggcttacttttccatccatatttaggcggagaacgggcaccgatttgggatgccaatgctcgtggcagtttctttggcttaacccggcagcatacacgtgcgcatatggtgcgagcagcactggaaggtatcgtttacaacctatatatggtgatgctgatgatcgaaggtattactggcaaaccaaaagccatccaggctactggcggatttgcgcgcagtgcactgtggcgccagatgttggctgacgtttttgaacaggaagtcaatattccggaaagctttgaaagttcagccttgggagcagttgttttgggaatgaagtcactggggctgattgacgatttgaacgtggttaaagatatgattggtgtcaccaatacccatgaacccaatgctgacaattttcaagcttatcgtgagttgtttccaatctggattcgattgacgcgtaaacttggcagcgagtatcaagcaattgccgactatcagcgggcgcatccagatccgaatgcccatatagctgctgaggattagtcgccagcactgcgcctgttgtccgtgctaagacggaatatgctggttcgatgggaaaataacgagaatgaagcaactgggtacacagatcaaacgacatgtctcgagaaaaacgtcaatgaacgtttttcataaataaaattgtaagcgatttcttaatctgtaaattttaggggaaatagaaatggatatactcgtcctggtcttaggtatcctgctcttgctggtgcttatcatcaagtttaagttcaacacgtatgtttccttgatcatcacagctgtcgtcgttgcccttggtttgggaatggcgccagccaagattgcgaccagtattcaaaatgggattggcgcgcaactaggtgagctggccttggtcttcggcttcggtgccatgcttggtcgattggttgctgatgctggtggagcctaccgcattgcgcataccctcatcaatgccttcggtcgccgcggattgcaacttgccgttgttttggcatctttcattatcggtattgctttgttctttgaagttgggattgtcttgctggttccaattgttttcgccattgcggctgaagcaggcgttccaattctgacacttggtatcccgatggcagcggctttgtcggtgacccatgggttcttgccgccacatccagctccaacggcgatctcgactgcattaggcgcttctgctggtctggttttggcctatggcgtgatcatcgccattccgactgtttatattgccggaccgttgttttccaaacttgcgcatcgctttgtgccagatgcttttgagaggcgcggtaatttgaaagcattggggccgcaaaaaacctttaaattggaggaaacaccaagttttggcatctccgttctcacatcacttttcccagtgattttgatggcgattgccacggtttatgaattggtatttcatggtggcaaacttccaaagacaccaaatggtcttgataacgttatcgcattcattggttcaccaagtatcgccatgctgatttcattgttgttcgctatgtgggcaatgggctatgcgcgcaagctgccagccaaagccattatgacaaccctcgaggacgctgtgaaatcaattgcgatgttactactcgtcattggtggcggcggtgccttcaaacaagtcctgattgatggtggcgtcggcgactcagtaaaaaatttgttcgttggctcaggcatttcaccacttatcatgggttggctgattgcggttgtcttacgaattgcactgggatccgcgactgttgcggccatgacggcctctggactggttctgccactcatgcaaagtgctgacatccagccagctttgatggtactggcaattggtgcgggttcattagctgccagtcacgttaatgacgccggtttctggatgtttcgggagtattttgatttgaccattaaacagaccttgttgacgtggacattgttagaaaccattatttcagttgttggacttggtggggtgctgttgttgagtttggtggtttaagtgaaaaaataaaaaaagctggcaatgccggttttttttatctgtttcaagatgaaatgaggatggataagtcctagattgcaataataaagttaccacctagaaagaggcttgctcactgcttgacctttcggataaatcaattctcttatgtttctgtccgaaattctagtacagacccccaataaccagaatgaatcctttcatagataccaattcatgtccagcatgtagcctcgtcatggtgacaaggccgcccaacaaaagcaaatgcacgggaaataatctccgatatttttttgaaaacttcatttttatgcaacaactcgtcagcttttaagatttttgctgtcaccctataggaccgacatgccaagatttcgagtcatttcttcacctcctgcagcatctagtgtaacggacgacacgcatgataacgtcagaaaaaaataaacgttctgctttctatgattaacgtcaatattcaaaaaacctccccactaagttgacccttgccaaccttgtcaggaggtttcaatattgcttttaagcttctgctgttgcttctgccgcgtgccggacactttccgccacgacttccgcaacatccccatcaaaagcattaggaatgatgttggtggtcgatagctctgcatccggaatcaaacttgcgatgcccttcgccgcagcgatttgcatgtcaatggtgatcttgcgtgcgcgtgcatccaaagcgccacggaaaatacatgggaaagcaagcacattattgatctgattagcaaagtcgctccgcccagtaccgacaatataagcacctgctgccaatgcctcatctgggaaaatttccggctctggattagccatcgcaaagataatcggcttgtcggccattgtattgatccattctggcttcaaaacatgtggcgcggatacccctacgaaaacatctgcaccttgcagcgcatcttccaaggtgccagtccgattttcatgattcgtgattttcgcaatggcggcatggtgtggtggtagttgatcggcattcttttcagctaagataccaaccttgtcgaccaccatgatatgcttaacgccagcggccaagaagcgccgggcaacagatagtccagcagaaccgccaccgttgacaacgaccctgatatcgccaatatcctttccagcgactttcagtgcattgtatagcgcggcaagaaccacaatggcagttccatgctgatcgtcatggaataccggaatatctagctcctcgatcaatcgcgcctcaatttcaaagcaacgcggcgcactgatgtcctcaaggttaattccgccaaacgttggggccactgccttaactgccgcaataatctcttcagtatcctgcgtatcaagcacaatcggaattgaatcaacttttgcaaaccgcttgaacaacgcggctttaccttccataactggcatagcagcttcagcaccgatgtttcccaagcctagtaccgctgaaccgtcacttatgactgcaaccgtgtttttcttggtcgtcaggtcataaactaaagacttgtcttttgcaattgccgaggaaaccgcaccaactcccggtgtataagcaatactgagatcatcccgcgtctcaatcgggacctttgagacaacactgagtttgccgccaaattcttttgcctgatccagtgccagttgattaaaatctttctttgccatgagtcttttcccccttgtttaaaatgcgctcccaagtcctgaaactggactggtccacgctccacctaaacgcgatcgctggcccagaaacctgcgtgtaaggaccttggtcgcaatggtcaaagcccgaccataacgccctaggccacttactctccggtttctaaccgggccgactcacgctctatctaattatgaaagcatccgtagaatcgcagtcattgagataacagtgatggcaccacccaagcgtgttgcgacctgcgcaaatggcatgaggttcatgcggttcgccgtactcagaatcgccacgtcgccggttccgcccatgccgctttgacaggctgtcacgatggccgtttcaatcggattcatattcaagaaccgagccacaaagaagccggttgaaacaaccgtcaacacaacactgatcacgacgataaaatattgccaacttagcataccaaccacatcttttagcggaatgtataagagaccaagtcccgccatcaatgggaaagtgaagttactggaaataaatttatacaattgcttagcgccacgttgcgtttctcctgggataacgttgaggtatttcaaaattgcggcagcaacaatcatcagcactggtcctgggaagcctgtgatggactgaagcaacatgcccaagatgaataaagtacaggcggtcaagacgccagcgcccatcattttcaaatcaatttcgccggtatcgtctttcatcgcatcggcgagatcatcttcggccccgtttaatcgaaccagctgcccttggcctgacaactctggccgcttttcccctaatcgattcaataaacctgaacacataatcgcgaaaaagtttccaataatcgtcgccggaataagctgagcgacaagcgcgccgctggtcgtgcctgtgatcgtgctgtatcctagagatagcggtaaaataccttcaccaataccgcctgccaatactggtgtgacgatgaagaacatcgtgtgttgccattccaaacctagtaatacgccaaccagtgtcccgacacccattgcaagaatcatgccgagcatcattggaataatcatccgcatcaatccttgaatcagaattttacggttcattcccaaaatactgccgcagacaagacaggcaatatagaaataaagaaagtttgcttgtttcatgagcatgtctgcagcttttaacacattcggattcatcgcattgtagaaaacgagaatcgaaggtaccaacagcgataaaatcgccggaccgccaaagttcttcacaatcggaatattggctccgatcgtacctaataaccaacccaacgtcagaatgaccgcaaacccgccgagcatgttaactggcagttgctgcatcacaccggcaaggacgatgatcgctgccatcacgatataaactggcaatggtaccgaccctaccttgaagtccatccactttttctgcggactcgttgatttgttgggtgttaccgtcttgttctccatgtttccttacccccaatcttttgttagttacagcatattgtaagcgcttcatcaggggaagattatttaacttattaaaccataaacccatttatttaagcgattgttttactattcacaagatggtttcttttctgaacaggagtatgatcatgaaaataaaaggatggcggctatggggctggctctcattaatttttacttccaccttgttattaacggttctaactgtttatggtttgaccatgctggaaaaccgtcagcaatttgaaagccgtgaaggtcaattgttgatctcaattggccgtcagttagcaaaggatccccgtgtaaccgccgcacttgaagcaaacaaggctgattcagccacgcgcacctacgcagggactgtcgagaaaaattttgatttagattttgttgtcatcatgaatatgcaaggcattcgcctgacgcatcccgatcccaaacaaatcaatcgacattttcaaggtggtgatgaagtgactgccttgcgcggtcatgagcatgtttcggttcggcgcggaaccttgggccgctcactgcgcggattcgtcccagtgtatcgccaaggcaaagagatcggtgttgtggcactaggcattaaggtcacctcactgcaaacactcatcaagacctcgcaagatggcttccggctggcgctattcgccggtacgatcatgggcctgctgacagcgtttttagtcgcctactatattaagcatcagcttcatgaccttgagcccaaagaaattgctaggctgcttgaagaacgcaatgcaatgcttgaagaaaccaaggatcctgtcattgtgattgatttgcaccaagtcatcatgctcatcaacaaagccgctgccaagctgcaaaatcaccttataaccgaaagcgcctttattggccagccattgacgaccttgattgccaaccctgaacgtgtcaatctgaatgtcaaaaccgagcagttttatcaacaggatggtcaggattatcttttctctgccgcacctattatggtgaaaaaacaaaaaataggttacgttatctttctacgaaacgctactgaagcgatctttgtcgccgatcagttggccaacaccaccgcctatgccaacgcactgcaaagccagtcacatgaattcatgaattagctgcacgtgatttacggcttggtggcaataaaacaatatgacgaattggccatctacttgcaagatttgttaaaaccagagcaggaatttgcaaatcgcttggccttgcttgtcaaaatccactcgttgccggcttcatgattggtgaacgcgaaaagtttgccgagcgcaaaacgaccctcgactttgaaatttcccccgaactaccacctaatcctaatacccaagaaaccaaaacgctgttagcattaagccgctatctacatttcgggctactgcagcacgatttgccggacaccattttgatccagctagagtacgcacagaatcgtctcacgatcgcctatcatttagacgaaccagccaaacgaacggactttatctcgcttattcatcaagactacttccaacaactgctgacggagttgaacggctcagtcaccgttagctcaaccgatccgctgacactaacattaaccgtggactaccacgaggaggctcaaaatgacgaacattctaatcgttgaagatgatccaatggtgcaatttatccaccgcaattatttagaaaaaatcggtacttttgacaccatctactcttcagaaaccatcgctgaagccaaaaaactcttgtccagccgatccatccaactcgttttactcgacattcgcctcaaagacggcaacggcattgattttttaaccgacctgcgccgcaccaaacaaaccgttgatgtcatcctcatcaccgcggcaaacgaggtcaacattgtcaatgatgccttgcacttaggcgtgattgactacctcatcaaacccttcacgttggaacgcttcgaaaaaagtattcaacgttacagaaccaagcatcaagcattggtaactgatcagcttgatcaaagtcaactcgacacgtatttcgaaccgcaaacaaccatcgctccgacagtcgatctagacaaaggcctgagcaaagccacgttgcaactcattcaaggcgccattaaacaactcacgcaaccatttaccgtcgcacaattaacgacagaaaccggtctctcgcatgtttctgtccggaaatatttaagttttctagaggatcatcattttctgaaaggcgatacgatttatcgcaagacaggccgaccttataaaacttatcagatggtcacggcaccacatgcgctgtcgtaaacatcattcaaatctttaaaaaggcagtgatcttaaatactatgatcactgcctttttgttgttaatgattaaggttgcttacatacaatgaacgctaatactgtatttcctaaaatagataagtttcacgtggaactcctcagaaaattaaggcctacatttggttccacgtgaaactcgctaccactttcaacaaaaaccggttcacacacccgttaaagacgtctgaaacagtccattggcaccgtttctcctattttttcgacgcttcaggcaaagccgtatttttgttcgtgatatcaataaactgtgcttcacctgctactgaatcaacggctttttgtagacgacgcatggcggcgcttgcaattggcaaatctacaaagtccttggtcgcattgtctagttcgacttcatcggctacggaatcttttagcggccgcggattgctttcatctaaagcgcggatcacaactggctcaatggacccatctggagcaagtcgagtgttgtttggtagtcaatatcataggcatcggctaagtcaagtgtctcacgaatgccggcctctgctgccatgatggcaacattcgtgatcaatttcagtttcgcaccgtttccctgctcaccgacatattttacagtgccaaacgttttcaagataggtgtaacatcagcaaccgcctgtttgtcgccagcggcaatcagaaccaagccagcttcacgtgcatacttcacgccaccaatcattggcacatctagtagatgggtcttggtcggcatgacggcttgaatcgcagtaatcttacgcgggtccaaagtcgaggtcacaatcagcgtactccccggctgcaaataatgcacctcaattttcaagtcaagtgcaacgatgataacgaattcttgatagtggtctaacacagcgacggtctctggagctgatgttgttaggcgacttcgagaccggtcttgggctcgaagcgccgtctccgctctagctccgcgtcgccagccccgtctggccggagattgcggagtttggcacggcaagaaagtattagcctagcaccgtcctacgattattcggaatttaatgattcacaagtccgacgaggaaattatggctcggcctcttttttggatgcgagcagaaacgcttagaaacaagcagtcttggaaacttgttttagctagcacgcatcatcggtaataaaagaattttcttatttgagcgcgttttcaacccagcactcgtccacttatagtatgattgggacgggaagggtattgcccgaaattattaattatagacagatgggagctgatcacgtgagttatcgtgatacgtatcaacaatgggtcgacgaaccgacccttgatccggagctgaaagctgatcttaagaatatggctgatgatgagacgactaaggaagaggcatttgctgctcctatggcgtttggcacggcaggcatgcgtggtgttcttggtgccgggattggtcggatgaatatttacacggttcggcaagccactgaaggtttggcccggtttatggacacactgtcggatgaaactaaggcccggggggttgcgattagttacgactcccgttacatgagtcaagagtttgcgtatgaaagtgccggggtcttgggtgctcatggtattaagagttatgtttttgatcagttgcggccaacaccggaattaagttttgcggtgcgtcatttaaagacctatgcaggcattatgatcactgctagtcataaccctaagcagtacaatgggtataagatttacggtccagatggcgggcagatgccaccggaagaatccgacaaaatcaccaaatatgctcgttcagcagcggatctttttgctatcaagtctctgaacgtccatgtgctacgcgccaaaaagttgatgcaaccgattggtgaagatgttgatgaagcttactatgctgaagtagccacggtcaccatcaaccatgatttgattaacaaagtcggcaagaacatgtcgttggtttatagcccactgcacgggactggacggattccagcgcaaatggttttgcgtaatgctggtttcgaaaacttccggttggtacctgagcaaagtattgctgatccagaatttgcaactaccccattcccgaacccagagttcgctcaagtctttgatttgccaattgcattaggtaaaaaaatcggcgctgatgtcttaatcgcgactgatcccgatgctgatcggctgggcacagcagttaaagtcggcgaccattatcagttgttgacgggtaaccaaatcgcttcggtcttattgcattatattctggaagcgcgcaagcaagctggcacactgccgaagaatggcgcggttgtgaagtcaatcgtgtcgacggaattggcaaccgccattgcgaaggattatggcgtggacatgatcaatgtgctgactggtttcaagtttatcggtgatcagatcaagcattttcaagctactggcgagcacgaatttctgtttggctttgaggaaagttacggctatctgatcaagccattcgtgcgcgacaaggatgcgattcagtcaacagtgctgctggctgaagttgccgcatactatcagtcacaaggcaaaacgctttgggacggcgttcaggaactgtacaagaagtatggttactatgctgaaaagaccgttggtgttgactttgaaggggttgacggtcagaagcaaatggctaacttgatgaccaagttccgcgaagaacagcctgctgattttgcgggtgtcaagattacgaaggttgaagacttcctgagtcaggaagctaaatctgctgatggcactgtcgaaaaactgaccatgccatcaagcaacgttctgaagtacattttggcagacggtacttggattgctatccggccatccggcaccgaaccgaaagttaagttctatgtcggtaccaaagcagacacagaagctaaggcccaagaaaaattggatgccttcgaaaaggcgctcaatgattttcgtgaagaagcttagtttgttttaaacgaatcaatgtgtgaatcctgacgattaagcaggtgaagcaagatagcggcgaacgtattgtcccaaatttgggacaaggcgttcgccgttttctgtagggactatccggactttttcggtttctaaaagcgattgttcaaggtcctttaaaaaacgttgtcatgcccacagccatgtttctccggtatactttaatcaaggtaatgatacgggggtggcatgatgatgactatttaatcgttgaagatgaaccggcattaggcgagacactgcgcgcctatttggccaaagacggtcaggccgtgctagcgacctcgttagcgcaagccaatgaacgagtcgcgcagatttcgcccgatgtcatcattttagatctgagcatgcccgatggtgacggcttgacttggttagcgcaatggcggaagcatttgactgctaaggtaattgttttgacggctaatgacgaggagctaacgatgctaaaaggactccgacttgctgatgattacgtggtaaaaccggttagtttacgtgttttaaaggctcgcattgctaaacagctgccgatgacagtgcaacaatttggggcggttagcctgaatttagccactggtcaagtgacgaaaaatgacacagcggttgtgctaacggcggccgagtatcgtttgctggcctatttttttgccaaccccaatcaaattttggcaagagatcagttgctagcagccttgtgggacacgcgtgagcagtttgtggcggataatactttaaccgtgaccatcaaacgtctgcgggaaaagcttgaggatgatccggcacatccgaccttaattcggactgtgcggggaatggggtattttattgatggttaagcatgattattgggctatgccggaaaccaaaagtgtgctgagattgacagtgtggttgatagttattttgtgggccgctttactcacggtgatggtgcttgtgccagtcactcggctttggctagttgttattggccttggcagcacactggccagtagttgtgtcgtgttgcggtgggcagtcaagtttagtcagcgttttgacttggcgctgcggcaactagatctgacaaaggcaggtacaagcaactatgcgattgatcggaatgatgaaggactgttttccgatctcaacaatcgactttatcaatatgcccgccaaatgcaagctgaacgcacggcagtgaagcgtgatcgcgatcagctaagtgttgctattaccgatattgcgcatcagttgcgaacacctttagcggcgaataataatttgcttgaaatgatgaccgcggctaattgggaggtcacccgtcaggagcttttagcgcagcacacgcgtcaagcagagttagttgagcagctcattttattagctaaggtggatacacatacgctgagccaaactagacaagatgtgagcgtagcggcgctggggaaagaggcattgaagccaccattgaagccactgctgcgaatggttgctgataagcagttgacgattgattggcaggtatcaccagacctaatgcttcatgtgaacccggcattggtcaaagaagcgttggtcaatgtcttgaaaaatgcggttgaacatactgcttttggcggtcaaattcagattattgggattgctgatcctattcgcgtccgcctgaagattatcaatacagtctcaccaattgctgaagcagatatgccgcatttatttgagcgttttttccgtggtcaatatgccactgccaataacgtgggcattgggttagcgatcgctgctggcattacgcgtgaaaacgatggccacttatctgctgaaaataccgcggaaggcgtacaattcacgtttgaattttttcgttgaacgtgttttgtcacttacttgtcacttaccattgataggctgagagtatcataagaaagccaacacagattgatgtgtcaggcgcgaggaggggtactagtggccattttgacagcacgacaattgacgaagcaatatgcaggggaaagtcgaccagcgttagatcacgctgattttagtattgaaaaaggtgaatttgtagcaatcgttgggccgagtggttcgggtaagtcaaccttgctacatctgctgggcggtattgatcaaccaaccagtggtcgggtacagctatacgatacagatatttatgctttggatcagacccaattggcgatttttcggcggcgacaagtcgggttgatttatcaattctataatctgattcccgatttgacagtggtcgagaacatgacgctgcccgctgacttggacggtcgaaccgtcgcgacatctgagttgacagaattactggctactttgggcctgacggaaagcaagatgctttgccaaatcaactgtcaggcggccaacagcagcgcgttgcgattggccgggcgctgatcaatcatccggcgatcattttagctgacgaaccaactggcaacttggatcgccgcaattcacaagacatcatgactttattgcgacaggcgaatatcaagcaaggtcagactttaattgtgattacgcatgatcccgatatcgctaagcaagcagatcgcgttgtaaccatcaatgacggtgtgctgcgtgaagggcggtgagcgtcatggggacgatgacccatttagtttggcgtcaactgattaaggagaaggcgcgcacgttcacaaccattctggcgatggcagttgctgcgaccttaactgtggccaccttgattggcattaattcggctcggcattcaatgtatcaagataatattcaaaataccggcggcctacagtttgttttatcgaaggttaaccaagaaaccgcactggctattcagaaaaaagccgatatttccgaaagtgtccgttatcagcaacaaggacaaatcagctttgctgatcaggtacctaaccaaccagattcgcctttgttaatgttgccgaaaccggcgctgcagcgattaatccaacccattcttttggaagggcggctaccccaaaatgagcaagaagtcatgttagcccaagatttgatttctgatgtttatgcagtgggcaaaaccgtggcggcacagcgcaatggtcagcgcgtcgttcttaagatcgtcggtagttaccgtggctatgctggcctcatggcaagtgatggcgctgtcaccaccggccattttgacggcacgaagaactatgctgtcgcagcggcttttggcaactatggcaatttttatgcgacgttgaagaaactcacagcgcagtatcatgtcggatccgaccagcagagaatgaatgaattagctttggaacgggccggtgagtcgcgagatgtcaaggtccgtgccatgttcgtattacttgtcatcgtggtgctaagtgtgattggtttggtgtcattggcgttgatttataccagcatcaatctgagtgtacaagcacaaacgcagcgttatggcttattgcgttcaattggtgcaacgccgagacaaatcaggcaatcggtgtatctgcaagcactgactttggcattgccagcgattttactgggtttacttgcaggaatcggtgggttgtcagtcgcttttcatgaattgaatcgaatttttaaggcgagtggtaacacctttcagctcctactcacgatcagttggtggccgattttagtcagcggatttttcatgttgcttgtcacgttactagcagcacgacgaccagccaaacgcgccgcacaagtgagtccgattgccgcagttcgcgcgcagtcagcaagtcggaaggtgagtcagcgtatgttacggcaagggatgccgggacgatttttgccgacgccgattgctaaattggcttataaacattatcggcgtttgggctggtcaaaagtcacgatgatgacaacgctggccttgtcactcatgatctttatcggctttaccagtttctttcgcggcatgttaacttttagcgatgaaacgattagtcgccaggcagatgtgacgatcaccaagacacaatcgctggcatcagcgaatttctcttttaatccgaggcgactgccaggggtgaaacgcggaacggtgactggcacaactcaagtcggtttgaaaaacgctccacaagcatttcatgatcggctgaatgtgatcgtggtgagtgaccaaacgttcggcactgtttttaaagatcagccgacgattatcacaggcagtcggttagtgacaaactcaaaaacgggcaagcgccagcagcaatgggacacgccaaaagattttgcaggaaccttggagcttgctaacgagcaaagtagccaaaagactttaacgcagccgatgaaggtcgtcaccaagactgctgcggaaatgaccgattggcttgtcagtgaccaaagtggtttggtgctttctgctagccggttccgtcaaatcagccaagcactccaaattaaaaatgatgacgttacgtatgccattcaagtcttactaattaaaccaagttttcatgagacggtggccagtgctttacggcatgaattgccacatgcagcactttttgatcaaattgaaaatgatgcgcgtggcagcagctttcagcttgctattcaagtcatggtctatggctttttaaccctgctgacccttgtgagtctggcgaacattgtgaatcatatttttgctaatctgttgcaacggcggcgaagtctcgccatgctgcaaagtgtcggtacgacacctggtcaaattgttcggatgttggcacttgagaatgggtttctgtttgggacaagtatggtgattgggtctttgctggggacactgcttggctggattctgcatcaagctgtcaacaccggtattacgatggcttttcaggttccttggttagagatggggatggccggtcttgcattactggctatctggggtatttttgcagggattagttttcagattatgcgacatcagtatattgatcaattgattcgggtgggttaagacaaaagtgaaatgattgatggcactgatgctccggtttctaaccggggtagttcacgcgcttgctgaaacgcgttctcaggcgcagaaacctgcacataaggaccttggacataaatggccaaagccacttatgctccggtttctaaccgcgcctgttcacgctctgctcttgcaatgggcttcacaaggtggtagtcttttaacaatttaatttactgccatcactatcacgccacgaatatcaggaggtcatttaatcatgggcatgcaccaatttatccaaggactaagcaacttagagacactgcgtcgggcaccgggattctttaagtatcaggaacattcagtggcggcacatagtttcaaagttgccgaaatcgcgcaaatgctaggcgatgttgaggagttagctggtaacaaggttaattggcagatgctctatgagaaatctctgaatcacgattatactgaacgttttatcggcgacatcaaaacgccggttaaatacgctaccccgacactgcgccacatgctggctgatgttgaagcgaccatgacggagaactttatcaaaaatgaaattccccgtgactttcaggatcgctatcgtcgtcgtctttctgaaggcaaggatgaaacgcttgaagggcagatcttgagtgttgctgataaaatcgatctactatacgaaggttttggcgaaatcgagaaaggcaatcctgaacaggtttttctggatatctactccgaaagcttaagcacgatcctgcaatttcggaatcgtcctagcgtgcgctacttcttggaggaagtgttgccggacatgcttgatgaaaaatttgccagccgtgatcagcttgctaaactgactaaagaaaccatggcagaacatgaaccaaacaagtagcgaaagtatgttcgctatgttataataagcaagacaaaagttggaatgcgcatcatgtcgattccaacttttttgatgacgaaattttgtttagataatgtaaaaatgcgttcactggggcctttttcctgcacggattgacacgtgttcaccttgtattcggaatgaatgatgcccatgtgattgttttataggaggcatgtcgatgatcgaacgaatagccgatcgtaaatttgatctggtttcaccttaccaaccagctggtgatcagccacaggccattgccaagttgacaaagggctttgaagagggtaagaaagaacagatcttgttgggtgcaactgggactgggaagacctttacgatgagcaacatcatcgccaacttgaacaagccgaccttgattttgtctcacaacaaaacattggccgggcagctttatggtgaattcaaggaattcttcccgcataacgcggttgagtattttgtttcctactatgattattatcaacctgaagcctatgtcccgagtaccgacacgtatattgaaaaagatagtgcgattaacgacgaaattgataaactgcggcacagcgccaccagtgcgttgttggaacgaaatgatgtcatcgtggtggcctcagtgtcgtcaatctttggtttaggtgatccgcatgaatacaaaaatcatgtgctgtcattgcgaactggcatgacgattgatcgtaatacactgttacgccaacttgtagatattcaatttgatcgaaacgacattgattttcaacgtggtcgctttcgagttcgcggcgatgtcgttgaaattttcccggccagtcgtgatgaccatgcgattcgagtcgagtttttcggtgatgaaattgatcggattaccgaagtcgacgcattgaccggcgaagtcatcgggacacgtgatcatgtggcaattttcccggcaacgcatttcatgaccagcgatgaacagatgcagcgagcgattaagagcattgctgctgagttagaggcacaattgaaagtcctgcgcagtgaaaacaaactgttggaggcgcaacggttagaacagcggacgaactatgatatcgaaatgatgcgggaaatgggtttcaccagcggcattgaaaactattcacgccatatggatggccgtaagcctggtgaaccaccgtatacactgctggactttttcccgaaagacttcaacattatggtggatgaaagtcatgtcaccatgccgcaaattcgcgggatgtacaatggcgaccgagcgcggaagcaaatgctggtcaactacggcttccgtttaccaagtgctttggacaaccggccattgaaaatcaatgaatttgaacaacatgtccatcgtattttatatgtgagtgctactcctggtccttatgaactggatcgggttcctaaagacgatattgctgagcaaatcattcggccaaccgggttgttggatccgaagatcgaggttcgaccggtcatgggtcaaattgatgatcttgttggtgaaattaacaaacgggttgatgctcacgaacgtgtttttatcaccaccttgaccaagaaaatggctgaagatctgaccgactacttgaaagacatgggcatcaaggttcgctacttgcatagtgacatcaagacacttgaacggacgcagattattcgtgatctgcgacttggcaagtttgatgtactgattgggattaaccttttgcgtgaagggatcgatgtccctgaagtttcgttgattgcaatcttggatgctgacaaggaaggctttttgcgtgccgaacgttccttgattcaaaccattgggcgggcttcacgtaacgagcatggcaaagtcatcatgtatgctgataaggtgacagattccatgaaggctgccattgatgaaacccaacgtcgacggacgattcaggagaagttcaacgaagaacatcacatcacgccaaagaccattatcaaaccgattcgggcagctatttccagctatgaacaatcagatgatgataaagccgaggccaagaagacttttgctgaagttgattatgaggatatgagcaaggttgataagaaggagttagtagcaaacctgcgctcacaaatgcaggcggcggctaagaagcttgatttcgagcaggcagcgtcattacgcgacacaattcttgaattgcaggctgatatgtcttaatcagatcgcacttgcacgatggtaccaagtcagccatgattgctttgaacagatccggtgagtgcgaaccagcccggttagaaaccggagcataagtggccttgaccgtgatggccggtctttggccattgcgttcaaggtccttatgcgcaggtttttgggctagcgagcgcgttaaggtgagcggtcagaagtcggcgtataagctgttgtggcaatgtgattttcgccaatactgcttgctaaaaatgaggagatcttttgtgaatggcaaacgataaaattgtgatccatggggctcgtgcccacaatttaaagaatattgatgtgacgattccccgcaataaactggtcgtgatgaccggcctatctggttcaggtaagtccagtctggcttttgacacgctttacgccgaaggtcagcgtcgttacgtggaaagtctctcagcatatgccagacagtttctgggacagatggaaaaaccggatgtcgattcgattgacggcttaagtccggcgatttcgatcgatcagaaaaccacttcaaaaaatccccgatcaactgtgggaacagtcactgaaatcaacgattacttgcgcttgctgtgggcacgtgtcgggcatccgatttgtccaaatgatggcacaccgattaccagtcaaagtgttgaacagatggtggatcgcgttttagccttacctgataagacccggattcaaattctgtcaccagtggtgcgtcgcaagaaaggcagtcataaaaaagtcttcgccaaaatcatgcgtgaaggttatgtccggatgcgtgttgatggtgaagttgttgatgcaacggctgattatgaactggataaaaataagtcgcatgacattgatattgtgattgaccgaattgtggttaagcctgaggcgcgcagtcggcttttcgattcatttgaagcagctctgcggttgtcagaagggtatgccaacgtggacgtgattggcggtgaaccactgcgcttttccgaacattttgcctgcccgatttgtggctttacgattggcgaaatggaaccccgactattttcattcaacgctccttttggcgcttgcccagaatgtgacgggttgggtgttaagctgacagttgacatggatttggtgctgccagaaccgagtatgactttggcagaaggggcaatcgcgccatggaatccaatcagttcccagtactatccggaactgctggctcaggcggcgaaaaccttcaaggtacgaatggacgtaccctttaacaagctgacccaccgtgagcgcaatgtggtgcttaatgggagcgacggcaagttattccattttcattatgaaaatgactttggcggtgtacgcgatgttgatgtgccttttgaaggggtgctgaataacatttcccgccgatatgcagaaacgaatagtgattttactcgccagcagatgcgcagttatatgacagcattgccgtgcccggtttgtcacggcaagcggctgaatcggcaggctttggctgttaaaattgaaggtcgcgatattgcagaagtttctgatcttgccatcaaggatgccctaccatttttcaaaaccgtgcatcttagtgaagccgaaagcgtcattgcccaaccaatcgtgaaagaagtcgttgaccgcttgacattcttggtcaacgttggtcttggttatctcacattgagtcgtagtgctggtacactatccggcggcgaggctcagcgaattcgcctagctacccaaatcggttcgaatctgagcggcgtcatgtatgtgcttgatgaaccatctatcggcttgcatcagcgcgataacgatcgcctgattgcctccttgaaaaaaatgcgcgatcttggcaacacgttgatcgtggtcgaacatgatgaagatacgatgcgcgccgccgattatctgattgatgtcggaccgggggctggcgaacacggtggccgtatcatggcatccggtacccctaaacaagttgcacgtgtgcgcaaatcaatcactggccaatatttatcagggcgcaagtttattccggtaccactaaaacggcgacaaggtagtggcaaagtgattcgtttggaaggcgccactgaccacaacttaaaaaacatcgacgttgattttccattaggtaaattcatcgtggtttctggtgtttctgggtcaggtaaatctactttggttaactcgattcttcggcgtgcattggctcaaaagttaaatcataattctgagaaaccgggtccatacaaaaagattcttggctataaaaatattgaaaagctgatcaatattgaccaaagtccaattggccgcacaccgcggagcaatccggctacctatacgagtgttttcgatgacatccgcgggctatttgccgaaaccaacgaagctaaattacgtggttacaaaaaaggccgctttagtttcaacattaagggtggtcgctgtgagaactgtaaaggcgacgggatcatcaagattgaaatgaactttttacctgatgtttacgtgccttgcgaagtttgccatggcaaacggtataactctgaaaccctcgaagtaacgtataagggcaagaatattgctgaagtgcttgatatgactgtcgaagaagccactgacttcttcaagaatattccaaagattcggcgcaagttgcaaaccatcgtggatgttggccttggttacgttaagctgggacaaagcgctaccaccttgtctggtggcgaggctcaacggatgaagcttgcaagcgaactgcagaagctttcaaccggcaagaatttttatattcttgacgaacccaccactggtctgcatacggatgatatcaagcggctgctggaagtgttggaacggctagtcgatgaaggcaataccgtactggttatcgagcataatctagatgtcgtcaaaacagctgactgggtcattgatcttggccctgaaggcggagacggcggcggtcagatcatcgccactggcacacctgaacaggtggctaatgtggccgatagttatactggccaatacttgaaaccaatcctcgttcgtgacactcaacggactaaggaagctgcgcaaacatcaactaagaatgaagcgcaggcagtaagcaagaagtagattgactgaccaggttggaccatcattcacggcggttaataagggcaaacaatgacaacaaaattgtttgcctttttgatatgggaaatttattagaattttcgagacactagtaccaaggcggagcaatcgtagaccggatggggatcagcagtacaaaaagcacggcgaccgcgccttgttactgatgttgttaggcgacttcgagaccgcgagttttgcgggcttggagcgttgtctccggtctagcaacgcgtcgccggcccagaaaccgacttgtttcacactctgatttgctcattctcgtgcttaatattatgatgaataggattaagaaagtagggaaatagatgttaaatcgaaaaagttttggttttgactgggggcagtttatcactggtatcctgttcctgatcgccgcatttgttgtcatgcgctatccgctggcaacgttgaaaacggtgacctttatctttgctgttggtgccattattcgtgggattgcgattttagcagggtattcaacgcttcgccagctcactggtaaactagcttgggtgtcgctcttgatggggatttttgaccttgttattggtgtcattttcctagtcaacagtaattttggtgttgcaacgattaccatgatgtttgcaatctggttcttagttgattcagttggttcgctattcaacgtgggccatttgcggattgcaggtactggctggtttgtcctttacctcgttttggatattctggcagtgattgtgtctttgatgctgttcatgcagccagtggttgcggccatcacgttggtcacattattgtcgatgtttttcgtcctattcggcatcgaatgtattgtccttgcctttgcacgacgcaatatttaatgaacatcgcttttatttaacctgatgcagctgattcattacgctgcatcaggttttttaataacgacgcttgatgatgcggtgaaaagaaaccggggatcggtaggaatgacacgcccggcatgttatactttaataaatatgatcaaaaaggagccttttatgactgaaagtttggatcttgtcattatcaccggtatgtccggtgccggtaaaaccgttgccatgcaggcattcgaagacctgggatatttttgcgtcgataatatgcctccagctttgttgccaaagttttgggaattggtaaaagaatccggaaagatcacgaaggtcgcgcttgttgtcgatctgcgcagtcgtgctttttacgatcagattatcgatatgctggctaatttggacaacaatgcctatgttcattctcgcatcttattcttggatgcaactgatgaagagctggtttctcggtacaaggaaacccgtcgctctcatccgttggccatggaaggccgattgatggacggcattaaaaaagaacgtgcattactcacagaattgcgcaatcgcgcgcaggttgtgattgataccacgaccttaagtccacgtcagttacgggaaaagattttccttaactttaaggaaagcggtagtcaaccagcatttcatattgaagtcatgtcatttgggtttaaatacggattaccaatagacgctgatattgtcatggatgtccgtttcctgcctaatcctttttacattaaggattatcggcccaagactgggcttgatccggaagtttacaattacgtgatggataatgaagatgctgaaagtttctataacaagttttatgatctattgtctgaaatcatgccaaagtacaaggcagaaggcaaaaccagcgtaacgattgcgattggctgcacaggcggccagcatcggagtgtggcttttgccgagcggattggtaaggcgttttcagatgcatatgccgttgatatcacgcatcgagacattaagaagcataaggagacggtgaatcgctcatgagtcgtgaaactaaatttattcgggtcatccgcggtcggcgtcccaaggtggttgtcattggcggtggaacaggcttgccggtcattctgcatagtttgcatgagcaagatgcagatgtgactgcaattgtgactgttgccgatgacggcggttcatcagggacaatccgcaactatatcaacgtagtgccgcctggtgatattcgcaatgtgctagtggctttatcggagttgccgagtttgtatttggatatttttcaatatcggttcaatacaactgatgcttttttcgctgggcatgcgattggcaatctgattattgccgcgctgtctgaaatgaaaggcggcattttcccagcggttcagcaactaagcgaaatgatgcaagttgatggtcacgtttatccggccagcaacacgccgttaaccttaaatgctgaattcaccgatggtacaaagctgtctggtgaagctgagattacagcggctgggaaaaacatcaagcatatttcggtttcagaaacagatcccgccaatggcaaaccagaggcggtcaaagaagttatcgatgcgattatggacgctgatgttgttgttttaggcccaggcagtcttttcactagcattttgcctaacttgatgattgaaaatctgggggatgcggtgaagaagacgcaagccgaagtgatttacattgtcaatatcatgacccaaaaaggcgaaacccagcattttaccgatgccgatcatgtccgggttctgaatgaacaaatgggcgagaactttgtggatacggttttggttaacattgaaccagtccccgataattatctggatcatcaaaagtacaacgaaattctcacgccggttaagcataactatcaaggcttgcgagacatgggctgccgcgtgatttccgaagactttttaaagttgcgcgatcatggggtctttcatgatggtgataaagtcgccaaggagattttaaacttggcctttcaggtcagcggcaaaacccggaggtgagggtatggcaagtttcgccagtctggtgaaaaaagaactgacacagctcgaggtacatccagaacatgctaaggctgaactgtctgctttgattcgtatgaacggcagcctgacactgatggctcatcgttttgtgttaaatattcaaaccgaaaatccggctattgcacgtcggatttatagcttgattcgccaagtctatcatcacgaagctaatctggttgttcaccgtaagatgaagctcaagaagaattatcaatacattgtgcggctaacagaaggcgtcaatgacatcttgtcggatctatcaattttagatccggataccatggcgatttcaacaaccgttccggcttcggtgttgaaggaaccgcagcggatgcgttcttatttacgcggtgcctttttggccagtggttcagtgaataacccggaaacctcgcgttatcatctggaaatctattctttatacgataatcacaatgctggtattttgaaaatgatgaatcattttaatctgaatgctcgcaccgtagaacggcgaagcggctacattgtttacctcaaggaagcagaaaagattgccgatttcttgcaggttattggggccacgaatgctatgctgaagtttgaagatgttcggatcgtgcgggatatgcggaattcagtgaatcgattagttaactgtgaaaatgcgaatatgaataaaacgattgacgctgcacagaagcagattgagaatattaactatttaaagaaccatgttgggctagataacttaccggccaaattgcgggaaattgcagttttacgcttagcacatcctgacgtctcgcttcaagagcttggagcgatgatgccgagcggccaaatttcaaagtctggggtcaatcaccggttgcggaaattgaatcagattgctgaagggtatcaacaaccagaagacgcttgagcactaatgcgaagtgggttgcgttcatcataatcgggtgttgacaatcaacaaatcaatccctttgtttcctcaagctaatcgtgtacaatgtaaccgacatcaagttatttttttgctgaagattgactgttttggacgcatttcgatgtcttttaacttggatgtatccctttggcgacgacttgtttgaaggagccgtgatgatcttggcaaccagagagaagcgccatcgcttttttgagatgactgtcttgaagcaatgacgtgagccccgtcggtgttgatggtggctaataattgatagatgagcgcatttttcacagtgtggacggcttttgcgagctgttcgcgcgtttaaaggtaagttttaggaggaagcagcatggttaaaccgattactttgaacgaacagctttgttttgcgatttacaaagcacaaaaacaatacaatcatttctattcacaagcgctagctccgttcaagttaacctatccgcagtacatcacgttattgtcgctatatgaacatggcacaatgtcggttaagcaagtcggacaaacacttgaactagatagcggcaccttaaccccgttgatgaaacggcttgaaaaagatggttggatcagtcgcaagcgttccactgaagacgagcggcgagttgacgtcagcctgacccaaaaggcgctggacgcccgtgatcagatttttgaacacgttggctcctgcatggaattaatgaaccttcctaagcctgagtatgaccatattaagtccgaggtcagtcgggttgatgaccatttaagcgctattccagacggcgcttttccagaagcgtaacgcccaaaaataaggtcaaagatttttacctaaatctttgaccttatttgactttagttgtatacttagcactgtacttttaagagtgctaataacgattatcaggaggttaggacatgctagtacctaccgtcgttgaacaaactagtcgtggcgaacgtgcttacgacatttactcacgtctattaaaagaccgaatcattatgttatccggtgaagtcaatgatcaaatggccaattctgtcatcgcgcaactgcttttcttggacgcgcaagactctgaaaaggatatctatctctacatcaacagtcccggtggtgttatcaccagtggcttggcgatgctggatacgataaacttcatcaagtcagatgtgcagacgatcgctatcgggatggctgcctcaatggcgtccgttttgctggctggtgggacgaaagggaagcggttcgcattgccgaactcaaccatcctgatccatcaaccttcaggcggtgcccaaggtcagcagaccgaaattgaaatcgctgctgaagaaatcttgaagacacgtcgcaagatgaaccaaattttggctgacgcaactggtcaaacgattgagcaaatcaagaaggacaccgaacgtgatcattatatgagcgctcaggaagccaaggattacggcttaatcgatgatatcttggtcaacaaaaatacgcaaaaataagctgtaaaaagaaaagcgcgttgccatatcgtggcaacgcgtttttgtttccccgaaaagacttgcaaagcgagggcatattgagtaatatgattaggtacttgcgcggttagtgtaatggatcgcacgtgagattccggttctcgaaatccgggttcgactcccgggctgcgcagaagcttggttaaatggaaaaagataggacagcaaaaaccccgagtaatcggggtttttgttttgtttaaaattaaaaacattcaaaacaggatagaggcgtgacatgcatcatgctaaaacgccgataagtgatagcctgagatccgaattgcagcgacgatcttcaccgttcattgttcgggtgcttgatgagagattcggcggctatttttgcaaacgctaacattataacttggaaactgctcattatataacgaacgggaataaaaccaacccttgtcactactgaactaagacacaaactgaatcacttttcccagcatgaaaattccattagaaacaacccgaaacccgctttcaaaaaaacccgccagacgggatgatgttttagtaaaatccgaataatcttcacaccaaaaaaatagatgttctaagtttaccgaatatgtgattgtttttggacgattaaggccgcagacttgcgataaagcggaacccctgctacaattggtcttgttggtaaaggaaaacagcatttgttgggttcctaatttttttcagcttgctgggtcggcgaacgactcggagggacgtggaatgacccattaaagaaggacgtgccttatgcatactgaacttgcgtggctcaaagcgatcgcgcctgatctgatgggcgttgtcactaaacgctatcaggtccttcaatttattaactggatggcaccagttggccggcgaacgttggccgaacagatgaagatctcagaacgtgctttgcgcacagaaacggattttctgcgtagtcaaggtttgttggaaagctcaaaatctggcatggtgctaacagcaaaagggttagagacatttcatggccttgatcatcttatgaatcagctgttaggaattaaggatgatgaaaaacgacttgctgcccagcttcaaatcgatcattgtttggtcgtatctggcgatgccgatcaaagtggtcgggtgcttgatgagctggggaagacgttgaattcgaccttacaattactgttgccgccgggtcgcttgacggttgccgtgatgggtggaacgacaatggcacatcttgcaaggcagctgacatttcagttgtctgcaggacgtgaattgacgtttgtccctgctcgcggtggcttaggcgaagcggtgacgattcaggccaactcgattgctgctgcgatggcggaagcaaccgacagcaactaccgggcgttgtatgtaccggaaaatcttagctcggaatcctacgaatcattgattaaagagccttctgttaaagaggttttagggatgattgataaggctcaggtcgtgattcatagtgtgggtgacgctttagtcatggctcgtcgccgtggcatgtcatctgacacgatcagcatgttgaaagccaaacatgccgttgccgaagcattcggtgttttctacgatgcgagcggcaaggtcgtttacaagataccgcagattggtttacagctcgcggatcttgatcatataccgtatgtattcgctgttgctgctggcaaaagtaagtccaaagcaattgcggcatacatgcaacacgcaccgagtcggacgtggctgttaacagacgtcggtgcaacaaattcgattttaactggggcaacccgttagaataaaaccttatttcctaaaggaggaaattttagcatgactgttaagattggtattaatggttttggccgtatcggtcgtttggcattccgtcgtatttacgaattgggtgcaaagagcaatgacatccaggttgttgcaattaacgatctgaccagcccaaccatgctggctcacttgctgaagtatgattcaacccacggtactttccctggtgaagttagtgcaaccgataacggtatcgtcgttgacggtaaagaataccgtgtctacgcagaaccgcaagcccagaatattccttgggttaagaacgatggcgttgactatgttcttgaatgcacaggcttctacacctctgctgaaaagtcacaagctcatttggacgcaggcgcaaagcgtgttctgatttctgccccagccggcaagatgaagaccatcgtttacaacgtcaacgatgacactctgaatgcagacgacaagattgtttctgctggttcttgcacaaccaactgcttggcaccaatggcttacttcctgaacaaggaattcggcatcgaagttggtaccatgaccaccgttcatgcttacacctcaactcagatgttgcttgacggcccagttcgcggtggcaacctgcgcgctgcacgttccgctgctgctaacacgattcctcacagcacaggtgctgctaaggctatcggtttggttatcccagaattgaacggcaagttgcagggccacgcacagcgtgtttctgttgttgacggttctttgaccgaattggtttccatcttgaagaccaagaacgttactgctgaccaagttaacgaagctattaagaagcacaccgaaaacaaccctagctttggctggaacgaagacgaaatcgtatcttccgatgttatcggtacgacacaaggttcaatctttgatcctacacagaccgaagttacaactgctggtgactatcaattagttaagacggttgcttggtacgataacgaatatggctttacttgccagatgatccgtaccttgctgaaatttgctactctctaatccggagtaacgcttttctagccgcaacatccgaagcggagggagcttactccctccgctttttttggaaataggcgatcaattctcaggatgttttagcatcctgctgaaaacgagcgcttatttctggtgttaagcggtcgttacttgaagttaagtcatctttaggaaaaataggaggtcatttctcttggctaaattaattgtttcagacttagatgttaaggacaaaaaagtcctgatccgcgttgacttcaacgtgccgatcaaagatggtgttatcggtgatgataaccggatcgtggcagcattgccaaccatccagtatgttattgatcatggtggcaaggcaatcctcttgtcacatctcggccgtgtcaagaccgaagaagacaaggctaagctgaccttgaagccagttgcagaacgtttgagtgaattgctgaagaagccagtgacatttgtcccggcaactcgcggcaaggaacttgaagatgctatcaacaagatgaatgatggcgacgttcttgttatggaaaacacccggtttgaagatcttgacggcaagaaagaatccggcaacgatcctgaacttggcaagtactgggcaagtcttggcgacttattcgttaacgatgcctttgggactgcacaccgcagccatgcttcaaacgtcggcattgcttccaacatgaagcaaactgctgccggcttcttgatggaaaaggaaatcaagttcttaggcgatgccgttgacaacccgaaacacccattcattgctatcttgggtggtgcaaaggtttccgataagatcggcgtgatcgaaaacttggtacctaaggctgataagattcttatcggcggcggcatgacctatactttctacgctgctaagggtatgagcatcggtaagtctttggttgaaaaagacaagatcgaacttgccaagaagatcatggatcaggctggcgacaaactgcttttgccggttgattccgttgttgcaactgaattctctaacgatgccccacataaagttgttgacggcgacattcctgatggctatatggccttggatatcggcccgaagacaatcaaagaattcaaagatgctttgcaaggtgccaagaccgttgtttggaatggcccaatgggtgtcttcgaaatgagcaactatgctgaagggacccttgaagtcggccgtgcccttggcgacttgaaggatgctactacaattatcggcggcggcgattcaacagctgctgctaagcaattgggtattgcacctaagattacccatatttccactggcggtggcgctagccttgaatatcttgaaggcaagaccttgccaggtatcgcagctatttctgacaagtaattgtcaggcatgctgatctaacagtcactaccggcagacggtatctgtcggtacatatgaaaggaagatatgccatgcgtacaccattcattgctggtaactggaaaatgaacaaaaatcctaaggaaacgcaagaattcttagacggcgttaaaggcaagttgcctgatgcaagcaaggttgagactgtcattggtgcacctgccattgatttgaccaccttagttgctggcgctgaaggcacacctttgaagacggcggctgaaaactgctactttgaagacgaaggtgccttcactggtgaaaccagcccgaaagctttgaaagaaatgaacgttgattacgtcattatcggtcacagcgaacgtcggcgctatttccacgaaaccgatgaagatatcaataagaaggctaaggccatctttaagaacaatcttttgccaatcatttgctgcggcgaaagtttggctcagcgcgaagctggccaaaccgaagactgggttgcttcacagattgaagctgctttggccggtttaagtgctgaccaagtcaaagtttcagtcttagcctatgaaccaatctgggctatcgggacaggtaagacggcaactgccgatcaagcacaagaagttgtcgcacatattcgtgcaacggttgagaagttgtataataaagatacggcagatgctgttcgtattctttacggcggctctgttaaaccagcgaacgtcaaggaattaatggctaagcctgatatcgatggcggtttagtcggtggcgcttcgatggatcctaaaagtttcatcgccttggctaactaccaagattaatctgggttctactattaaacagccttctggcaaaaaggagaagaatttatgtctatcattactgatgtattggcacgcgaagtcttagactcccgtggcaaccctactgttgaagttgaattgtacactgaagacggcggctttggccgtgcgttggtaccatcaggtgcttcaaccggtgaacacgaagccgttgaacttcgtgatggtgacaaggatcgttttggcggcaagggtgttttgaaggccgttggtcatgtgaacaacgaaatcgctaaggcggttattggccttgacgtgactgaacaacgcctgattgaccaaaccatgattgaccttgacggtaccccgaacaagggcaagtttggcgccaatgctatcttgggtgtttccttggctgcagcccgtgctgctgctgatgaagttggcctgccattgtatcaatatcttggcggcccgaatgcccacgttctgccaacgccaatgatgaacgtcctcaatggtggtgcacactcaaccaacaccgttgacttccaggaattcatgatcatgcctgtcggcgctaagagcgttcgtgaagctgttcggatgggttcagaaaccttccatgctttacaggcactgttgaagagtaaaggcgacatcaccgctgttggtgatgaaggcggctttgccccgaacttgaaggataacgaagaagccttcgaacttcttgttgaagcaatcaagaaggctggctacaagccaggcgacgacattgctttggcctttgacgttgctgcttcagaaatgtacgatgccgagagcaagacatacacaaccaagtggtctaaccctgacaagaagtacaccactgaagaatggaccgacatgattgatggttacatcaacaagtacccaatcgtttctgttgaagatcctatcgacgaaaacgactgggaaggctggcagacattcaccaagaagatgggcgacaaagtccaaatcgttggtgatgatctgtttgttaccaacaccgactacctgaagaagggtatcgatatgggtgttgctaactccatcctgatcaagctgaaccagatcggtacattgaccgaaaccttcgaagccatcgaaatggctaaagaagctggttacacagctgttgtttcacatcgttccggtgaaactgaagatacaacgattgctgacttggttgttgcaaccaacgctggccagatcaagactggttcaatgagccggacagatcgtatcgctaagtacaaccagttaatgcggatcgaagatcaactgggtgcacaatccttgtacaagggccgcaagtccttctacaatgtgaaagcaattgactaatttgcttaattagttggcagcttggaaagcacgtttccgttaaggagcgtgctttttttgtggagcgtgagctggcgcggttagaaaccagagtgtaagtggccttgaacttaaatggctgggccttagctatttaagttcaaggtccttacatgcaggtttctgcgccagcgagcgcgtttaattgtgcgcgaacaggagcgcttagaagccggaacataagtggcttcgaccaaatggcgtggttttagcgaggtcgcttgggttgaaagaatcagtattttttaatcggtgagactgaatcgcggttgtcgggtgcacctttctgtatactagggataagcacaaatgaaaggacagttttctatgcaaacgacgccacctcattggcaacggaacattgctatctttttgcttggtcaatttctttctggcattaccagtatgacggttcagtatgcgatcatttggtacttaacggctaaaactggttctgcaacgattctcagcattgctactttattaggtatgttgccgacgattttgctgagtccttttgtcgggccttatattgatcgcttgaacaagaaaatgttgttgattgtaccggatattgtcgccgctatggtggcacttattttgagtgccgttggcgagtttggtggtttttttcctgtttggctgatctttgtgtcgttgctggtgcgggcgttggcacaaacattccagatgccgacgattcaggctattttgccaaccatggtacctggtgatcagttgacgcgcgtgaacggtcaactcggtgtggtgaattcggcgaacatgattattgcgccggcactgggagctgtcctttttggcctgatgccgatgccgcttttgattttgttagatgttttaggtgcgattctaggagtcagcttgctgttgttcgttagtattccagaaaatcgtttggtcgggacaactgtccatgttgcgcaggatgccaaggttggttggcatttgttgcgaggcaatcgtggcctgtggtatatgactctaattggtatgttgacgacgtttgccttcatgccagccgctagtatgtatcctttaatgaccatgcgttattttcatggcactgtcggtcaagctgggttgattgaagttgtttattttgctgggtcgctacttggtggattgctcattagcgtctttggccattttcgtgatcgtattcatccgattgtctgggggatggtggtcattggcgtgacgtttggattaagtggtgttttgccacgaactgaaaatggctttttatggtttcttatcttgaatggcgttgctggcttagcttggccgtttttcaacacgcctttgatcgcgatgtatcagcaaagctatgctcctgagacgctcgggcgggttatggggattttgaatgcactaatgagtttgccagggccggtcggcttgatttttgctggtcccatcgctgatcgctttggtgtcgcaactttatttgtagttgcagggatcggcgtgttactggccgctggcgttatgttcggtttgaagatcacccgtgaatatgaccgccagttgcaagcagacgggtcatcagatttgactaaaaggggatagatcatttgaaaaaatttttcaccgtgtttgcttggctagaagttgttttaggattgacgatgttatggatgacgtgggatgtgggcttgcgagcatctggccagatttttggcgccttagttgttttaatcgggattgtgcttttatacgggttgatcatttatgcgttgattggctggttcatggatcctgcgcaccgttactggtatgtgctgacactggtgctaactttgctgtacaacgtgttagcctggacctttcccagcgtcatgatccaaacatgggccacatatccatttccgcttatcactttgttaatcggtgtaatgttggtttgggtggctcggcaagaaaaacaataattggttttgctgactcgggtgactgagtcgtttttgattcccagccagaggtatatactgagatcatgttgtactggaggggaattacttggcacgacctgtaaaagaaaaatttgacgttactcgcctgcgatttgtgctactcggactactcgttggtttaatgagcggcactgttgtcagcgcgtttcgctattgtattgaggtagggctgcgctatagtcggctggtatatgggcacttgcgaatagcaccgtttgtctggtggcaatgggcgttgttgatcggtgtcaatcttggtttggcgttgatcgtggcgtggcttctcaagaaagagacctatatttctggctctgggattccgcaagttgaaggccaattggctggtgaattggaaatgcactggtggtcgatcctctggcgaaaatttgtcggcggtgttctggcgctggggcctgggttgtttctcggacgggaaggaccgtcgattcagttaggcgcttcagtcgggcaaggtttagctgctgggttcaagctatcaggaactgatcggcgattgttaattgcatccggttctgctgctggcttggcggcggcatttaatgcacccattgctgggaccttgtttgtcttagaagaggtttatcataatttctcaccgcttgtttggttaacggcattggctggggcaattggatcggattttgtttcactgaatgttttcggacttgttccggtgctgcatttaagctattcgcgtagtttacctgtatcgagttattggcatttaattttgctaggcattcttttgggcttgtttgggtacttataccagcgaatcttgttggtgatgccgcggtggtatcgcaacttgacacatttaccgcggccgttacaaggcattgtaccgtttctgctggtgattctggttggctattttgcaccaaacttacttggtggtggcaatggtttgattgtcggttttggccagtatgtgccatctttgcttgtattgatcgcaatttttgttgtacgtttcgttttttcaatgatttcatatggttctggattaccaggtggcatttttctgccgattctttctttgggtgccgtgattggtgccatttatggcgtcttcatgaatcaactcggcttattgccgcacgtctatatcatgaacttaatcattttttcaatggccggttactttgctggcattgggaaagcaccgtttactgcgattctattggtaacggagatggttggtaatttgacgcatttgatgccgttagcggtcctatcattaactgcttatctcgtggttgatttgcttggcggtgcgccgatctacgaagcgttactcgagcaaatgacaatgccgaaaacagttcagcagcttcatcgacccgaccgactggaaataccggttttcttcggcagtcccttgaatggcaaaatggtccgcgatatgccatggcctaaagaagcattactaatcggaatccggcgtggcgaacaggaagtgattccacatggtgattccttgatccgtgaaggtgatacgttggtgctgttaacggatgcgacccaacgtgctcgggtcaagcggcggattgatgcgctatcggcggcgttggggaaaacgcaccaaaactcatgagcaagttatctgtcaggacgttgacgtgctactattgtgagttattttacttgctgtgagacggttcaagtagctaaaaaggtggatttcagcaaagatgcctcttttaggtagaatgcgttcgcctttatgttgcttttatgctaaactactagggtgagatttttcgcaagggaggcaacaacttgcaaagtttattgaccacatttcttgtgatcgattcgattttgatcgtgatcgcaacattaatgcaaccaagcaaacaacaagatgcgttaagcgcattgtccggtggggcaacagatcttttcgggaagacgaaatcccgcggcttcgaagctttcatggagaaagtcaccgttgtactaggtgttattttcttcggcctcgcaatcgcgctggtatatctggaagcccattaacgaaagtctcctggtactcaggagactttttttgcagagcgttcattggcccggtttctgggccaggaaacgcgtttcgacagcaactgcggtggaatagctaaccatatgacaaggctgactttatccgccaatagacaagacctacaaccgttttttcaccgcaatatcgagccttttcaccaagagattgaagttccacttgtccacccagccacttgccacaaaggatgaaacccatcatgatctttcgtgaaccgcaaccattcgaatacgagggcactgataccggtgttgttttgctgcatgcctatactggcagcccaaacgacatgaacttcatggggcgggccttgcagcgggctgggtatggcgtgtatgcgccgttgttcacgggacatggtaccattgagccaatggatattctgactaagggcaacccagatatttggtgggcagaggccagcgcggctgtttcgcatatgacagcaaagtatgaccgtgtttttgtttttggattatcactcggcggtattttcgccatgaaagctttgaaaatattacccggtgtcacagctggcggcgttttttcatcgccgatcttaccgggtaagcaccatctcgtgccagggtttctgaaatacgcacaatatatgaatcgtttggcaggtgtaccagacgaaagtactcagattttggcttacttaccaggccagctggcggcgattgacaatttcgccactggggttgccgctgatctgtatttagttaataagccgatttttatcggccaagccggtgctgatgaattagttgatgggcagctggcctatcagctacgggatgcactcatcaatgcaccgcaagtagattttcattggtatgacaatgccaagcatgtgatcaccgtgaattcggcgcatcacgcactacaacaagacgttatcgcatttatgcaacaagaaaacgagggatagcatgaccacagttggccatattcgtaatgaacttttagcaacatttcgtaaaaatccgaagattgattattcggtccagacgctgagccgtgccttgaaattaaacgaaggcactgattttaaaacgctggttcaagccttaactggtatggaaaatgacaatttaatccatcccattagtgaaggccgttatgcttggggcggcacgcctaaagtgttgacaggtattttccatggcaatgaaaaaggttttggtttcgttgcgattgaagatcaggacaatgatgtttatgtgccgtcaacgagcactgattttgctttggacggtgataccgttgaagtccgtatcgtccgtgaagcactcccaaacgatacgcgtggaccagaaggcgaaatcactaaggttgttgaacgcagcctaacgacacttgtaggcgaattcaaaccattttccgacaaagatcgggccaagtctggttttattggtatggttgtcagccacgagaagaaactgaagaattttccggtttatgtcaaagacactggtaccatgccgcaattaggcgacatgacggttaccgagattacggaatttcctaatgaacaccatccgaagctgatgtatggcatggtggttgaaacattgggaaataagaatgatcccggtgtggatattatgtcattagtgatgcaaaaccatatcaagactgagtttcctgatgaggtaatgactcaaactaatgatatcccggatcatgtcacccaagaagaacgggtgaaccgtaaagatatcaccgatcaagccgttgtgacgattgacggcgacgacagtaaagacttcgatgatgccgttgtcgtttggaaattgccaaacggaaacttccatcttggtgtgcatattgcagacgtgtcgcactatgttacagaaggctcagccttggacaaagaagcgtttgatcgcgggactagtacgtatctggtcgaccgtgtcattccgatgctgccattccggctgtctaatggcatttgttcgttgaatcctggcgttgatcgcttggcgatgtcttgtgatatggaaattgatcaagatggtcacgtggttaatcacgagatttatcaaagcatcatcaagagccatgcgcggatgacttataacaacgtcaacaagattgtgaccgaccatgacccagaagtgatggccgagtaccaggaacttgtgccgatgtttgaagacatggttcagctgcatcaaattctttacaagatgcggcatgctcgaggtgccattgacttcgaagaaaacgaagccaagatcattgttgatgatatgggtcacccaacagacattgttctgcgtgagcgtggtgtgtcagaacgaatgattgaatccttcatgctggccgctaacgaaaccgtcgctgaacattacaacaagcaacatttaccattcttataccgggttcacgaaacaccagatgccgaccgcattaaagaattcatggaattcattgctagttttggtatcaccgtgccgatgaaaaaaggcaaagaaatcaccccaaagcaacttcaggatgttgtgacagatgtcaccggcacgcctgaagaagcaatggtgagcgttaaaatgctgcggagtttaaaacaggctcggtattcaccagatccacttggacattttggcttggcagcaaagtattactgccactttaccagtccaattcggcgttatcctgacttggtcgctcatcgcttgattcgtgattatgcggttgaaggcactggcgacgatatcaaggcaagctggaataagaaattaccagatattgcagctcaggcatccatggcggaacggcggagcattgacgctgagcgtgcagttgacgatcttaagaaagctgaatttatggctgataaggtcggcgaagaatttgatgctgttgttagcggcgtgacgagctttgggatgtttgtggctttgccgaacaccgtagaagggcttgttcatatcacgcggatgaccgatgattattattcattcatcgatagtcagatggctttagttggcgaacgcaccaagcgcacgtatcgaattggccagtctttgcgagttaaacttgataatgttgatattgatcaacgacaggtagacttttcattgattcctgatgaaaatacgccaacaagtgatctgggcaagttcgtcaaaaaagaagaccggcgtgaacgtcggccaaatggcaacaagcctggttttggcaataataaccatggtgggccaaatcgtaatcaacacaacaatcgaccacgcaaaccagctggtgcgccacatcaaggcaagcactataatgccaagcgcggcactaaataacgctggcaacttttgaaagggggatggttcaatggcgaagaaacatcgacaaaaacctgacaacctgctcgcccagaataaaaaggccggtcatgattacaacattcttgatacctacgaagccggtattgcgctgacaggtaccgaaatcaaatccgtgcgtgatggcaaacttaatttacgtgacggttttgcccgaattcggaataatgaggcgtggttagaaaacgtccacattagtccgtataaagagggcaatttattcaacgttgacccaatgcgtaatcgcaagctgctcttgcacaaacgagaaattcgcaagttaggtcaaatgacagcgcgccaaggtgtcacgcttgtgccgttgcggatgtatctaaaacacggctatgccaaggttctgattggtgtggctgaagggaagcataactacgacaaacgtgaaaccttaaagcgcaaggatcaggaacgcgaggttcagcgcgctttgaaggcacggtattaaacgcccagtggcattaagctaatgctgatctgagcatcaaaaatcaatcttctagcttgtccatcagcaatatcatgatgtcgctgatgtgcaggttaggtgacgttatgccaactgagttttatcagtaaagagcatcgggagaaacctgatgctctttttgttttgctatcatttatttctaaacaagctaaagtgttgatgttatataaataattacactattgattgactaatgatttatttttcattgttttgcttatttatttatataaaatggcgatttttccttctaaggttttacttaagtaagaactaatataaaatagggcaaggagactgtcgttagtcaatgcctttgtcgacgaacttcagttgaggagggaggatagcatttgtggtcacactgtctgatgtcgcgaaagaagccaatgtttcaaaaatgaccgtgtcccgtgtcatcaatcatcctgagcaagtgacgcctgagttaaaacaactcgtcgaacaagcaatggcgattttgcattatcgacctaactctgcagcgaaggctttggccaataatcggactaacgttatcaagtttttgattcttgaagatgtggatacgaccgaaccttattacatgacgttgctattcggcattgcccgaggacttgatcgtcagcagtatgctttgcaattagtgacagattgcgagcatcttgatttggatcacgccgatgggtacattattacgggtgcgcggtcgactgattgtcaatggattgatcagttagcgaaaccggttgttttatttggggaaaatcgtcatggttatgattttattgatacggacaataaattaggcgaacaacaagcaaccgaatatgcgctggccaagaattatcaatcgattatttttcttggtattgatgtgagagaaccgtttgaatattcgcgtgaagcagggtatatcaatactttgcagagacatcaaaaagtaccgcagattcatcgaatgggtaatcatagtcacgaatcgcaacattttatcagtgaaaattggcgaaagttcgcgcgaaatactgttttcatctgtgcaagtgatcgcctcgcgttaggtgcggtcagagcgattcaacaaaatggtgggcgaattccaaccgactttggcgtcatcggatttgatggcgtttttctggatcaagtttcaaatccaaaattaaccaccgtgaaacaaccggtggtgcaacttggtgaactattagcacggatgctcttgcaaaaaatcgcccagtcaggcgcacaacaaggtgaactactggtgccgccaaaattagtgcttcgcgggacgatacgcacttaggtgattatagaattccgatctggcaaaatgagtttgtctactgataggtcggggtaacattcacagttatcaaacaggccaacaattttccgctgggaaattgttggcttttcttcacttcattttgataacggtaacaaacgcagttaacttgtatcatgcgtgcgctttcactatgctagttggaaaagggggcgggtcacatgagcacttggtatgatcaggcgattatttatcaaatttatccgaagtcatttcaggacagtgatggcgacggtattggggatcttaacggcattcggcaacgcataccgtatctgcaggacttaggcatcaacgccgtttggctgaatcctgtgtttgtatcaccgcaagtcgataatgggtatgatgtcgccaactattacgcgattgatgagcgaatgggaacgatggccgatatgcaggctttgattcatgaacttcatgaagcgggtatccgtatcatcttggattttgttttgaaccacacatcggatcagcacccgtggtttcaagatgcaagccggaatgtaaaaagtatttatcgtgattattatattttttctggacatcatcataaaagaccaaataattggggaagcttcttcggcggctcggtttggtcgcctgatccagccggtaccggtcaatcctatttccatttatttgatcagcacatgccggatttgaattgggccaatgccgaggttcggcgtgtaatgggggatgttgctgaattttggctaaacaagggaattgatgggttgcggcttgacgcgtttattcatattgccaaagttgatctggcgcaaaactatccaacgtcggaaagccaacaagagcctgtgattgcagaaccgttttttgctaatctgcccaatgttcagcggtggttgcggcccttctgtgctcagatcaaggcagattttccaaatacctttatacttggggaagcggcaagtgcaaatgtcaatcttgctgttgactacacaagccagcataacaaattgatggatagtgtgattactttccgatattttaccgaagatacaacgcaacttgacaccagcatcccagcgcagtatcagccgaaacctttggattttgcaaagtttaaacagacacaggttgtttggcagcaaacacttgctggtgtgtcgttgccgacgctttattggggcaatcatgatatggctcgtctggctacgcgcgttgcccattcagcgattcaggcgagaagtctggcagtgctgatgtatttacaacgcggtattccaatcatctattacggtgaagagctagggcttgaaaatctcacgttgcctgatgcgaaagctttttccgatccaagcgtcccgcgcttcattgcagcagctgtggacgcagggtatacccaagaggcggcgttagcgatggtcaatgcgacccataagttgccagcgagagggccgatgacgtgggatgcgacaaccaatagtggctttacgagcggcacgccttggctggttggcaagcgcagcagccgcacgcatgttgccgaacaacaacatgatccgcacagcagccttgcattttacaagcaattgattgctttaaagaaacggtcggtctttcaaacaggcagttttcgactgttgagcacggggccagacagctatgtgtatcttcgccagacagacaaggcgattgccgttgtggcggttgctttgagtgataaaacagtcaaccttagattgccagccggtgactatcaagcggtgctaattgtcggtgacgcgacactgagcgaagaaacactgacactatcagccgattcagcagcagtattcattcaggaaaaggagcgcgctaagccatgaatttagcagctatgtctcatcgaccagaaagtgaagattgtttcttatataccaataaaaagctacgtttgcggttccatacggcacaaaacgatgtcgccaaggtggttgttttgtatggtgatccttactggcaagagcttgatcagcatcaacaatatcggttgagttatcagcgcaaaccgatgagtcagctagggacaggtcaaattgctgatcattggggagtgaccttggaggcgccttatcaacgtctgcagtacctgtttgaagtgaccgggcaggacggtagcaaatggttatttggtgatcggggattgcgaaaagacacagagtccgcgcgaattgataccgacaattattttcgcgtgccgtattttcacgagattgatcgggtgaaaacgcctgattgggtgaaagaaaccgtttggtaccaaattttcccggaaagatttgccaacggtgatagcacaaatgatcctgttggcacgaaaccttggcgaccgtctgatcatcctggacgtgatgattactatggtggtgatttacagggggtcttggatcacttagatgatttgcaagcattgggtgtcaatggtctgtacttttgtcctatctttaccgcgagttcaaaccataaatatgacaccattgattatttaacgattgatccggatttcggtgataagacactgtttgccaagttggttaatgaagcccataaacgcgggatgcgcgtcatgctggatgccgtgtttaaccacatgggctttgctagcatgcagtggcaggatgtcttagcaaatggcaaaaaatcacgctttgcttcgtggttccacattcatgattatccattgacgccatttcataatcccctgaaaggcgagggagcgccacaatacgatacatttgcgtttgagtcgcgaatgccaaagttagatacggccaatccagcggttcaggattatctactgcaagtggcaacttattggattcaagcatttgatattgatgcctggcgtttagatgtggcgaacgaagttgatcatcatttttggaaaagattttacagcgctgtcaccgccattaaaccggatttttatattttgggcgaggtttggcatagcagtcaaccttggttaaatggcgatgaattttccggtgttatgaattatgccttcacgcagcaaatagaggaccactttttgaccggtaagcagacagctgcggggatgaccgctttgttaacggaccaattgatgctttaccgcgatcagacgaatcaagtgatgttaaatatgttagattcgcacgatacaccgcggttgttaacggtagcaggtgatgacattgagctagcgttgcaagcattgacctttgcttttcttcagacaggtacgccatgtctttattatggaactgagatgggcatggatggggaaaatgatcctaatgatcgaaaaccaatggattggacaaaattaggtcagccaatttggcaacgggtggcgaagctcatcggctttcgtcgtgaacatgcggctacccttgggcgtggtacgaccaaattagaagtgacaccttctggattaattaaggttgtgcgccacggccgtgaaacgctgacggcatatttcaataccacagcgtcatcggttcctttgacggcggcacctgttttgcatcaagggtttgctcaaaatgagttagctccaaaaggatttgttgtagcagtaaactaattatgatagcggtaacattcattttgcgattgtatagcgctttcggtactatcccctgtcaagttgacacttataaaaacgaaaacacaatttttctggacctcaagcacaatgacaaagtacggtcatcgcacttgaggccacttatgctccggtttctaaccgcgcctgcttacgctctccgcctaaagtccagtgactttccaaaataagtgcggtatatttaacgcggagtgaataattgaaacgctttaaggcttcaaggagggcaatatgaaaaaagcatgggtttacgggttagctgccatgcttggcttgggtgtatcagcggtgattgctaatcaggcatcagcttccgcagcaacaatgccgattgtgattcaatcagcgacatcgaaatgcgacactggttctgcgccggatcatggggcatcacaatcagcgatcgtaccaccgcttgctgacaacaaggttgaagtaccaattgtcacggttgcaagcgatgatgatcaaaaggcgggcaataccagcagtgcggatagttcatcggtttcatcgagtcagcaaaatggggcagcaacatcggacacaggtgcggaaactgtgggcagtcaagcacctgtcacaaacgggaatgttacatcgtcagcaaccgcgcagcaagatgatcgtgatgcacacccgtcagtttctgaaccaatgattaaaacggcacaagaagttaatgcgacagaagcaagctcgtctaaagcaccgacgagtaaagagcgggatgaacaggcaattgttgctgcagcgcaagcggcaacacatgataatgtgaaatcaggccgcacaatatctgtggtcccggagagtgtgacttcttttatcggttcaacccataagcagccgcagaatgcttttgagattatttggcaggcgttgattgagactgttcagatgcgacagcaatgcccaacggatctgattgatgatttggttttgggaatgccgcaaccaaattttgacgttgtgcaatcgacatttatcgcaacgaaaagggaactcagcaagacgttttcttcgcctgtttttgggaagtcccttcaactagatagcctgtcgccgttcaatcaggtttttggcaagatgatcaacttgatcgatcaagtgttgttgacacatcttgttttctcagattaacttacttaaatagttccgtgatggtgaatgaaaggcgactaaatttgtcaacgggttcttcttactcagaggggagcccgttttttgatggcactgacacgttttttgaatggccccaaaacttgatgaccgtaaaaaaagcctatctcttcagtattcgttacaaacacgaagaggcatagacttttcagaaataacagctgatcaagcggtatgcgcgattgtcaggcatttccggcttttgggttgatcggctattgttttggtcacttttaattttcttcggcacctaatttggcgacagcaacggcttttcgaactttgaccgcgtgtgccacgaggccgacagccagaccaacaccagccggaactaaccagccaaggcccatgccagcaaacggcaagaaatgtaattggaaactgtgcaatgccagaccaagcgcactttgactgacaaaggctggaaaggcagcgaacatgtcgagaacggctgggactgcggtgaagccgacgacgaaccgatacaccagtggatcatgatggaatgctttgccgaaaacggaaaggagaatcaataccattgagaaaggatagaggaacatcagcatcgggacagaccaagtgatgatttgctccaaaccaaagttcgccgttaagaaggatagaaaactggtcagtgccaaccagacacgataactgacctttggaaaatgacgatggaaatcttgtgcaaatgcagcaaccaagccaactgcagtggtgaggcaggtcaacgtcaacaatgttgccagaaccgcatgaccagcagcgccgaagtaataggttacaacttggttaaaagcagtcccaccttcagggctaagtttgaagtgagccaatgacatgctgccgagcaggattaaggcaacatagatcagaccaatccagctagttgccatcacgcctgctttggcggtcgacttggccacatcgtcatcattttttaagccgagacagcgaacagctgtgaccacggtaacgccaaaggctaaggcagccaaagcatccatcgtgttgtacccttgtaggaaaccattcatgaagctggcatttttataagctgctgtgacagtttgggttgctggatttcccattggatgggagaaaccaataaagaagacgaagaatagcaagacaaggaaaactggattgagaattttgccaacagccgttgtgattttgcgttccttgtaggataggaaaaaggcggcggcaaagaataaggccgagaagaccagcagaccaacctgcgcccacgcttttggcagcatcggcaagacgccggttgtaaaggacacggttgcggtccgcggtgtaccgaacatcgggccaatggtagcgtgaattaaaaccatgaaagcaagagcgaaaaagcggccaagtggacgaccaatatcatacacaccttctgcatgcgtagcggcaatcgccaacacgccgagcagcggcaatgcaaccgctgtgactaagaagccaagcattgctgaaaaccagttggcaccagcgagttgaccgaggtgcagtggaaaaattaaattgccagcgccgaagaagagaccaaacaaaagcgatgcaatgacgacataatcgcgggttttgagcttcttttcagataattccatttgagttcctccagtgtttttagatgtatcattgattcattaatttggcagctaatgtggctaatgtcagattccaattgcatcacatccttcaatggtttgagttacatgtttgctaggcgaaaattcaagcttggggaagcgcttctgctcgcgctccgctataacgcgttcgtcagcccagaaacctgcggccaaggcccttacactccggtttctaaccgggttgactcacgctcacacaaaaaagtcgcccttagatttttctaagggcgactttgcgcggtaccaccttaattcaccaaagccagctgagccttggtcttcatcgcatacggtccaatgacgatatgctagcactgtaatgggtgcccccatgacacgttactgaagttcggtgtcctgcttgaaagggatattcgccatatcatgaatgcttcctcacaccaaccgaagctcgctgtattcacagacacgggtacttgtctttcgcgttgcatttatatttgatttttagtttagcatggattgttttcttgtcaataactaattgaaatttaatcaaaaaaagcttttgtccgatttgcgtaaaaaatggcacaagaagttttcttcacaatgttgaagctgattgaataaataaacttatttgataaatcaatattagctgaaacttgcaagcctatcgagttaattatattgatcattattgggtcagttaacgagtttttaagaaaaatgattttttaattttaaatatgacttgaatggaaagcgcagagtgattaaagcaaaaatgtgaaaccgctaacaatcactatataaataactaagtaaattacaagtgctaatgtggtgcataaagagctatttatatgccataaaactatcagtaggagaaaattgaagccgagtcatatacaaaacccgatattaaagggatctgcgccagctctaattcattgattcttctcgctcaatcctgtattatgagtagtatagagagagataaatgaatttcaataacgatatggaggcaaaaagtgatgaaaaaagttaactatattgcagccggaatttccgcattaacaattgctggactcctgttgccaactggccaagttttcgctgctgatattaacaaaacatctgcggccgagattaacattacccctggagaaatcattctagacaaggtcccagacttgaactttgacaagattccaattgctgacttgctggcgggcaacgtagacaagccgctggttgataatacggttggcaacggaccagtgaagaatgcaacggaagccaaggatggtaacgccactggcgacctgagtatcattgataatcgcggtacgaacgctggttggacgttgtctgcacagctaggtcagatgaaaaatgatacaggcaagacactaagcggctcattgacgcttaagggtgcaagtcttacgacagataaccctgattatgatcaggcacttaatcctactgttgcgcaaactctgaatatcggtggtgacgcagttccgatctggaatgctgcagccgggactagtacaacagacggtcaaggacaaggtaaaaacaacgcgttgattaaggatgcaagtacaatcctgcatcttaccaagaacgctgctgtcacagctggcaaataccaagcggccatcacctggactttagccgacgcacctaagtaatctatggcacctaaactaaggggcagcggtcattcgctgcccttttcatgactgtgggggcggaaccatgaaaaagaaaatcattttcagcctgttggcaattctgagcttgttgtggttcggcggtgcccatcaggttcaggcagctgaaggcgctggctttactatcagaccggcgttgccgcaaaatcaaattgatcaatcaacctattttaatttgctggtaaaacccggcgagacccagcggctgttgatttatgttaagaacacaacaaaaagtgctaaaaagttgaaggtcagtgcggtcagtgcgttcactcaaagtaatggtacgttaggctattacccaaataaacacacagacaagtccgctgagtacactttttccgggctgacggaagcgcctaaaacaattgatgttggtgctgaggcacaagtgccagtcacgtttgatgtgaagattcctgaaaagggtttcaccggtcaaattctcggcagtttatacgttgaagatcccacggtgcataaaagcggcggcagtggcatggcgattaacaacaagttcgccatgcttgtcggagttgttttgcagacttcggaggccaaggtggcaccagaattgaagctgatggatgtcaaaccgggcactcaggataatcaggccagcgtcttagccaccattcagaatatcaaacctcgtttatttggcgagataacacttgatggcaaagtttatcggcaaggctcaaaagacccttacctgacacgttcggaaaaagggtggtcatttgcccaaaactcgcattttgactacgccattttctccaaagaggcactggcaccgggcacctatacgcttgatttaacagtcaaaggtgctgacaaaacttggcattggcgccggaactttacgattacgcagcagcaggcggatgtcattgaagaaaaactgggacgtgccccacaaacccctcggctgtggattatcattgcgatcatactggcgcttgtgatcttgatcctgctgtggttaatttggcgccaacgacgcaaaaggagggagaccgatgagacgaaacaagcctagtttttggatcatgctgctcatgacaatgagtctcatggtcggcgttggcgcgaaggctcagcaagttcaggcagacacttctgttgcacaagttgaacttgttggtgaacttccgtcaacgaaccctgatcctaacccaacgccaacccctgatccgacaccaacgccagaaccggttgatcatcaaaccgctgatcagcatggtcaagccacgccgctaacccatacaggctatctgccgcaaaccggcaatgctgttcaactttggtacgtggtcattggggttgaacttctgattattgtcattttaggcatcgtgttactacgcggccgatcacggcagggaggtaaaaaatgaaaaagaaaacctttatcatgatttgcctcacggtgatcttcggcatggtgcttggtccgctgcagtcagtggctgcagcggaggcaacttggccgagtggcacgtatcccgctccagcaacaggaagttttacccgattgaatggtctttttgatcgggtgtcgacagattcgagcccaattaaaagcggcacagatgaagtcggctttgaactgaatgcggatcaagcaagcaaggtcggttctgtttggagcaagacgccttttgttgatctaagcaaagataaattcacattggacatgcaaatttatttaggtaataaaactggtggtgcagacgggcttgcttttgcgttggccggtaccaaacccacaaaatcaggaaatggtggtgcatcattggggatttggggtttgccagaaatgtcaagcggtgctagttccgcttctgtagccgcaacaggaacccaaaaaagttttgccgttgttgttgacaaaaaaaaacctttgactcagtgagaagcgggatggacaaggccatcaattatccaatctttgggtcaactgatcagtatatcggttctggttatcctggtcaggcgggtatgtataagactggtggtccgttttggcggacagagttggtttttacggattccggaacaggacttaaaaaccgcgctgattacctgagcaatcgggtcactaatggaagctggtctaacttagttgttagctgggcaaaatctgctaatggtggcaccttgacgtatcagttaaaaggtacaaatatcagttactcgattccttggacgaatgcacaaatccagtaaatcttcggcagcacgaaacttttcttgggtttcacgagcgcgacgggggccgcatcagagccccacgttgttggcatcaagagcttagctgacttcaatacagttagcggaacggttaccttgaaacaaggtaatgatcctgtcactattgataaacccttaaacatcggcgataagttgatgtatgagtacgcgcttgatgtgaataatattgatggtcgtccgtggaaggctacaaatatcgtcttgccaaaaggagaatatctcgattacttgaattcaggcggagctccagcaaaacccggcgataatttggcagttaatgtgacgatcggttctgagacgaagacagcacatgcgattgttcaaagcgacaatctctcggccgttattaccgatatgcctgaatttcctaacaacacagaatcgcttgttaaatttagcctgcctgtgcaggtgcaaaagcataacgctaccaccattaagtatgtgactcatgctgcaggtaatctaacaggtggtgcaccaagtaatagttacaaattaacaaacacggttgataattccgacagcgttaaatatagtattgccgcctttgatccaggcaaactgtccttactggttgtgccaaacttttattttcaaaaacttaaagtgggggaaccggagccagttgatccggaagtagcagatgttattgcaggtattcctggtcaaggcaaactgaattctagctcagaaatagcacccgataaatggctcatcaataactcacagaatgtctctgcacttggcaagtaccttgaagtcaaagacacacgtccagataaaccaggctggcgtttgtcgatgaaactgtcaccattcacacatgctgatgattatgttcttggcgataatggcgacaagggcggtggggaagctgagatggtgctgtttgatgtcaatagccaaacagatttcgaagtgactaggattaaggataataaccaagatagtgttgtgaaggtaatgcaggcagggacgaccgaaccaaattggtcacttggtgatgccgcatccagtacgcaagcactgctgtctgtacagagaacgccttctgtacatgcgggcaagtacagttccactgcaacatggacgttagcaaacgtcccgcagtaatagcgaaataagtcaaaaaattcaagatctccttgaaatgaagcaaccatgagaatatgatgtgcttatctcttagattaaaggcgagtcagtcatgagcacagacaaaggggtcttaggatgaagaagaatcggatggtttcgcacacactcatcaccatggcggtagcggttttggccgtgatttccgagatgccaattcatgttttgatcgccggattcagcagattaggctgatgccattagcaggtgtcagttgactgtttaatgagctatacaaggaagtcgcttcttttcggagaagcggctttttgatttgcctagaataaagttgcgagtgtgaagatcgtccaagtagcaaagcaaaggaaaattgcttgccatggtcaatctttcgtggctagatcaaatgtttcagtgcaaactagaagttttataagcctgaaaaactgtaaaaaagtagcatactatcctaaaacgcccatgaggtcaaaaagtcatattattaattcaaattattgattaaaggctgataatacgggacttgcaatcgtgatttataagtttaataaatggccatttttgagatggatacaccgtttgaaaatttattatcactgtgtaaataacgagtaattattaatttggatcatctgttatgtcggaacgcatagcatatctaacgaaacagaaatgagaaaaataacgttgaatacgtttacttaatagagaattatggttatatgaggactatatagttgatatataaaaaatgttcgtatactattagtattgtaataaggaattaaagcatattttaaaagcaggaggataaaataatgaaaagagttaactacatgtctgctggtttaatagcaatgacatttgcaggggtcatgctgccaatcacaagtgtctttgccgcagacgaaccaatcaagaaaacctctgttggtgaagttcgagttggggttgatccagataatcctgatcctaacaatccggacaatcctgatgggtctaaggatattttgtcattggtcaaggtgccagatctgaagttcaagagtgtcagtgttgagcaactggcaactgggcagcaaacattgccgctcacaagcaacacagttactgacaaaccggttaagaacgaaccagcaggaaatgccagcgatgggaataatcaaggtttgttaaatatcactgattatcgcggcaccggtgccggttggaagttggaagctcaggcgggcgaactcaagaatgcggcaggacaaaaactggctggtagtcttttgctagctggggttgcgaaaaccgacgagactgataataatccaactgctattagtcaggctgagttggtcttggaaggcagcggggtgcaggtatggaatgccgcgagtggtcaaggccaaggccgcaacacaggtgtctttacttcggcagataccgtgttgaaactatctcaaaacacggctgcatacggtggcaagtatcaaacggctatcacttggacgctgaccaacgcaccgtcttaatggatcgcatatcaccagaaagggggcagcgatcgcacgctgacccctttttgaagaaacgtgctttgaatcgactacgggtgctgcgctgctactgggttgatcagatgaagttttcggaatggcaaatgtagggaaaagcggagaccgatgacacgaagtatatggcgctttttgatcagtttgatcattgtgttcggcgtcctcggtgaagggatcatggccgctcagcaagtgcgagcggcgacctccatcggtgaagtcgtcgtgattgacgatcggccaaaacccgacaaggatcataatgcaccaggaacagaagtatcaaaaccaaaggaagagccttcggtaccgccacgccaacaggttgatcgtttgccacagaccagcgaaggcggacaaacatggtatccgctgatcggttttgcactcctgatgatgagcagtttgcgtcttcaactgcggcttaaacgacaagacaggggggacgatgatgaaaatcgtgactaatttcgccatcgcttttgtcaccctgatgcttgcaggtttcgtcgggccgcaccagtcggttatggccgcagatgatctaggcccaaaaaagtccagtgctcaattgacggttgatgctggcaatatcatgattcagcaggtgccggatttgaattttggcggtatttctgttcatgaaatcgtgagtgggtcctttcagcggcatccgttgaaaagcaatctggtgaatccgggaccgattaagacggcaacgaatgccaatgacggcaatgcgactggactattacaaattgctgattatcggggcaccggggctgggtggcgacttgaagcaaaaatggacgcgatgacggatggcaaagggcatttcttagcggggtatgttgatttggttgggtcacagcttgccacgagcaatcccgatatcaattcgattaatcctgccggcagcaatgtgccgcggctgaattttgccaaagacaacacctctgtgagttcaaccgttgtttggcaggccgatgctgagacgggggctaagccgggacaaggacaaggcgataatcaggccacaattggtaccggaacggcactgacgttagtggcgacaaacaccaacgtcaccattgccaagggcaggtatcaaggcgccattacttggacactgagcaatgcaccaaagggttagaacaaacttttgaggactaacttttgggggagccggaagtgagatgggtggacctgattactcgctgaagactgtagcgaaaaatgaggtgcaattgattttcaagtgcggttaggtgtcaatgccaccttgcaaccggactacttgcgaaaggaggcgttctgatgaaaaaacgatgctatctgctagcttgtctcgccatgctgttgtgtaccctgctggcgcctgtgacgagtgttggcgcggccgtcacgtggccgacgacttccggctatccagcaccgccgtcatttggtgacgtggacggcctcttttcaccaacgatgggtgactcaagtttattgacggatccgaccaacggacatgcagtcgggcttgagattaacaaggatcaagcaaatcggtcaggagcaatttggagtaaggcgccgatgtttgatttggataaggatagttcgtatacgatgtacttttatatgggcaacaagccaaaaagtggagaaggcatggcctttgtgcttgctgcgaaaccagcggcccccacaaaggttgatactgggtcgttaggcgtttggggggttgaccatcttccgcctaatagtaagccgcaagaagtcgccgatacagcgttacccaatagttttgccatggtggtggatacacaaaaaaatgggacaggggatcccggcggttatgaacaactgagtgattttaagtcttattactttggtactggttatccaggacaagcaaatatgtaccgaattgactatccttattggatgacttggctgtattttaagatcgacaatccagctgaacaataccgctttggactgggaacgcagaagaatttatatgatacaccagccaatggcaaatggcataaactgcaacttgactggaaaaaagataacctcggtggcggcacattaaccgcaaaaatgacgatcactcgcacaaaagatccagactatgccacagaggtgattaagtggaccaaaaatgatattcaaaaatacttttcacaaggttcaaccgatcccgcgccgagaaagttgtatctaggttttaccggcacgacaagtaacgtttttgagccgcatgtcgtcgcaatcggcgccatgcctgaagccgcgaccgtaaatggcacagtcgccttgatgcgcggagccgaaacggtagaggcaacaactcatctaaaagtggacgatgtgctgcactatgattacaccgtgaacgtgaaggcaaccagtcaggcaccctggccggaaagcgggacagtaatgatgaacgtgccaaaaggaaaatattttgactatctgaaggctgatgggacgcccgccaaaccgggcgatacgttgcctatcaaagtcacgataggcaatacggattatcaggcgcaggggaagattcaaccagacggcaatcagattgttgtcaccaatatgcctcaggtgccaaaagggacaacggcaacggtgaagttttcgcttccggccaaagtcaagcatcacggtctggtgcaaacgacaccggttcaggataaaccgattgggacggtcacaggggatggtcaaacgtatgatttgaagacaccagcgggcaaagattttcttgcttatattcttgatcccgaaacaggtgaacttgtgttggagaaagtgccgagttttgtcttcgagttgaagaatggccaaactggttatcgtaatccaaccgtgatggagatggtaaagggactgccaacgccaatggccactaattgggatcaggcgaatgcagatcagtggctgacgaatcagcaaggccgcgaaccgaccaattcgacaggcaaggtgttgagtgtgaaagatacgcggccaaccaagcaaggctggcatttgacgatgcaactatcgccttttacattaactgataatagctatgtgctaggcgataatgggaacaaattaggtggcaaggcaacgttggttctgacagatcagacagcgcaaattgcggctatcaaggataataacaacgcgacaccggtgaaaaatatggcggctggtgggacagattggtcgctaggcactcaaaccggtaatgtagcggcctacctaggcattgaaccaacagcgactgctaaggctggccaatatcaggccacggctacttggctgttgacgaatgcgccgaaatagtaagttgcttgagaaacaacaaaaatggttctgaaacataagactgacttatgtttcggaaccattttttattggctatgatttagttttctgtgaaaattgccgagttaatcgctgctgaacgtggtgaattttgttaaacggcaatgcttgaaggagtgtgttcaaaatgattaagatgccgcctagccactcggccggtccgaacgcgatgtgcaagcgggtgacggctagagtggtggcagtcaacggttcgaaggcactcaacatgcccgtggcgactggcgagatgtagttgaggctgcccaacaccagcaagtaagcgaacatcgtgccgaataccatcacgaaggcaatggcaccaaaatcaggtaaagttagtagcggattgggatgcagcacgtattgcggtaaaaatggcaagctccccaagagcatagaccaaccggtgaccgctcgagcgtcatatttggccagtaacgtgcgcggaagcaacgtgtatagcgcctgactgacacctgccataatgccccagaaaacagcggccggcgcaagacttaaccctgtcagatgaccgcgggtaaccagcaaataggtgccaattagcgccaaagtgatactgacaaagtcaattcgccgcggcatttggtgagttgcaaaagccacataaagcaagatgaaaaccggccccaggaactgcaaaatcgttgctgttgcagcattacctgcattaatcgctaaaaagtaggttagttgtgacggtaccatgcccaaaaaggcgaacacgatcattagtatagcatcgtggcggtttttccaaattgcaaggaacatccgcggttcttgcacgccgctccaaagcaaaagtaggagaccagcgaaaaacaagcgaatgccaaccagccacagcggctttactcccgcatcggtaaatagtgtttgagtgaaaataccgctggcaccccaaaaaatagccccgataacggcgaaagaaacaccttttagtttttggttggtatggcgagcgagatgagcttcagtgcgtggcatggcgggatcctttcgaagtaagactgtccaagccattctacgcaaaaaaactagggttggctagttcgtgcaatatcgatcaagcttcctgatggcgtgtcttgaagttgcgatgcaagtgcctaaaaagaggcagccattcattgaagaatgactgcctctttgactcattcctgagtcgtcttaatttttaattcgtagcgcagattggttcgatagaaatgcccaagcagcatgcctagcgttaatcctaagacaatgagaccgagcgggaaaagccaaccaccgaggaacccgccgatgccgatcacaatcatggcaatgatgacgccaaaaaagatactagcaaagccaagtgcgccaccactaaagttagcattggcggaatacacactagcaaatggaaattgactgccaaccagcggccatcccatcattaacgtcatgccataggtgaaaatgatcacggcaatgccggccaacaaggcatcaaagccgccaagcgcagtggtcaaaatggtaatgaacaatagcggtggtaagaatagtcgggcgaacatggccttgactaccccgcgcagtagcaagccgtgggtcgtaaaaggcacatactggaagattgccatggcttgaggttgactcgaaaaccgcagattaaccaaagcgggagccaacgccacaatgacgccgatgccagcgtaggcaataaaatgcttcgccgagctaaatggcatgtcgcgcagtccaccgccaacaaagatcagcggtagaataatgccataagccaactgcggatagacccgcagtttataatcgcgttcgctgcctagcacacgccaccctaaagtgaagtatgtccgttcttcaccaggacgagtcagcagggcactcacgccgcgaaaccaccaaccaagtttacgcgtgcgggcatcgccttggttcaatttttctagataggcttcaaacacaccagaaaaatgtagaaagacgagggtcaaggcgatcgggacgacgacacttaacgcggtgagcgtcagacttaataccgttacctgtcctgcaaacaacatgggcagaccaacgaaccaagcggggacagctggtaagaaaagccaattaaactgaccgctgatggacatgccgaaaagtgacatggaacgcggcaacaagttaggcagctgaccaccaacgtagataccaatcatcagtaagatctgcactaaattcagcatgttgcgcaatcgttcgccatcaaaaaagcgcaagactagcaagtaaacaaaaagcgccatgaccagacttaacacgccgctcagcagcaaaccgatgagaccgccaagtgccacgactgggccataatggataccggccatgacgagtccaggcccgcccattgccagcaacgtcatgcccagatagaagcaaatattgatcaaccgcgcaaaacttaacgtttgatcattgacgtctcgggaggcaaaaacactccggtcgcggggatcaaggatcaggcttgagtaagtggtcaaaatagcgagaaaactcgtgagtagttgaatcgtcatgaaaagggtaaaggtcgtgagaattgaggtcgggagaaacataagcagccctaaaatcaagccaaagaagagattccataaaaaggcggttttgatacttgcgtcttgaccacgtttgcgtttattgaacatactgcctaagccgctagattcacgagcggccaagagacccttagtcgcaaggattagccgcaattgatcaaactgaataccacgtttttccaataagggcctaaagcgcgcgagccatgcaaatgctttcggcaaaggcaacgcggctgtatcagttggatcagcggtgtctagggacgtctttttaaatagtttcatgggattcaccgccagtcacgatatccacgaaactttgtgccttttgaccgtgttcggcaaagccggttagatcgttgaagagctgttgcaggttggtgtcggcttccttggcaatggacttgaaggggccgtcagcaacgaccataccgtcattcagcacgatgatgcggtctgacaacttctgaacaacatcgagaatatggctggaataaaaaatggttttaccacgatcccgcaaatcctgtagcacttcttcaatgacaagcacggtgttggcatccaggccgtttaacggctcgtcccaaaaaagaatgtcgggattgtgtagcaggctggcgataatcaaaatcagttggcgcatcccttttgaatatgatgaaatgcgccgatcaaaagcctcccgcaaattcacaagatccgccagtgcaaaggccttttgttcagcatcggcagcgctgagtccgtaaagttggccaatcaagcttaaatattcacgagcagtcaaggcgtcaaacacgtcggcactttcaggcacatagccgatccgccgtttataactcgggtcgttgggtttgattggctgaccaaacagctcaatggtgccgccgtctggttgcatcaaaccgagcatcattttaactgtcgtgcttttccctgcaccattaggaccgatgtaaccaacaatgcttcctggagtaatcgtaaagttgagatcttttaaaacctccttgggtccgaaacttttctggatgtggctgagtgttacgattggttctgccatgataggcctcctcttgtagggttgagtaggtacgcgtctaaaaaggtgccagcaagaaatgaaacgcgcttgtctgcatacttctttgggccgattatgacagaaaagattattgttgtatagagaaacaacttttgaataacgctttttggcgacaataaaaaacatcacgaaagacaacgtgatgttaggggactcgctaattcaatggactaggccaaacaagagccaaataaaaaacgaaaaatcggtcagtttgtgaaccgacgaaagagtggccgaagaataaaatataatactggcacgataatggccgttgcaattgagttgatcacggtggcaggcaaactcaggaaggcaccgaccacggctgccttgaaaacgctgccgaccatgagcgcctcaacaaccccagtgagataagaagtgacgatttttgtcaggcctgcgagaataccaattatgatgatattgcgcggttgatcgttatgcttaaaggctttgaccaaagcgctgacaacgatggccatcacaatggcttcaagggcagtcaaccatgaggtagccgcatagccgttcagcagatcaaacccgcccaaaccgatgacagcggccaaaccacctaagcggccacctaggaaaagaatggcaagtaccattaaaggattaccaaagtggatgaatggccgacccaccattgccggaattggaatccgtaagagtgaaatgccaatgaagataatggcagcaaatagaccggtgaaaataatattctttaacgtattatgggatgtttgcatcgtaatcgcctccaaaatattgataataatgcacggtatgtggcagtttatggcagttgtttgcttagcgcaggaatgacgccagccagattcaggccgtactttggatcggcatcagtggcaagcgtggctttgattgcaagccgggcggcaaccatgccagttgcggccgcttgccgcaagttttgaccttttaacaaacccgttgccaaggcagcagcaaaaagatcgccagtgccaaaataatggcccgcttcttttggctgagccaaggccagcgtggtaccggatgcatcgatgccaaccaccgcaatttgtttgtgaaaaggcacgccggtgatgagaacggcgctgtcaaattgggcatgcaggcgtttcgccaaagccgtgacggcagaaggatcgctgagcgttgtcggcttttcatccaaaagcagctgagcttcggtgatgttgggcgtcaagacagttgcccgatgcgccaactgttgcatggtcgccacataagcagcatcaaatcccttgtaaagtttgccgttatcggccatgacgggatcgatcaacacgagcggggcatgaaatttaggcagccaacgatcccattggccggccgccttttgaccaagataaccaaggtaaatgccatcaggctgcagttgcagttgttgccagtgcttgagaatccccggcatttcggcgctaagatcaagataagtattggcgcctagtccgccagtgtgactagacagcagtgcggtaggcaaaacatacggcgtcaaccccagcccagccgctaacggcagcgccacgctcatcgagacttgacccacaccacaaagatcttgactgatgatcagactttttgtgttcacagcacgaatcctttctgaaaagatagttgttaataatgagaatgcgcaattttaggtgtcttgtcaacaagagcgcgaacaggcgcgtttagaaaccggagcataagtggcctcaaacaaaatggccccggcatcgggccgtgaccatttaatagaaagaatcaagctgaattaagcattccgaatcgtctgagtcgcagcagcaatgcgcttgacgacggttggattgtccatcgtgtagatatgaatcccatcaacgccatgcaccagcaaatcgacaatttgatcaatcgcgtaggcaataccagcatcacgcatcgcttctttattgccgggaaaatgctgcatcattgcgacaaattttggtggcaagttgacaccggccatggtggccatccgttcgatttggtgttcattgatcactggcataatgccggcttcgataggcacgttgatcccggctaattgtgctcgttcgcgaaatcgataaaaaacctgattgtcgaagaaaagttgactgatcagttggcttgcgccggagtcgactttttctttgagatggtgaatatcactgaccacatcaggagattcaggatgcttttctggatagcaggctgctactacgttgaagtcgccaacttggtgaatgtgttcgatcagatcacaggcatggggaaaatcgttactaacgcggccgcttttgggtatatcaccgcgtaaagcaagaatgttgtcaatgccagcatcttgaaaaccgcgcagttctgcatctacctgttctcgggtgagttgagcggctggcagatgggccacgggttccatatcaaactcatctttaatcagtttggcaacttcgagtgtccccatgtgaggcttgttgccattggcgccgaaggttacggaaacgaagtcaggatcggcttctttgaccgcatcgagggtgttgagaatcggagtcaaagcaatattgctcgcatttttgcgcgggggaaaaacttcaaatgagatgacttgatgatctttaaagcactggttgattttcatgagtgagttccttacgtacttgtttagccgctgccaccatgttgatgaggctggccttggtttctgggacatcacgagtcttgaggccacagtcaggattgatccaaacatgatcggcaggcagacgtttcagaatttcgtggatgatgtgcacaatttcgtcctttgaaggaatccgtggggaatggatgtcataaacaccaggaccaacatgagtctgaaaatgggttgccttaaggatgtccaagagactgaagtcggaacgggccgcttcaaacgagatgacatcggcatcgaggtcgtcaatcgccttgatgatatcaccgaactgcgaatagcacatatgggtgtgaatctgtgtttcaggcttgaccttgctgccgactaaccgaaaagctggtactgcccaatcgagatacttcgggtaccaatctttcttgcgcaacggcaagttttctcgcaaagccggttcgtcgatttggataatcttgatgccatgcttttcaagatcaagtacttcatcttccaaagccaatgcaatttgttcaacgctcgtcttttggctcagatcttcacgcgggaaggaccagttgtagatggtaactggaccggtgagcatccccttaacgaggtggtcggtttgactttgggcaaagacagtttcagcaacggtgatcggcttggtgcgataaacatcaccccagataatgggtggtttcacaccgcgcgtaccataactttgcacccagccgttgtccgtgaagcggaagccgccaaagttttcaccaaaatattcaaccatgtcatttcgttcgaattcaccatgaacaagaacatcaaggccgatttcctcttggaatctgatccattcgatttcttctttgtgattgaaggcggtgtattgttcttcagtgatttcatgccggcgaagttttgcccgattgcgtcgtacttcagcggtttgcgggaacgagccgatcgttgttgttggcaatagcggcagcttgaacgccttagcttgaatcgccaaccgggttttccgttccggcgtccgcgtgtagtcgtccggagttaaggcagcaatcttttcattcaacgccttattttctgcgtaccggggcttgctgaacaaagcaacgttggcttgatatgctttgtgatcagcaccggtttcgaagatagcatccaattcgtgcagttcactgagcttttcttcagcaaatgcgaggtattgtttttcctcaggctttaaatgagtttcattgcgtaaggtgtatggcacatgcaacaaggaggttgaggtgcttaacaccagcttatctgtgatctttgccagcgttttaatggttgctaaggcatcggcataatgtgtgcgccagatgttcttgccattaatgataccggcaaaaagagttgcgcctgcagggaagccttgcgttttcagaagatcaaggttggcatggccttcaacaaaatcaaggccaaaaccgtcaaatggcaacttactgatgcgatcaaatgagtcggtcaaatcgccaaaatacgtttggacaaacactttggcgctttgcttttgagccagaagtggggtgtacagccgttcgaacaaggcgaggtcagcgtccgtctggtcatagaccaaggccggctcgtccacctgaatccactcagcaccagcagcatgcaagcgtccgataatgtcggtgtatgcagcaattaaatctgttacaaaatcatctggggtgacatcaatgaaccgtgatagctttaataacgtgtatggaccaaccaaggtcgggcgcgcattgatacctaatgcttttgcttcttcaaactggtcaaatagttgccagtctgtcactttaatttgtgtgtcctgatcgaattcaggaaccagataatgatagttggtgttgaaccattttttcattgccaaagctttgacatcaccagcctcgccttgataaccgcgcgcctgggcaaaataggtgtccagcggcgacagacccagcgcttgatatcgctttggcacgatgttcaacaagttggcaacatccaaggtgttatcgaagaaggaaaaatcgccagtcggaatctggtcaatgccggccgcttgaacagtttcccagttatgctgccgcagggctttcacttgttcctgtaattcctgtgctgtgatttgatgtttgaaatacttctgggtcgcaaatttaagctcgcgatgttcgccaatgcgtgggtagccgatgattgttgttgtcataaaagaaatcctcctcagttagtgagcgcgagccagaccggttgctggtctgacgaacgcgttatagcggaaatttagttgcggaaaggtgcggtgcttgtttgggttcacgaaaggttgtttagcgagaaaatcgtgaacgtcaaaaaagccgccctcagcacagacaaattgtctgcgccaaggacggcttaccgtggtaccaccttggtttgaaagccgttcacacgactttcctcaatcagtccgacagcaaatagctgtgagacctaacgcaataatgggcgtccccatgaccgcctcgcaatcgctcagcgttcctgcatcaccaagaccatattcgctgccgtttcttgatgtcctttcaccaaatggacactctctaagcaagaaactaacaactactcatctttccgcatttcaatgttgaggctagtttactgacgaagcttgttattgtcaagaactttgtttgaagagcgtgagaagtagcggttagttctgcgtagcgaagtgcgactgcgaatccttttttcgcggcaacagcagacgatttaaacgcttgaactaaaagaagagagctggcggagcggcgatgggctcagcactgaaatttgtcttggcggagtggttttctccgcctagacaaaggccgagcttcaagaccgcgggtttttcgggcttgaagctcgtgcccagtgcgttccagcccaatcgccgcgtagccagctcggcatagaaagctaaatgtaggctttatgttgccctatgctccggtttctaagcggggtggctcacgctcttaaactttttcactgacttgttttccaaattgcggtaagctattaaaacaagttatagaaggagaaagacatcatgagggtattgtttccgtacatcaaaaaatatcggtgggacgtgatctggtcgattttggcgatcttgattgtggcctttgcaacgttgtggcagccgcatttgttgcaggtaatcatgaatgccatcatgaaaaatgataagcagacggtctggattaatggtctgtatttgatcggactggcgatcatcgggattattggcgggatcgtcaacacgatttacgcggcgcgggttgcgctgggcgtggcaacggatttgcgtgcagacgaatatgctaagattcagagtttggcgtacgcggatgttgaaaagttttcgccatcgaacttggttgttcgaatgaccaacgatatcaatcaagttcagcaaatcatcatgggcttctttcaacaagtcacgcgaatcccgattttgttcgttggcgcggtcattctcgcgatcatgacactgcccgaattgtggtgggttattgcggtgatgatgattttagtttttggcgtcagctttttctcgttcagtcatatgggcaaatactttggccgaatgcaacaattaattgagcgcgtcaacacgttagcccgagaaaatctgatgggcatgcgcgtggtgaagtcgtttgttcaaggcgcaaatcagatcaagacatttgctgagtccagtgatgaaatgcgggatgtcagcgtcaagatcggaaacttgttcgccctgctaatgccggcgttcttccttgtggctaatttagccatggctggtagtatttggctgatcggacaggacattactagtcatcctagcaatctggcggcaattacaagctttattaactatttgatgcagattctgtttgccattatcaatggttgcttcatgttgacatttgcttcacgtgcgttggtttcactcaaacgtattcaagaagtcatggacacaaagccgagtatgacattcgtctctggcccgcaccgtgacttagatggcgcggttgaatttgatgacgtgacgttcacctatcctggtgatgaaaagccaaccatttctgacatcagtttcaaggtgaaatctggtgaaatgatcggtattgttggcgcaactgggagtggtaaaaccacattggcacagttaattcccaggctgtttgatccagataccgggattgtcaaggttggcggtcacgatgtccgtgctgtcaccgaagccgatttgcggaaaacggttggcttcgtcttgcagcgatcaacgcttttttccgggacaattgcggaaaacttgcagcaggggaatcctaacgtcaatctagatgcgatgcgctgggcggcaagaatcgctcagtcggctgaatttattgaacgcttgccacgcacttacaacgccgaagttgaggagcgatcctctaacttttccggtggtcaaaagcagcgcctgtcaattactcgtggcgtgatcggccagccgaaaattttgattttggatgatgcgacctcggctttagatgcccattcagagaaattggttcaagaggcactggcacacgagctgggtgatacgacgacgattatcattgccgaaaagatcagttctatcatcaaggcagatcgtatcttagtgcttgatgaaggccgcttagtcggcagtggcacacatcatgatttagttcaacataacgatgtttaccgcgagatctatgccacccaaaaggcattggaagagggggtgtgattaaatgaaagacttgaaaaatgcaggtaaattttatgcgcattatctgaaaccttattggattgagtttttgatcacgacgattttggttggcatctcgacttgggcaattgtggtcgcaccgacttacatgggacgagcgatcgaagaactggcaacctatgtgcagcagtggatgaacccaacaactagggcacaagcaacctttacgacatttaaccataccttggcgattttcgtcttgctttacatcattgatgccactagcatccttatctcaagcttattgttgtctaaaatcagtggttactcgactggtaccatgcgggtcggattattccgaaaaatgcaacggatgaaagtgaattatttcgacagtcacagtgacggcgatattttatcgcggtttacaagtgatctggataatattttcaacgccatgaatcaggcgttgattgaaatcttcttaagcggtgcccagtttatcgggattatctggatgatgttcacccaaaatgcgacgttggcctggatcacaatggcatcgacacccgttgcaattgggttgtcggccttcgtcatgcatcaagcgagtgtctcggttgatcgccaacaagatgatattggccgcctaaacggttatatcaacgagcagattacaggccaaaaaatgttgatcactaatggcttgcaacaggaaagtgtcgccggtttccagccgtataatgcggcggtgcgtaagtccaacctgcgcggccagatctggagcggtattttaaatccattgttgatgggcttgtcattgttgaacaccgcgattgtcatttttgctggttcttggttggcactgaatggttctttgagtcaaggcgcggcgctggccttggtagttgtgttcgtcaattatgcgcagcagtattatcagccaattgtccagttgaccagtctattcaacatgattcagctggccatcactggcgcccgacggattactgaagtgcgtgagcaacctgatgaagtggatccgccagaagggaaaacgcttgacggactcaagcatgagttactgatcgacaatgttcattttagctatatccctggcaaagaaattttgcatggcgtgaccatcaaggtggataagggcgaaatggttgccttggttggcccaaccggtagcggtaaaacaacggttatgaatttgctgaatcgcttctatgatgttgactcaggggcgattacatttgacggcatcgacgttcgcgaattcaagctcgcctcattacgacaaaatgtcggtattgtcttgcaagacccgcaactcttttccggcacaattcgcgataatattcgcttcggcgatcccgatgctgatcaagcgcgggtggaagcagcggccaaacaggctaacatccacgatttcatcgtgagcttgccagaaggctacgatacctttgtttcagatgaacaaagtgttttctcggcaggacaaaagcagttgatgtcgattgcgcgaactattttgaccaatccgcggttgttaattctcgatgaggcgacaagtaatgttgataccgttacggaagccaaaattcaagcggcaatggataacgtcattcaagggcgaacgagttttgtcattgcccatcggttaaagaccattttgaatgccgacaaaatcgttgtcttgcgtgatggcaacatcattgaggaagggagtcatgagcaattactcgcgcaaaatggcttctatgccgagctttaccacaatcaaatggtgtttgaataacttgtaaaaagattccgaataaaatcggagtcttttttatttttattcgtttgtgaaacggttgcaatggcttcctagcctcaataatatatgttatcctttttatatcagaacgatgggtaggacggttctgataaatattgggatgatggaggtaacgaatgagtaagcgtagatatctggtcgctatcggcggcattttgcttcacctgatgattggttccgtgtatgcatggagtgttttcacgggaccgattgccaaacaaaccggttgggcgttgtcatcggtgacagttgcgtttagtatcgcgatcttcttcttggggatgagcgccgcctttatgggtcggctggttgagcgatttggtccgcgactgacagggacagttgcggcgttgctgtatggctccggcattctgttgacaggactggcggtgcaacttgagtctttgccgttactttacattgggtatggtgttgttggtggtttgggattaggtgcgggttacgtgaccccggtttcaaccatcattgcttggtttccagacaagcgcgggctcgcaaccggcatggccattatgggcttcggttttgctgcgatgctgaccggtccgattgcccagaacttgattgctgggattggactggtgccaacgatgtatgtgctcggcatcgcatatttacttattatgctcacagcagcgcaggttatccggaagccgcgtacgggtgaggttccggctgctgatattgctaaaagtgtcagtttgaccggtactgccatgacagccaatcaggcagtcaaaacgcgttcattccgctacctgtggctgatgtttttcatcaacattacctgtgggatcgggctggttgctgttgcgtcaccgatggcgcaacagcaaaccggcatgtctgcggctacggcagcgatgatggtcggggtcgtaggtttgtttaacggttttggtcgactggcttgggcaacactctcggatctgattggccgtccgctgacgtacacactgatttttacggtggatgtcgctatgttagctggcattctggtgttcagctcaccattgctcttcgggatcgccttatgcctgatcatgtcctgctacggtgcagggttctctgtcattccggcctaccttggcgatgtttttggtacgaaacagttaggcgctattcacggctatgtcttgacggcgtgggcagttgctggagttgttggaccgcccctgcttagccttagcgatcaatacttccacagctatacttacagtttgattttcttcgttgcgcttgaattggttgcttttattctctcgattcgcattcgccggcagttcagcgttgtggctcgtgatgaaaaggtggcggactcactcgaaaggcaacattgattggttaatactgtgacagcctcgaaaaaggctgctcgtgatcaacgaatgaatggggaaattgacggttgtattggtctataacaatgaagtttataaatgaataagctctggaaaaatccatacagatgtatggattttttttgcacgctaaaatcccggtatatcaacattaatgattcataacgcgaagtatttaaaagcgtttaaacattattagttgacatacctgtacgtacaggtaaaataaagtttgcaagtgaaagcgatttctggaggagaaggcatgcggaagtatgatgtgatctatcaggatttgaaagataagatcgaggccgaaatttatacgactggttcattattgccgagcgagaatacgctgcaggatatgtatcaggcatcgcgcgacacggtacgtaaagctttgcggctgctcaaagatgatggcttcattcaatcgcagaaaggcagaggatcaatcgtgatcaatcgccaagaatatgtcttcccggtgtcaggtgtcgtcagttatgccgaattggctaagcagcttcacttgcagacaagaaccgtggtgttggccaatcattttgccgcacttccggccaagtcctttaaagatgttgatccggatgttgaagtcaagcagatgcgtttgctgaagcgagtgcgttacttggaaaaagagccggatatcattgatatcgattatttggatccaagagtcgtgccgccgattccggagtcggtggcaagggattcgttgtatgcgtatctcgaaggacaaattggcttggaaattgcttatgccacaaaagagattacggttgaaacggcaactgaagaagatcgtcgttatctaaatcttcctgagggcgccatggttgtagttgttcgcagttgcagtagtttggcagacactagaaaatttcagtacacagagtcacggcaccgggcagatcgcttcaagttccacgacttcgctcggcgtacaagaccatagagcgtgagcaggcgcgtttagaaaccggaatgtaagcggccttgaacgtgatggcatgggtttggctattgcgttcaaggtccttacatgcaggtttctgcgcctgcgaacgcgtttcaagcatagcgtgatctgatatgttgagactcaaaatttaagtggttttgaaagcctttgtgtttaggtctcaagctcagcaaacgcttttcaggaaagggagtcaccatgggatttcataataaagtcatttatcagctataccccaagtctttttatgatagtaatggcgatggggttggcgatctgcgcggcatcatcgacaagatcgattacctcaagtcattacatgtcgacatgatttggtttaatccattttttgtttcaccgcagtatgacaatggttatgacgtcgcagattatcgtcaaattgatccacgctttgggaccatggccgattttgacgagttggccaaaaaacttaaagcggcaggtggtactatcccctgtcaagttgacacttataaaaacgaaaacacaatttttcttaatcataagggaatccgaagccgttttaaatgtacctcacaatcgtgcgcttacggtaaaatgggtgagtagcgatgttgcgtgccggcatcaaataaaagtggcggattgtctgactttttctaaaactcatttggcaggtgctcaatgcgtgtaagtgcatgttaaactagttcatagcatgttaattgaaacattttttggaaggtggggaagggctgcatgttaagatttgtgaaagttgcgccggaagctcggctgcattatttggatcttttattgattggggatgaggatccgaatatgttgcggcggtatttggacgctggcacgttatttgcagcgattgacgaaactgtgccggttggcgtggccatggtagtgcctgtggatgctaccaccattgaactgaagaatcttgcggtactgcctgcccgccgtcgccaaggtattggcgcgagcttgttacggcacgtcggactggtgtatgcgcctgagtatcaggatatgctggttggtactggtgatgtggatttcgagaatctgcgtttttacatgcgccagggattccggtttgacgggatccgtaagcatttcttcgatcagtatgccaatccgctgtatgcagaagggatgcagttgcaggacatggttgtgttacgacgacggttgttattgacaagttctgataaaacaaaggagtaatgcttttggccaaaaggcgccgacattttacgttaaaaataattccgcttgctgcttggctagtcatcggtttctttgcgatcggtgtgacgcttgtggttggttcatactgggcccaacaacaaacagaagtgacgcaaaaacaagaagttgcggatgaaaaggcggcagtacgcgcaaaaaaagttgcctttattaagcgcttggtgccgacagcacaggccatgcaaaagcaatatggtgttttgacaagcatcaccttagcgcaggccattttggaatccaactggggtaccagtgcattggcgaaggattaccataacctgtttggcatcaaaggtaccgatccagccacgaccaaagtgttgcgcacgcaggaatatgtcaatgacaaatggatcacggtcgatggccgttttcgggtgtatgacaacgacagtgagtcgatccgcgatcatgcgctgttattcgttaatgggactgattggaatccgcaacaatatgccacagttcgtgccgctaaggactataaaacagcggcagctgctttgaagacggatggctatgctactgatcctgattatccacaaaaattgattcatttgattgaaacttggaatctaacccaatatgatagttgaacgttcgtgttttagtgatgcggcaatcctcgttatttggactttttaaagccgaatcacggggattttacttattcttttgatgaaagcggcttcgcgtgtttgttcgggaattagcgtgattgtgttgttccacactgatttttatggtaagcttgttgaaaatttacaattaaaaggagtgcttgtggtgaaattactggaagaccggatcaaaaaggatggccaagtaataggaacagatgtcttgaaggtggataactttttgaatcatcaggtcgatcctgatttaatggcagatctcggtcatgaattctaccggcgcttcagcaatgagccgatcaccaaaattctgacggttgaaagttccggtattgcgccggcgattgcaacggcaatggagtttcacaagccgttggtttttgcccgtaagcataagagcttgactttaaaagatcatctttacacagctacggtctattcgttcactaaaaagacctccaatgagatcgctatctctcgcaagctcctttcagccgatgacaatgttttgatcattgatgattttcttgccaacggtcaggcggtcgaaggcttgatggatatcattgcacaggctggtgcgacactgagcggtgtggggattgtgatcgagaagactttccaaaaaggccgcaagttgcttgatgaaaagcacgttcgcgtcgaatcattggcgcgcatcaatgcatttgaaaatggtcaggtcatctttgcgccggaggattagcccacgatgaagaataaagcgatttcgaatcctaaagcagccgcattgggactgcagcatttgctggcgatgtattccggttcggtgttagtaccaattctgattggtgcttcgttgcattttacgtctgagcagatgacgtatctggtgtcgattgatatcttcatgtgtggtatcgcaacggctttgcaagtatttggcaacaagtattttgggattaagctgccagtcgttttgggctgtgccgtccaagtggtggcgcctttgatcatgatcggccagaagtttaattttcaaacgatgtacggggccatcattgttgctgggttgttcgttttcctaatcggcggtgctttttcaaagttgcgtttcttgttcccgccgttggtgaccggttcgttgatcacggtcattggcttgtcgttgattccggttgcttttcaaaatcttggcggtggctcaacaacggccaaggattttggtaacatgaccaatctgatggtcggggccttcacggtacttctgatcttagcgatcaatgtctggggcaaaggtttcctgcattcaatcgcgattttggttggcttgattgctggtacggtgcttggcggttttcttgggttggttagttttcagccggtgattgaggctagctggttccacgtaccgacgccattttactttggggtaccgcagtttgagtggagctcgattgtcacgatgattttaatttcgatgacatccatggtcgaaagtactggcgttttcttcgcgttaggggacatagtcggccgaaaaattgaagcagacgacctgaagcgcggctatcgcgccgaagggttagccgtgatgcttggcgggttgttcaataccttcccatacaccactttctcgcaaaacgttgggttggttcaattgtcagggattaagacccgcaagccagtcattttttccgcgattttcttagtgattcttggtttactgccaaaaattggcgctttagccacgattattccagcaccggtgcttggcggggccatgctggtgatgttcggcatggtggctgtgcaaggcattcggatgttgcaacaggttgattttgacaatgataagaatttgcttgtcgctgccatttcgatcggtctgggacttggcgtgacagttcagccacatatcgttcagttcttgccaaaaacaattcaattgctgtttgggtcaggcattttaatgaccagcttgagtgcggttttgctgaattggctgttcaattcgccacgtcggacgcaagaaatgtcggttgatgaaggcttgaacgaacgcgattcagataaataaagtcaaagcgaggaacagatgtgacgcaatttattagtccaggtgcaacgattggcattatcggcggcggtgtgactgcttttcaaatggcgaatgcggccaattcgatgggcatgcgcacggtcgttttggcgccgacacaaacggatattgcttttgaaaaggcggatattccgttggtgggcgatgccactgatcggacagcgctgaaagaactcacgcaattaagcacagtgatgacttttacagatgagaatgtcgatggttcgttgctggcggaattagccactgccaaccaattgccttccggggtcgacattttgactgtcacccaagaccgctatttggaaaaagtctttttggacgatctgaatatgaacattttgccttatacccaagtcattacgccgaatgatattaaagaggctgttgacacaatcggttatccagccttgctgaaaccgattcagaaggggatgggcgttgaccagcagttgctgctgtccacggcagatgacgtcgcgcgggcacagcagttgttgcaacagcgaccatatattcttgaggcttacttacaaaacatcaaagaagtcgctgtgatcgttgcgaaggcggggtcagaagtgcgcatcggcccggtcatccagaattattttgatcgtcatcaattgaaggcttcatctgtgcgcgctgatgttgatccagcagtgattgttgagatccggcgtatcgccgctaaaatttcagagaagttagcctatacgggcatctttagtcttgaatttttcttagccagcaatgggacgctttatgtgaaacgagtttatccagggccgaaattatatggccatctgatgctgaatacgagtgacatttctgaatatgagctgcatctgcgcgcgattctaggctggccattgccggagttgcaattggctgaggacggcgttggcattccgctgcggtcagaagatatggacgcggttttgactcagattcaaattaaacctgattggcgatttacgttttatccgactggtggcgagctaaccggcgagattcagatcgtgggtgatttgaaagcaatcaaagccagtgtgaatgcgactggccactttgtcattcaatgatcgcgtgctggcagtcgcaaaccaaggatacctgttgttgttttgtccacttgaaggaggaaaaagcccgtgattccgcgttatagtcgtcccgaaatggccgcaatctggtcagagaagaaccgttatgctgcatggctggaagttgaaatcttagctgccgaagcctggtccaaactgggagaaattcccgctgctgatgtccaagcattgcgtgcgcatgctaagtttgatgttgatcggattcatgaaattgaagcggtcacgcatcatgacgtggtggcattcacgcgggatgtttctgaaagcctcggcgctgagaagaaatgggttcattttggcttaaccagtaccgatgttgtcgacacggcacaaggctacctgttgaagcaggctaacgagattctgcgtgcagatttggccgccttgaaggctagtttagcgaagttggcgaaggcccataaggataccgtgatgatggggcggacgcatggcgtgcacgctgaaccaactacttttgggttggttgttgccacgtggtattctgaattgaagcgagacatccgtcgatttgaggacgcggctagcgatgttgaagcaggtaagattagcggtgcagtcggcaccttcgccaatacgccgcctgctgttgaggcgtacgtcacagagcagttgggtattcgcgctcaagaaatctcgacccagattctgccgcgtgatctgcatgcgcattacattcagacacttggcctgattgcgacttcggtggaacgatttgctttgcagattcggcatatgcagcgtaccgaagttcatgaagtcgaagagcatttcaacaaaggtcaaaagggctcgagtgctatgccacataagcgcaatccaatcggttcggaaaatgtttctggcttggcgcgcgtcattcgtggatacgagacgccagccttagaagatgtgctgttgtggcatgaacgcgatatctcgcattccagtgccgaacggatcatgttgccagatgctaccgggctgcttgattacattctccatcgattcaccagtattttggacaatttggatgttttcccagaccgaatgaaagccaatatgaatctgacgcatggcctgatttacagccagcgggtgatgctgaagctgatcgaggctggcttgagccgagaacaagcctatgacttggttcaacccaagactgcggtggcatgggatgagcatcgcgccttccgtccgttgcttgaagctgatccgaaaattactgatcggttaagtcaggccgatttagacgatgctttcgactaccactatcacctcaagcatgttgatgagattttcaaacgagttggtttagcataagcaaataaatcaaacaaaaacggcgagtgcagactcgtcgtttttgtttggccgcattttgcgccacctgttgaccatataaaaagtcctgttcaagttgtgatagcaacgagaacaagactcattttgtcagggcactcagcgtcaatacaggcggttcctgccaagcatggttaggattcgcatttaacaaggattgatctgttgttaaaactagcaagcaactattggtttgttgcaacgcatgattggcttcagtgaggaagtcgcgggtaacataaggatcaaagatcgcaggagtgctggttagcagcaggtaacgttttttacccatcaagccacgataaaattgcaaataaatgcgttgcatggtgttcaatgtcgcagctggctggtctaagatcggtgaattcgtggataaccattcaggcaagaaatcagaatccttgcagcgtccattgatgcaaaggttgtttcgcacgctgagatagtcaaggatacctgtatgccggctattaatgaagccgacttgcttgatgacgccaccattaataaaatcgcgcacgtactgatcatgcaaggcaatcaggtcattctcgtttgaggcatagagatactgaatcgtcgttggggtaaaaagtttggcaaaattttcgcgatagatatcaagtagttttgatcgaaataacatggctgtctcctaacgcggtaaggcacgccttttccgaagcatggaaagtggtgtgaccaaacctatgttggtgatgaaaatcacggcgagaccatttcccagtgctgacaggaaaccggttggctgtgtcatatcatcagttttgctaccgtaataaaagagggtttcacgggtaaaaccagtcaggtgacgggcaaagagttgctcaaatgcgtggttcattgcgatgctgtcatacttttgttgtagcagatgggcaaataccgaacgatttgtggtcgttaagaaataaatcaattgatcatttaataaaaccacaagaaaaatactaacaatgaagctaattaaaaagctgaaaattgcttcaaaggcgtattgtaagccgatcgacatactgctttttccgactaaatacaaagcatcagtttcagaccgtcgacgccgccatagccaagcagttcctgcaagccacaaaagaccgtcagcaaaaacaactttggtcagcatcgactgagcagcctgcaccatttgaatgtgggcttgtccgacctgcgtactgagcaaaatcgtctgcctattttgtgttccaaatgagttcaagcgttgcaaaaaagctgcctgagcagattggtcaatcatttcacttgtcatcagcatgatgctgatcaagcagaacgacactgataacagcatcatcacaatataataacggcgatgataacgaaatcctgaaaacgttcgctcaaagaaatgcatctacccgttcacctcacaagcagtataagcaatgaatttgaacaaaatgtgaacataagccgagcatttactatgttatttgaatttatttagatggttgggttgtgacattcacatcagacgaactgctagattcgctgctgctggaggcttcagtttgatcctgaactttatctgggaaggtggtgatgggatcagtgtcgtcggctaattcaggagcatcagtttggtaaagtccagttgttgattggtcattattttcgctatagagactggtgctcttgctgcctagattgcgttcgattgacaagacattgctgagactctgattgtagtcatattggttagggttgacgggtttaaagccaagtggcacgtagaagcgtaagagattgcggttagcgacatcgtctgaaaggctgagtcttgtgtccactgacttctgatccttggcgatggttgcttcaagcgcaggcgtcaatgtcagcagtttaccggttgtattatcgtagactttactgccaagtacggtgtatttagaggtgacaaaattgtgattacggaaggtaacaacgctgtcgtgctgactggacagcagatcggtgccaaattggacataacgcgagctatcaatgcctagtaagtgaagtaaggtcggcaagacgtcgatctcgccgccgtaagtgctattaacgccgcctttaagaccaggcatgtggaaaatcagcgggacgcgttgcaactgagcatcatcgaacgcattccaagtgctaggatccttgccaagcaacggtgccagagtggtattgcgatcattactaataccgaaatgatccccataaagcatcactagcgaattcttttccaaaccgcttgctttcaaatagttgaagaattccttgagcgcttcatcaagataatgagccgtgcgaaaataaccgttgatcgtggcgtcataagtaccggcgtcaggaaaatcggaatcagcttgggtgatataaaaaggattatgattgctcgtcgtgatgattttggcatagaaaggctgttgcagatgctccagatactttggtgtctcggccatcatcaacttatctttaatgccatattcagtcgctgctttttcgtcatgattataaaagttgccggaaaagtagtcgttataaccaagactcttgtatacattgtcgcgattccagaagctagcagagccgccatgaaaaacagcactggtataaccggctcgttgattgagaatggccggcgctccttcaaacgtattttcagtgccgagactgctgaataaagagccattggcaatcccaaacgtgctggtttctagcatgttttcggcgtcactggttttaccaaggccaacttgatgaaagaagttgctaaagctgagtgtgtctttttctttaatgagtgaattcaggaaaggcgtgacttcttgaccgtcaattttttggccaatcaagaattgttggaagctttccaaatgaataataatgacatttttgcctttggccgtcccaaaataactggcgttgggagcggcataatgcgaccgcgtatattgcaatactgggtcaagattcgaactgtcggcttgggcgcggacctgattgttctgggctgttttggcagcatcgtaaacggtgaatggcgccaagccgagatacttaacgatataattccgatcaaaagtccgcgtcaaaagttgcggccgattcatttcactaaccgccatgatcaacccaaacagcgcgatcccaaagacggtgaccgcttgcggaaagtgaaagggaagttggcgggtatccaacgtcagaccgaaatgcggccagcgcaaaggttcattgtggatatagcgccagatattccaaatactgtaactaaaataagccaaggccacgagcacaatatcaattacataaatgatatcgtgtggtttaaccatgctaagggagctagctccaagaccctgactcactttagagacgccaagaaccgtgttgatggtcagaaaatctgaaaactcacgataatacagaacatttgcgagtaatagcaaagtgctgagtatgtaaacaatgacgccgatgaggtaaccgcggcgcgcatgcttgggatacaagccaagcgataggaaaatgattccagttcctaagggatttaataatagcaaggtgtattgtagcggatcatttaagccaagtgaaaagtccacaaagtaaccaaagatggtcttagcccataccaaaaaaagcagacaggctaaaaagccaatccgggttgatcttatccactgtgcgaggcgatttagtcgtaaccgtttcaaagcggcaactcctttccactttgttctttgtcattgtacccgcaaaagggaggaagcacaaaagcagggtctgagccaacttggttttgggggtggcaagcgtgtttcaatatctgaaaaatgagctgtgtttgcgagcgtgtttctgaagcaactgcaaaaggcctaattaccattttgcttagacccttatgtgttggtttcttcgctgctttgggacaatgacgcgagaacgctattttagtgctttttgatgtcccgcgccggcctcccgacatattggtgaaatgatattaaatattgatcccgttgctggtatcatggcaaatcatgcaatgattagcgtacctcattttcctaatggcagagggtgatgctcatcattcttacagagtctttaaaagttgtaacacattgtgggtatccttcagtcactttgctacaatgacaactggaggtagcacaatgctgtttttggggccattttacaactggattaatacaacctcgctcagtcgcgtcaaccattttcctttggttcgattgattgtttttagtttggacaaaactattctatacctattgatctttgcagccttgcgctgcctttggctgttggtgacgaagcggagaaccacttttgggcgggaattaaaactaggcatttttgtcggttatttaatgctcctatttgctttgacagtttttcgcgatgtgtattatccgtggcaactgcactttcattggaatcggccattatctgtgattaatatccgaccacttgttgaaacgcttaaattgcaacatgctgccagtcactttgatctctggtatcaatcactagggaatattgcttggtttatgccgcttggctttggtattccttgggtgagcaaacatcgacggcgtctcgcgggcacggttatatttggcctactgacgtcgttaagtattgaaaccctacaatttctgctaatcagtggggtagcggacattgatgatgttattttcaatgtgatcggtgcgattttcggctatagcctatatcgcttgtttcatcattgtaaataagcatgagtcgttttagtattcatcatgagttttctgtgtatcatgaaggtgagctgtctcttggaaatgctttagatcaggttgtgcttgtcttgccgtgggaaaaccgctagaatatttttttgtgttcaatttttttaaatcaatcattgaaatagaaagaggcgcgtaatgggatttttacttgcgctgattccagcaattgcatggggctccattggcttggtcagtggcaaactaggtggcaatgcttatcagcaaactttggggttgacgtttggcgcgctggttttcgggatcggcacgttgattgtcatgcgtccggtcttagatactaaaatttggttacttgggattgtctctgggcttttctgggcattaggacaaggccaacagtttcagtccatgaaatatatgggtgtctcaatgacgatgcctatttcgacagggatgcagcttgtcgcgacaacactggctggtgcgctgttgttccacgagtggcgtaatggtcgtgatgtgaccttgggcattcttgcgctggcattgctgattgtgggcgcaacgttgacatcaaggcgcgaacaaacagacgacttcacaacacaaagtggcgttgcaaaggggctgcgaaccttattgatatcgacagttgggtatgcgggctacacgattattgtcaacgctgggcatcttggcgctttggccgttgtgatgccacaatccatcggcatgattattggtgcgttattaatgggcattggccatcagccatttgctaaagcaactgccaaaaatattttgacaggcctgctttggggaacagggaatgtgttcatgttgttaccgatggccaatgttggtttagcggtttcttattcattgtcatagatgggaattgtcatttcgactttcggctcgatttatctgcttggcgagcataaaacacgcaaggaaatgatctgggttagctgcgggtcggcactggtgattctcggtggtgtcgtccttggcatcatgaaagcaaagtaatcgatgagaagttgctcgattgcttgcttttttacaaattcaattttaaagttaacttgttagagtgtgaatttgaacaaagcatgggtaactgaatttaaaagtttacttgatgagttatttcgaattaataattgaattgacgttttttatgaaaccactctcatatcgacttttgacagttacttatgtatttagaggaggaagcacacgatgtcgtacatcaaatttgattcatctaagctggacaagttcgttcatgccaatgaacttgaacagatgcagccgttagtgactgcagctgacaaggaattgcgtgaaggaacaggtgctggtaaggatttccgcggctttatcgatttgccagtcaactatgacaaggacgaatttgcccggatcaaggcagcagccaagaaagttcaaggcaattctcaagtctttgttgcgattgggattggcggttcttatttaggcgcacggatggcggttgattttctttcccagactttccgtaaccttgaccctgatctgaagttcccagaagtttattttgctggtaactcaatctctggtacttatctggcggacttgcttgacattattggcgaccgtgacttctcgatcaacgtgataagtaagtctggtaccacgactgaaccttcaattgcattccgggttctgaaggcaaagttgatcgaaaagtatggcaaagatggcgcaaaggaacggatttatgcgacaactgatcgtgccaagggtgccttgaagcaagaagcagacgcagaaggctacgaagaattcgttgttcctgatgatgtcggcggtcggttctctgtgatgtccgctgttggtctgttgccaatcgctgttgcaggcggtgacattgacgaaatgatgcgtggtctcggtgatggtcgtaaggcatacgcttcagctgatttgaaggaaaacgaagcttatcagtacgccgcattgcggaacattttgtatcgcaagggctataccactgaattgctggaaaactacgaaccaacgttgcaataccttggtgaatggtggaagcaattgatgggtgaatctgaaggtaaggaccagaaggggatctatccttcaagtgccaacttcagcactgacctgcacagtcttggccaatacattcaggaaggtctgcgcaacctgatggaaaccgttgtctgggttgaagaaccaaaccgcgacctaaccattcctgaagatgctaacaaccttgacggccttggctacttggctggcaagaagatgtccttcgttaaccgcaaggcctatgaaggggttgttctcgcccacaccgatggcggcgtgccagtcatgaccgtctccattccaaagcaggatgcctacaccttaggctatctgatctatttcttcgaagctgccgtttcaatctccggctacctgaacgggatcaacccattcaaccagccaggtgttgaagcctacaagaagaacatgttcgcattgctcggccgtccgggttatgaggatatgaccaaggaattgaacgcacggctttaatagcgtgggtttgaggttgcttgaataggaaaaaatgagagccacaaaattgtgttgtaaatgttcgtgactgacttttgactgaatagccaaaagggtcaaaacatttatgtaccaattttgaggctctttttgtgtccgctggattgccagtactggctttcttttggtgtatagactaaaaacacggtgtgatttcagcgggtgataaacgacatcgcgaaatcaagcctatatccatatattgacccaatatctagttggcatattaatatcagcgtttgagaacgcttgttgcgagctagttcgtgtccgttagtgctattaggtcttagaaaagtgtttcggcaacgctacttcaagccagcctcaactgaccaatccaactggccttttgagaccatggcaagagcgtgatattgtaaccctctgctgccgactgaaagcttggcgaaatattacgttccagatcgtttgcgagcaagtagaacttaatttcatcattaaatgaacgtacatatgtaattgaaaagattggttctttgtaggcatttccagttggattattcactagttttaatgccttagcggaggttgttttcgttcgaccagtcagaatttcaaagttgatgttattgccactttgacctgtgtatttaacatttgtattgaccgaaatatcgctgttaattaagaagttgacaacgtcttctagaaataagtctttggttctatctcttgaagttgcgagcatatcgccaacctgtgtgatgcattgaataagctgcaattctgcttgtgcatatttggagaggaaaggtattttgatagctagctcaccagttggggtatattgaacgccgaaggaaaggagagtgtcattgaaatacttctttcttttaactgatgtgttcgtgtcaaatcctaaggttccaagttcgtccatggtataaccgtcatcactcagcatcaaattgccatcagcgtctttgtataaaaccagagaagtattatcatgaaacatgtctggaaacggcgtgcgaatctcaatgaagtggttcttgtccttataagaaaacgatacatctaaccatttaatgcgagccctttttaaggtttcaattgttggcatgttcatgatttgcctctttcttgttctgtacgaagacagcctttgcattgttaaggatttaacgatgacattgtccaaacaatcgtttatggtgtttgattgaaaaattaagcatggtcattcatgcgcaatatttctaaaggcttagtcaggaattcattgattccagccaaaaacttttgaaaatgcgccgtcccattatgactttcaaccgcttcagcatctcgccaatgttcgatgatttcatattcattcggagcggtgagactttgatagtgatcgtagctaaggttcccttgttccgcacgcgaaccttggaccaaagcggcgatgaattgtcgatatgccgcatcacgatctggtttgacgacaagtttgacattaatgattttcattttaaatcctccattttttgtgtatgtcatatgataatggaagctaggtcgccaagaaacgttttcgatccagggctagcttctttttgcatcagtacttggtgcctattatacggagtgattcagattgtatcaattttaaaaagcagcgtacataagtggtgtcaatgatgtgtttaagtctaaaaaatcaccatcagcacaaatgctgcgtccatgattaacaagccaaatagggccgtgatcctaccgataaaactgcggtgaccttgttcaagtgagaaggggaggatgtcttctttgctcgacggtgatatttcgaaatacttctccatcatgtgacgtgagattgtgtatgactgacagcttagataaatcaaagtgatggtgacaattaccgttagccaagcgcttacacggcaaacggttgggtcagcgtagatattaagttggtagatgccagcaatcaggaaaccgatgcaggcactcagactgaataggttaaggcgaagtagcaaagcgactttttgggcccgtttcatttcttcaggaaatgttttcaacatttttgccgataacatgacaacttgataagaattggcaccttttgtcggacgttttgcttttatgactttaacgacaccagttatttctgtgatggcaccgattgttaaaagaagcaggataccgtcaaaaaagatttgatttgtcatgagggacctccaaaaactgaatcaaaaaagccgcttcgactgttatgacgtctaacggctttaagtgacgctgatagattttaattcttagtgcttgtcccatcagcatagttgattgtgtaaccaggttcaatgttgaaaatgtaaacattaaaatagacttgattataaccaatactttgcgcacgcatctgaacaccacgagccactaattcattgccacggaaaattggtttgacttcgtagcggacataatggccggtactttgtttgaggtaataagcgatatccatctcatgagccagcatgagtggtgtattaagggtttgcgtgccggtcataaggttcttggggttgttgttttcgccggttaattgataaccaataagatggctgcgattgtacagccaaccatgcgcggttttcttgttatgccagccagttgggttccatgtgagtggttcacgcttggttgttggcatgagtgatttatttaaaagcgcatttgcatctgtcacgcgattttgaccatcgagatcagcataagttgcccaagcacccttggcagtagatagatcagcatcagtgaatgcaggattatttttgttgacaatgatttcttgttggccagtgtagtcaagattggcgagatcggacgctgtcgtggtagcagcacttgttgatgattcacttgcagcaggttgtgttttcgctaacttggctttgagatcggtgatctctttgcgtttttccgtcagttctgaatcaaggccgctgatagctgactgcgtctttttgttagccttggtttggctggcaactggatcgccagctgactttactgaacgactattagttgtactgcaaccgccgagaagaagaccaacaacggccagcggcatgaaaagttgaagtaatttattttttctcatcgtaaggcctttcgataaccagctgcttgtgcatcagcttcggaattgaagtaaaccgcgttggctgaattcatgtgatagccagcttgaccaggcacatggtaaattttgctgcggctgtttccgatgatggtgccttgttcagccgtattcatgtcaccttcattagtcgtggcctgctgtgtttgtgctgcctgttccttagcggcagacttttgagcctcttcagcttgtttggctgcctgtgctgctgcaactgcttgcgatgaggccgcggcggcttgctcagacgcggcaacttggctcgccgatgcttctttggaagctgcctcagatgccgctctagacgatgaagcctcagcttcgctggaagcagcaacttgcgaacttgcttcagattctaagctggcctcttgtttgcgaagtgcttttaattcagatgtcttcttggctttcgctgccagtaaaactttcccacgagctttttcgctcttgagttggcgctgctgtttggcagatagcgccttggttttgctggttgacgatgtttgctgtggtgatcccgatgcggctttcgtatctaccagcggtccgccagcgatcaataagacaagcccaccaacgagtatgatcaagtttaaacgcttggtgagcggatgtttgcgttgccgaatcaatctgacaataccccatatgaatcccactagcccgagcagcacaaaaatacttcccagtgttgacatgttattccctccaaagttttaatatcgacattagttgtttgaacataataagatttttgtcgattattccaaagtttattttcccagaaaaaaagcccggcgacaagcgccgagctagcttcacagtcagtttttttaggatttgaccacatcgacattagcatacaggtttgcaatgatcgccagcatgtctttttcagttcgatcccagccgatcgtcggctgagccccatctggcctacgattgctccgccttggcactggtatctttaaatctcaataaaaatgatccatgagaataaggccaactatttcagctttgtatggaaattgtcgccttgttgttggctgtgaatgatgtcccaacctcacctcgtgctctgaacaaaataattgctttatgcctaaaacaaatctagtataaccgcgagagatattgaataacgcgctcgtcgtcgcagaagcccacatatgtgccgacttctaagcgtgcctgttcgcgctcactttttgggagggattcttatggtaaagaccattaaggctggtgtcgccgcgttgaagaccttgagagctggggtgtgacacatgtttacggaatccccggcggtacttttaacaatatgatgtatgcgctggatgaagagaaagacaatttaaagtatattcacgtccgacatgaagaggtcggtgcgctagctgcagtggcggatggtaaattgactgggcatattggcgtggcatttggatcagcgggacccggcgcaacccatctatttcaaggggcgtatgacgctaaaatggataaggtgccgacgttatttcttgtgggtcaagttgaacaacgcttcatgaattacgatttcttccaagagctggatgaagatccgatatttcaagatgccgctttgtatgcgcggacggttaccacggcggctagtctgccgcatattattgatgaggctattcgccgtgcttatgccggacgtggagctgcgattgttgtgattcccaatgatttggcggccgaagaaattccagccgatggctactacagtgcggcagctacccacgccaccccagttttaccagctggcagcgacgagcaagtagatgcggcgttgcgcttaattggtgcagcgcaacggcccgtgatgtacgttggccaaggcgtccgtggggctgctgatacggtgatgacgctggcaagaaagctacagatgccagtcattacgacagcagttggcaagccgattatcccttacgaatttgaatcactgcttggttctgcagctcgggtggcttcaaaaccagcgaatgaagcgttgcgagttgctgacttgatcatgtttgtcggttcgaattacccgtttgctgaagtcatgttctcaccgaacgccaagtttattcagatcgaggcagatccgaagacattgggcaagcgccatcacacagatgttgccattttggcggatgctccggcaaccttgaagaaaatgattgatcgtagtgacgatgcaccacgcagcggctggtatcaagccaatgtcgacaacgtgaaaaattggcatcagtataatgacgatatgatgacccggacaaccgggaaaatgcgcttcgaaccagttttcggccaaattaaccgcattgctactgatgatgccatttttgcgattgatgtcggggatgttacccaaaatgctgtccggttactgaaagtcaatgggcgccaagcgtggaccaccagtgggttgtttgccacgatgggcgctggattgccggccgcattagccggtcaattgagcttcccaaagcgacaggtctttaacctggctggggatggtgccgcggcgatggtgatgcaggacttggataccgaagtccgttatcatttgccaatcatcaatgtggtcttttcaaataatgcactagggtacattgaagatgagcaggaggacgatggtcacgcgtggttcgggatcgacatgccggcgattgactttgcgacggtggcgaaaggcatgggtatgaccggcatcacggtcacccaagttgacgaattgccagcggcttttgaaacagctgaagccaaccgggctgccggcaaaccaaccttgatcgatgccaaaattaccaacgagcggccaattccagttgagcatctgcaactggatcctgaccagtttgacgcagacacgattgctgcgttcaagaagcgttactatgcggaaaaattggtaccgctgagtgaattcttgaagacacacaaggtgcctgtggcgtaactggtgatagaagaaagatcagtattaagcagtacggcgatggccgtgctgtttttagtcgctgtgttgccggcgattgagaaaggtgatttttcaagcgcaatacgtgtttagccgccttgaaaaaggtatcatatgataaaagtggtcatcgccgataaagaataccatcgctttttgaccaattatctaatgagacggagtaagaaaaatgccttttgctgaagtgattatgaatcccagtgcggggaatgcccgctggaaaaagcaattgcctgagttagttgcgatcattgagtcccactttgcgccactgcatattagtcagacgcgcaaagccggcgatgccagattggtgactgaacgactcatcaaggcttatcaacacaagatggacgatcttcaactgatagtgattggtggtgatgggacgctacacgatgttgtgaatgggttgcagcgacaagatcatccagaagtcgccattggctatgtgccaaccgggaccggcgatgattttgcccgcgccaaccatattcctctggacccgaaaaaagctgcggcggctttgacaacggcaatgccgcatgccttgaaaatcggggtggccgactcggccaagtacgggactcagtattttattaataaccttggcattggaatggatgcccaaatcgtttaccaaacgaaccattctgatcacaaggcagcattgaatgccctaaaactcggtcatttttcgtatgctgccagtattctaaaagcactgcgacaacaaaaaaagtttcgtgcgacttggcaagtagacggtaaaaccacggcaatcgacaatgcttatctcaatgtctttactaatcatccattcttaggcggcggtttgcaactgtttcctgataaggcagataatcgcaacaccttgttttttgtccaggtgcatcgcgaaaaattgggcattttgcttcaggtcctatttgccattctcagtggccgttcagttcaccgcgccatgcaccattcacaagggcaaacatttgaatttgccacatcagcgactgtaccaattcaaattgacggcgaagaatattcaaccccgattcaggtgacactgcaccaaaccaagcaactatttttgctgccaacttaaaaaagcgtgctagccgcctgcaacaaagacaggggtcagcacacttcatgaagttattttttgcgtaagaaaatcaattttgagaagagataattggcgatcacgatgatgacctgatctaaaattttgacgagaatctcattaccatgcatccaatcgaccccgatgatcatgatcaagttatccagcaacaaggagaccccacgcaacacaagaaagctgattaactcgaaccagaactttttcttgcttgagtagtcactgtggaaaacgacacttttgttggcaaaaaaagcaaaaatgacactgacgatattcgccgttgtattggtcaaaactaagccaataccaaaataccgcatggcgaagaacgtgacaaagttaatcaacgtggtcaaaccgccgataaacaggtaattgatgatcatttcataacgcttatagagttgaaaaagcttcttcaaaacaggcgcctcctatgcaaactttcaatagtataccatggcaggtggggcatgtagaacttcaattgtgagtcgttcttgcatgagtagatcagaataccgtcttaaaattaaaatagaatctggagagctggcggagcggcgatgggctcgaagtcgtgcacaccactctagcttcgcggtcgccaccccgaatcgccgcgtagccagctcggacactaaggataacctcccaacgacagcagaacagaaaaacaacttatttatcaaaacaacaaaccgcaattgatccgttcacccaagcacccttgcttgaatctcacaacgtttcaaggtatgatttccccgaggaggatgacgatgacacaatctaataaaaaacagccaccgcgtaaacatcgttggctttggcgaaccatttttacgctcggtatccttctgggattagcgctgatcttcaatgaacccattaaattatttgtggtcgatcatcttagccagtggacgatggcacaagttgaccgtgacaatgtcaacaaaaatgaaaaacgcaaagcaacctttgatttcaaaggggtcaaagcgcttgatatcaatacagttggcaatgccgcgcttaaccgtgacctgcatcctattggcaaagttgccattcgcagtgtcggtttgaaattgcctatttttaaagggttatcaaacgagaatctcagtgcaggggcaggcacgatgaaagccgatcaaaaaatgggcgaaggtaattacgctttagctggtcactacatgaccaatcaaggtattttgttttcaccgctcaaaaatgtgaagcaagacgacatcatttatatcaccgatatgaagaaagtttactcgtataaagtgaccagtaaacaggttgttaatgaaacccaagttcagtggattgatgatgttgccggtaagaaactgattacaatggtaacgtgtgcatcgccaactgaaggcgaagtggatcgcattattattcaaggccagcttcagtcagttaaaaaggcaacgaagcaacacttgaaggttttcttataatttcggcaagcgcgagcgaatgcttgcgctttttttgattttgcggcaggcttagtgtatctcgttaagaatgtggggaaaagtatgtcaggttacgaaaagttcatcaataatcttccggttaggcgcacagtggtgttgttttcagtctttctcttattgtggtttgctcgcagcattatgagcgatattttgttgaccttcattttcgcgttcctagtcagccgcttagtccacgctgttcagcggcatgttcatattcgcccatttgtgattgtggtgccagtttacatacttgtgatcctaggcctagtctacgctgcagtgcattacgtgccagcgattattcatcagacgattggcttgtttaattctgtgcaaaacttttataacagtgaggcgttcgccaacaatcaggtcatgcaatgggtgctgcaaagcacgaagagtctcaacttgacagaacaacttaagactggcgtgaccacggtgctacaatacgccggcaatatcggcgccatgggattgacgctgtttgtctctttcattcttagtttctttttcacgattgagcttgacagcttgcctgcgtttggccaactgtttctggattcaccgttcggctggtatttcaaagatctgcaatatttcgcgatgaagtttatcaatacttttggcgttgtgatggaagcacaaatctttattgcagttgtgaataccgtgatcacaacgattacgctactattcttaaaaatgccgaacacccctagtctcgcgattatggtctttttactttccttgatcccagttgccggagcgattatttccttgattccgctcacgattattggttataccgtcggcggttggcaagatgttctcaccattttgatcatgattgcagctattcatgtgctagaagcttatgtcttgaatccgaagttcatgagcagccgaacacagctgccagttttctttacctttgtcgttttgttagtggcagagcggttatttggcacttggggattgattgtcggcattccgatctttacctttttcctagatgtattgggcgttaagaaaattgctggtacggcgcacaagcaatcaacctacgcgagtgtgccgcagcccaaggagcacgatgacgatgcataaacaccgttggctgattgtgattgtattggcggtagcgttggtggctgcaacgggcttaacgatggcgtgggtgtatcatcaacgccaagctagtaaaattgtggcgcgtccggtgccgcaagcgcaagtcggcaaacatgcccaagccttgattaagaaaacggcgttcacgggtagtgtggctttgattaaaaacggtcagattgtttatactggcggcgtcggtgacgcggatcatggtaaacatgaagccaataacggcgagacaatgtttcctttggcgtcggttgaaaaatacttaacggcactggtgatcggtcatttgattgccgagcacaaactgtcatttaataccaaactggccaagtttttcccgaaaattgatcatagtaaggacatctcgattcggcagttattggatcaccgttctggtattcaaatggacgaactaacgcctgatcaaaccttaacctcggagcaggctattttggactggacattcgagcagatgggatcgactggcgaccacagcttcatttatgctaatgctaactatgcagtgctagcggggattgtgcgtcaagttacgggtaaaagttttgcaaatgtcttacagcaaacgatcatcaccccgctacaactgacgcacacccataactttacggcgctgacggcgcagatgcctgttgcgcagggctacttaacagccggtgataacgattatcaaccagatgagctgagcaacgccctgttgtcgactttgttgggcagcggcagtgtgtatatgagcgcaacggacttggctaaagtcatcattgcggcagagactgggaaaatcatgccgttaaaagtctatcatcagctgattaacgccaattatggggatggtaatccatatgccagtggcgtgatgtggttagacgaccagcggttattacagggaatgtacaacgacaatccggaaagtttcagtaccttagcctattttcgagccgatgcgaaaagcggtgtggtcttgtttggcaatcatacaatgtcaactgataccgtgagtcttgcgcagaacctagaggcattggtcaattgagtgacgaccaaaaaaataggccttaagatcacgacactacccatgtgtcaggtcttaaggcctatttttgtctaaaaagccgttggattaagcagtagatacttgtctaaaagttaaagctgcggccaaaatcattgataccttgaccaatgccgccgagaatacttgaaaggccgaacgtcatgatgatcaagaacacgatgactagtaaaataccaacgattagataggcgtagattttatcaaaacggttggttgactgagcggtgaacaacatatacgtgccagagatgacgaataacccgctgcccagcgatagcagcaaccaaatcaggaagattgaaccgatgttaatcataccaagcatttgcatgagcagcgtgaacactgagaaaaagaccatccagttgcagtgaaaggcatactcggtggtaaatgtcagaaaagatcggcgccgatcgccaagcatgccgttgacgactaagtaatagacggcgaccactgcaatcatcaggaccgccactagaaagactaattttaggaaggtcatcaacacattactagcaattgcgcctggcaatgacgacactgcggaaccagtcatcaaggcaatggttaatgccaaactaacaatcgtgatggctaaactggttagcccaaaatactggtgatatggtcgcgtcacagtcgcaggatgtttaatgctgtcgaccagatagcgccagtaactgccagcatactttttggtagcctccaccgtgggatttggctcctctggcggtgtttgtgcttgttgctgcgtttgatcagcctgctggtaaggctgcgctgtcggtgctggtccttgagccgtttgctgactttgtgtctgtatgccagctggttgtggtggcacttgctgctgactgttgtcaggcggtgtgacctgactttgcgcttgttgcggcgttacaggttgattctgagctgacgatgaagttagactgcttggcactgaagattgttcgctaacagctgctgtgttggcggttgaggcttcattctcagaagtcggttgtgcactttgaaccgccgtttcggctgttgcaacgacaccggctaaactggtgccgcatctggtacaaaatttagcggtggcagtattatgcgcaccacaatttggacaaatcttaaacatagtgttccctccaaagatatgtatgagtgctgaatataaagaatgaaattaaagttgtacaaaaagagtataacaaaaaactgtctttatcattaacgacgatgaaatattcgatataacgcgcctgcgattaaggcaaacgcaccgccaagtaagattagatccatgacaccatgaaccaatgacaacaggccgcttgcattaaccgcaacctgcatggcgggaactgtcagatagacgataaagtaaatgacgctgatgagccaaacgccagcaattgatagccaaatttttttcacatgaacctccagaaatattttcagtaaaaggtgacaattatgattgtgatgcgtgctaaaagttgccaaaagcaaatcaagccgcagttaatttgcgtcgtatgttcttttggcaacaatccctttccaatataccagagaaagcgggtgcgaacttactgaaaatggtgtaacatgagattctgtaaacaggcagaagactgtcaaatcataaaagcgaggtattctctgatatggcgaaattagtattgatccgtcacgggcaaagtgaatggaatttgtccaaccaatttaccggctgggtggatgttgatctgagtgaaaagggtgtcgaagaagcaaagcatgctggccaattggttaagcaagctggtcttgaattcgatcaggcttacacctcagttttgacccgcgcgatcaagaccctgcattacgtcttggaagaatccgatcaactttggattccagaaatgaagacatggcgcctgaacgaacgtcactatggcgctttgcaaggcttgaacaagaaggaaaccgctgataaatacggtgccgatcaagttcacatctggcgtcgttcgtatgacgttttgccaccattgttgaaagcaactgacgaaggttcagctgctaaggatcgtcgttacgctgatcttgacccacggatcattcctggcggcgaaaacctgaaagtgaccctcgaacgggttatcccattctgggaagatcatattgcaccagatctgttggctggcaagaatgttatcatcgctgcccacggtaactcactgcgcgccttgaccaagtacatcgaaaacatttccgatgcagacatcatgaacttggaaatggcgactggcgaacctgttgtttatgacttcgacgaaaagttgaacgtcaacagcaagaataagctgtactaatccaaaaatcaattgcttaagtgattgaaaagacggctgtcattgcgacttttagttgcgaggatggccgtctatttgtttgcggtcaaatttggttggggttgtttgattggaccatttaccgtgagcttattgttttaagcataccagcgtctagacaaagtgttcgaattgtcttgcagttagttgcgccaattggctgactgcttgataatcagattaaccgattcgagaaaagaggcagttaagtggcaaattatattcgagagattcgcagcaaagtcggacacatgccgatttttttaaacgctgttgccggtgcggtggtgaacgagcagggacaattgttactgcaaaaacggacagatgccggtaactggagcttgccaggtgggatgatggagtacggtgagacctttgtcgaaaccttgcaacgagagatgaaagaggatgccggtttactggtggaaccagtcaaggcactgcatactttcgaccaaggatttacaacttatcccaatggtgatcaggcccaaatcatctgccgtttttatctcgtcaaaccagtcggcggcagtttggctgaagcggatcccaaagaaacgttggccttgcaatactttgactttgatcaactgccgccattgtttaatcaacagtcgcgcgacatgattagtttcgttcaggcatatttgcaaacgcactaaccgaggacatggaaattcaaggtgatttaagaactggacaaaatttgttcagttctttttgttagttgttgttgacatagactaacaaagggattagactagcacaatgttagttagacatataagtaactaactattttaaatagctgataactggaggcacatgcatatgcaacgttcaaccacgatgctggcagccgaaaaaaggcagtcaacaccaaaaaagttcgatttccgtagtttcatgaaactaatcagtaccattcacccacattactggcagcttggtcttggactgcttttgggattagtggcgacggccggccaattaattgtgccaaccattgccaagtcgctgattaatgcgttggggcatgcggtcaacatgaatttggtgattggcgttgtcgggctgtttattggttcagcgttgatcagtgctggttcaggtgccgtgttaggcttttttggcgaagatgtcgttgccaaattacgcaataagctgtgggccaagcttttggtattaccagtcagttatttcgacaccaccaagtctggcgaaatcacgtcgcgactggtgaatgattctactcaagtcaaggatttactcgccaactcggtaccgcgcatggtcacagccttgatgcaactgatcggtgcgctgattttgatgttgatgatggattggaaaatgacggcgattatgtttgccgttgtgccgcttgttattctgatcttcctgccagttgccactcagtcgcgtaagattgctttttcgcgacaagagaatctggcagcttttagtggcgaggctggggatgtgttgggcgctgtacgcttggtcaaaagttccaatgctgaagcagtcgaaaagaaaaccggtgatgcccgcattgatcgtttgtatcgcttgggcttgaaggaagcagtttatgacgcggttgcccagccagtaatgacgacattaatgatgggtatgattgtgggcgtgctcgcatatggtgccagtcgggttgcaagtgggtcaatgaatatggggaccttgtttgctttcttaatgtatctcacccagttgattgggcctttttcaacgcttggacagttttttgcggagacagcgaaagcgagcggttcaacggcgcggattgatgagttactgcaacaacctgaggaaagtcgcacaggtcgcccgctaaaagatgccagtggtcaagctttgacaatgtcgcatgtcagctttagttatgatcaggaaacgccggtgctaaaagatgtcacggtgacagctgcacctaatcaggtcattgcctttgccggtccgtctggtggtggcaagtcaacgattatcagtcttttagaacgcttctactcgcctgatagcggccacattttgatcggggatcaggacatcgcaaatctgaatgttgaagattggcgtgaacagattgggctggttgggcaagatgcaacaattatggcaggtaccattcgttataacttgacgtatggggcgacgcgcaactatacagatgaagagttatggcatgtgcttgatatggcgtacgcaaaaacctttgttgaggccatgccgcagggactcgatactgaagtcggcgaacgtggtgtcaaggtttccggcggtcagcgacagcgactcgccattgcccgcgcctttctttgcgatcccaagattttaatgctcgatgaagcaaccgctagtcttgatgccgaatcagaaatgatggttcaaaaagcattaactaaattaatgcatggtcgtacaacgattgtgattgcccatcgactaagcacgatcatgaatgctaatcggatctacttcattgaaaatggcacggtgagcggaagcggcacacatgaggacctgatcaagtcgcatccaatttatcgcgagtatgttaaagatcagttcggaaaggccgcgtaaacgttaaaagtaggtagtcttgacaaaaactaactaacggattatactcatgctattagttcatgggatagtagactaactaaaagacaaggagaatagcgatgacaaaaacatcagaagatttattgaaggcctttggcggcttaattcaaaagcgtccattaatgggtgccgtggctagcagcttgcgttttggtgatcgacagcgccagccaaatcaattaagactcttgcggctgcttgataataaagatgaactgacgaattcagatttggttgaggcgttggacattcggccaagttcggtgtccgctttagttcagaaactagaggatttagggttgatcagccgccgcgagtccgaaaccgataagcgcgttcagctaattgcgctcactgatgacggcaaaaaatttattgaaacaacgggtaaactgaagacggatttacctgatcaaattttcagtggtttgtccgaagaagagcaggcgcaattactgacgttgattgaaaaattgtctgccgatttggcaactagggatgaccttagctggccagaaggcaaacagttcgatgacatgcgcgaatgggccgcacggttccatcacggtcatcacgagcatggcccacgtcgcggctacccaggtggcttcggcggcggcccacgaggctttgaccatcgattctaaatagtgacttgaatggacaggctgcgatttaattgacagctgtcaatatagacggctgattttccgcaattcatagggaaatcagtcgtcttttgttttctcgtggatattttggagataaagatcacagtgccaaggcagagtagtcgacggctagatgaggcggctcgaagcaccggcaccgcgctagccccgcgtcgtcagccctctctgaccagaggttgtggcattggggacgacaaagaacttttagtctgcagctttttccatgatccaatcgcgcatctttgctaaacagttggcgaataaagttggccaatactgacaactaagtgagttttcgttaaaaaacttcgccgaaactttactattagccgcgaaccatgcaagatgaatctaatagtatgaaaatggagggaactagcttggcagagacgatgcgttattgtccaaattgcggtttcaaaataccggctgggaccaaattctgtccgaattgcggcgcagatttaacaatcttcaatgctcgggttgctggcgagacggactttggtcgtgagcagtcacaacaactagctgcatctgaaccggttcgtgaacaggtacgaggagaacgctcacgccgacagcggcaaagtggttcaaccagcatcaaaaagagtctggtcctaactgacgatagtttcgatcattttatcgattggttggcaactcacatggtgtataccttgatcggagtcatggtacttttttgtgtctttagtttttcaacgatcgctggatgggtgttggcagttggctgtgctgtcgccatttatgttgttgcaaatcgccgaccagtggcgtcttatactagtcgctttaacgatgacgattcaggtgactcagatgatgatatttggacagcgccgcggccagcagcgggtcaatcggtgccaccgtatcctaatccgtatatgacgcagccggacaatggcccgatggcgcagcaagcacagaaaatgagcaatcgttcgccgcattggtggttgcaccttggaaccacagcaggccaaccgagacgaagaggcggcatcatttggctggtttacttaatcgcgtcgctagtggcatttacagcggcctatgcctggccatttggtgccggcagtgtcgccacggccaatgttggcggcagtttgtatgatcttgtccgcagtgctgttaccttggcggaaactgctgcaaccaatactggcgttgcttcgcctcaaaccaatctgccatacttagcgcttattttagcggggataggcccagtgttaggccttttgttcggactttttcggtcacgcggaatgatgcggtttgctggcatgttaggtttgttaggctacggggccttatattttgcctatgcgccgttgatgagcagtgccaacaaccaaattcaaggtttgctgaatcccggcatcgggttttctgtcggtattggcgcggcgttggttatgttcgtcaccgccaggttgttgcccagagactgatggtgttttcgatcaaaaaataaaagatgttctgtaaatgccgtcagtgttgtaggattaagaagtaggtcacaactgtcttcagttcctgggggtaggcacttgaaaaaagataaaggaaggttaaggcgagcttggttgctggtatatcgtgggggcttaacctgtgcatcgcggtaaggcgtgggtcttagctggtttcggtgtgttgatgtttttgctaataggagcatttattcgacattctcaatcgacggagccgcacgcgcctgcgactgttagtcgtcagcggcagtcagccataactaagcagtctagcaggaagacacaagcagcatcgacaccgtcacagaccgctcctcctattgcgggttcaacggtagcgcaaacaagtagcagcttggcggcgttcaccttttccgcgccaaccctacatcgatcttggtcatatatggcctatgtgccagctggctacgatccgcacaaacgttatccattagtgctcatgctgcacggcatggatggcgatgacaccaatctggtccagttagtggattcgaaaagcttacttgatgaagctgttaattcgactggtcatccagcagtggtggtgtttgtggatggtggcaatagtttttacgttgattcgccagcagaaaaaatgcagacggcaatcatgcaagatttactaccacatttaaagcaacaatttgcgcttttatcgcaggcggatgcccatgcggttggcggcgtgtcgatgggcggctacggtgccctaagactggtgctagccgaacctcaacagtttcggatcgccgcggctttgtcgcctgcagtttggcagcaggtacctgaagcggcccaatcacgaatgccagcctttttaactcatggccaatgggatcaggcccgttgggatgccgatcaacctgccaacatgctgacggcagaccgacttgctggtttgaaagtttatttggcgtcaggacaagctgatacaactgtgccatttactgatgtcactcattttgcctcacagcttcaggcagtgggggtgacaccgactaccagctggtcagcgactggcacacatggatttaactattggcagcaggcgttgccagcagcgtatcagtggttgctgcaacagctaccaagagcaacaaccaactaatatttaaaaaaagctgcgctggcttgcagcaaagaaattgagggggcgtttttttatggaatattgtccaaattgtggcgtacaagttagcgctgacgaagccttttgccataattgcgggtttaatcttgcccaatatcgtgatgaaaagggtggcctggcacaagaacaaccggcgcaaggacaaggtagtgaagtgaatggtcagatgcaaaccagtcagccatcaggacaacagccactggcttcaggggctgtgccgccgaatgcgacgcgtcggcgatcaaatggtggcggtgggcaaaagcaaccgcatggccgtccttgggtcattgttagtattgtgttgatggcagctgttgttttgctagcagctttcttattctttcaaaaccgccagcagcaagctcgaactgaggcactggattcatccagctcagcggcggcgagtgcctctgcttcgtcaattgcggctgcatccgcctcggattcacgagtggctgaatcaagttcggcttcggcctctcaagaagcagccagcgaatcactcgccaatgcccgtgaatcggccgaagatagtcgcgatgacgatgagagtcgcagtgacagtgatttaagcaatcgtgaagttgcgcaaatggcggccgattatgacgattttgatttggatgactatcgcgtcgaggtgacatctccggcaactaacatgaaggaagtcgatgtttacgataaagatagcggcgccttgcacggtaaataccgctatgatgaaatccatgatcagatgagcaagtttaacgatgattccggtaagtggacgttaattcatggggatgatgactagtcgtcaggcttgaaatatacgatggtgactgagattctccgaattaaatattgaaaaatagtcggttctaacgatgggattcttttcgttgggaccgacttttgtttggacaaaactgacggataatgatccagatccgtcgcagggtatgcattttctgagttggcatgcggcggtgctaatgacctgacgcatttttacaaaataaaacaatgcagcattaaggtgtccatgaaactgttgcatatgaaacaaaaagacgtatactggttatcatggaggttttgataatgcaaagtgaatcgaacatttccgggctgatttatcagctcgcaaaactacagaagtattttttgaatcaacatttaagcaatttggatctcaatagcgatcaagctaaggtgcttacttttattgccgctaatccaggcgctaatcaacgacaggtcagtgtcgaattaagtcggggaccggctagcgtgtctaatttgattaaaagtttgatccaacgcgggcttttggaaaaacgaatggcaccgcacagcgaacgtgagcggcaactgtttttgactgatgagggcgagacaaccgccgagcaagttcgtgatttgtttcaagtactggaaaaggcctttgcggcaaacgtgcctgatccagaagcactgacggtgactctgaagcaagtgttgaaagccttgcaataaccttgccggcgtttatgaccctttgaagggagcaaaatcatgtctttaaccatcattgaacgacgcaacacgaagaaagaactggcagctaactttaacttggctggcgtcacacttgagcaagctgcccaagatcttgcgaccacgccggagcatgtcgaagcggttttgcaattgcaggttgatcaaattgaagagccttggattcttcggaattacctcaacaagcaacttgctgcacaagggaaaacgccactaccttacagccgcctacaaggcgatccagccgtacactggtttttaaatactgatttgattgccaaaggccgattaaattaagtctcggtaagtaaaataacaaaaacatcaattaccccttggcgcctgctgagaaacatgctacactatgcacaaattacagcaagcagaaaggtgtcccttatcattgattggcgcgacaaatgaggagttattcgctttacttttccctaaaaacttccccacattgctagtggcaaagcaggcacggcggatgctatgcatccgcgcggcccatggcaatgtggaggccgcacggttattacgcgtgcgagccactccaatccgggttgtttacgcggttaaagcgagtcactaagaaaaaaagtgggttggtagtccggctgtttaagtcgggctttttttgtgtgctgaggaacatgccagcgtccattccttaccagtttgggagaaagtagcaagtcaccacgctaccagctggattcatcgatacccgtcaactgaacgagatccgagaaattgccactattcgcgtttcttttacccttaaaaccgttacaattaaagtaataagaaacgatcaggttcacactcaaaaaaggagcgataactttgaagaattttcgatttcagaataaaaccgatattcgttttggtacaggccgattagatgttgagctgcacgacgcggtgagtcaatttggttcgcgtgttttgttcgtttatggtggccattccatcaaaaagtcaggcttatacgataccgtgactggactgctcgctgatttgcagttaaccgaattgccgggcattgagccgaacccgaagatcgattctatccgtgctggccaaaagctggcaaaggatcaggatattgatgttgttttggcagttggtggcggttccgtcattgatgctgcaaaagtcattgccagcgccaagttttacgaaggcgacccatgggatcttgtcaaagatcgtggtgtaactcgccggaaattgcagcaattgccagtcgtcgatattctgacattagcagcgacaggcagtgagatgaacagcggctccgtgatttcaaatcctgtcactcatgaaaagctcggcacagtcgggccaaacacaccagcggtttcatttttggatccgtcactgacctttactgtgccagccagacaaacggcggcgggatcaatggatattcttagtcatttgcttgaacaatattttgatcgttcaaaaaataatgacgccagcaaaggcatgattgaaggcttgatgcgtacagttattaagtgggcgcccattgcgttgaaacaaccggataactatgatgcccgcgccaacttaatgtggagcgcaacgatggcgctaaacggtatcgtgagtgttgctaacgaaaatggctggacagtgcatagccttgaacatgaactatcagcctattatgacattacccatggtgtcggccttggcattttaacaccgcgttggatgtcgtttattctgaccaaggacgcaacgacagcagaaatgttggcacaatttggtcgccatgtctgggatcttgaaggtgatgaatcttatgccgtggcgcaagcggctattgacgcgacctttgattggattagtcgcttagggttcccgatgaccttgcctgaagttgggatcaaggatactcagcattttgatgccatggcgactgctgctgttgccaatgctagtcttgaaacgcgcgcctatgtgccgttgtcggtagaagatgtcgaaacgatttatcaagcatccatgacagatgggctggcataaaagtgttagcggtaacgagtctatacctgacattgttgtgccacttttaaagggggttcttttttgacgcaaccaattcttgaacatgattctgttgcttttcaggcggcacgaaacgctgaaaatcaactctgggctgactttcacttaaagcctaagacgcgctggtttaaaattgcgcctgatgatttgcgggttcgggtcttagagtttggtcatggcgaccccgtgctggttgtgcccggcaatactggtgatccatatgcgctagcgccgttgttgccgcaactagtcggctatcatgtttttgtcatggcgcgcccaggtggcggtttgagcgatggatttgatcatgagcaagtagatgttcacaattttgccgtggatttgttcagccaggtcatggataagcttgatctcaaatcagcaccgatcattgctcattcgatcggtgcgcattgggcgacttggtttgcgctggcttatccagatcgggttcagcagctcattttactgggtaatcccggccgaatgcttataaccaaaacaccgacattgctcaaaatggcgatgatgccaggtcttggtaaatggttcatgaaacgtcaaatccctaaatcagccaaacgcgcttggggaccgctgcatcgcatggggactgatccggctgccgtcagtgctttgccgcaaagctttgcggactgtgtttatgcatttgatcatttgccaaactatcagctggcaaccttgtccttattacggacgatgaatcaagaaaagtaccacaatgcattgaaagagtcgcaattgcgcgagctgtctgttccaatgacgttaatctggggaacgaatgatacctttgcgaatcctgaactcggtcaagaaatcgccgctgtcgtgcaacatggtgaactgttaaccgtgaatggggcaggacatgaaccgtggattgacgatcccaaaaaagttggcaccattgtccgacttcggctaaaagaaaaccatttgcgtgctaccgtgtcccaaacatcggctagtgagtggtaagttcaaccgaattttgtaaaaaagctattgtgtattctcaactttagcttttttattttgccatttttgacaacgaaaaccagaaaaaagtcgagatttttttttgcatagttaggcttttttcggtaacccttaaaccccttaaccatattatctgagaccgtattcattctgacacatcaatattctcaaaagataataaacgcaaaaaaggtttgacaatcaaagcagttctgcatatgctttgaacattcaactagtttagttgagagcgtgagctggcccggttagaaatcggagtgtaagtgggcctgaacgtgatggccgtactttggccattgcgtgcagggtccttacacgtagatttctgggtcagcgaacgcgttttgaaaaacggctgagccccatctggcctacgattgctccgccttggcactggtatctttaaaattccaatagactacccaaatgaaaaggacaaacaatttccgcacttatagaaattgtttgtcctttattcggtggctgtgaattatggcccaaccgcgttcccgtaagcaaccggcgttcccaagagactgacttcaagtgtgtctgcgacggaaatgtctttttactttcccgagattcacaatcgcagcaggactagtattgtcacgataatgttataagtcatgtgtgatacaatgcttgtttttattgttccagaagctcgattgagaagactaaaaccaattgcacaaagaagtaagcacaatgaagcaacaatctccaatccgtggagaaaaacaaaaatgagcgaggtcatgagaactgatggccaatagccaaaaatatttgccaagtaatcttggataacgcctctaaatccgagttcctcacatatcggggttaagaaacacagagagataatcattggccagcgcgacggaccagttaatacttttgcagttgacgactgcaacacattgtcagttggagccgggagaaatggcagattattgagtgttattgttaaaacaacaatgaaaatggtccaaatgaccgccatataaaaataacgtgctttgagtgactgattaagttgttgcgttgaagaaggctttatatgacgatcaatgaatagcagtgatggtattgagatactggccgcaataacaataaatagccagtttaataagacaccttcaaaaaagcagtcaactagggagactccagaggcaaggaataagaatggtataaatagaatgatcccgataaccagctgttttagtttattcaaacatttctccaatttgtagaagcttaagaaacaggtagcatcatgcgctgttgacaatcttgtcgctactgatgcttgctggcatgaagctttggattagacgcatacttttcatgcaaacatcttattaatacatagattgccgcgcaggttacgatagcgcttaataccttgatcacattcccgaatatcatattgttcgcccagagagcttcgatatatctgaagatgctacggttaaagagcactatcagcaatgcaacccaaacttttttatcgcgattcattttagtatcatctcccaattagcgcatcatcatggctgaggattggtcatactagaagaccactactcaaatatctattatgtataccaatgaaaccttacaggaaattcgataggacagcaattaagaccccaacaaccaagatgccttcaagaccaagcaaattaattgtaactgaaactgatgatgcttcgtcagtttaaaaataaacgtcgtgttttcagcttttttcgtcataaacatgctggttgcagaataatcgtgtggcaaatccataaagttgatcaccgtcaaggcagcattcttcatccctcggtacactggtctcaaatggagggattagcgatgcattttattcagacgcataaacaagaagcgatgattgctggcggtgtgctgacagcaggcggtctgatttttagtcaggcatgggtgctggtgttggcgagtttggtggcgggcttgccgattgcgatcaatgcattggcggcgctgcggtataagcagattagtattgagttgctggtgacgattgccctggttggcgcggtgttgattggtgagccggttgaaagtgctgtggtcagttttctatttttattcggtgactggttagagcagcgcagtttggcgaagacgcgttcggcgattcagggtttggcggctgcggcaccgaaaaccgcgcggcgactggatggcaccatgattccggttggtgacttggcagttggtgatcaagtccgtgtactggccggcgaaacggtaccagctgatggcaaagtgatcagtgggcaggcgaatgttgttgaagccgcgatcactggtgagccggatgcaaaaagcaagcaggccggcgcaacggtttattccggcacgcaggtgagtgatggtacggtggctattgaagttgagaaaaccggctacaacacggtttatcaacagatcattgatttgattgaagatgctcaggacgcacagtcaccagtcgccacttttatccagaagtttgcgcggtggtatacgccgctggtattgatcattgctttgctcgttggtttgatcaaccaaaatgtccgactagccattacgattttggtattaggctgcccgggtgcattggtgattggcgcccccgtcagcaatgttgtcggcttaggctttggcgcgaagcacggcattttgatcaaaggcggggatgtggccaccaaattggatcagattgacacggtgatgtttgataaaaccggcaccttaacccaaggtaaaatcagcgttgcaacggctcaatattgggcgaacgatgacgccaaagttgccgagctggtggcggcggttgagcaagcaacagcgcatccgttggggcaggcattggtcgcctacctaaagccgcaaacaacaccggctgtgaccgacgtgaaagtcacgcggggcattggcgtgcaggcgcaagtggctgaccataccgttagcattgggaatcaaaagagtctgacgcagccactgactaccgctcagcaagttgctattcaaaacgtgattaaaagcggtgcttcgttggtcgtggcgacaattgacggcaaacttgctgcagtttacggcttacgtgatcagttgcgcaccgataccccaggcatgttggcgacccttcaagctaacggtaaaaagacggttgtgctttcaggcgactcgcaggctgtggttgaacacatgatggcggatttgccactgagccagacccacggcggtttactaccagtcgacaaggtcacggcgatcaaggcagcgcaagcgcatggtgaaaaggtgatgtttgtcggtgacgggatcaacgacgggcctgcactggcgcaagcagatgttggggtagccatgggctcagggatggatgtggccattgatactgctgatgtcattttaaccagcagtcgcctgacgaatctcggcgttcttttcgatctggctaaacggatggacaataatatcaaacagaatcttgtcattgcgatcggaactgttgccttattgttaagcggcttgctcattgggttagttgatatggccagcgggatgctgttccacgaaatttcgattctgttggtcatcgcgaatgccttacggttacggcacaccccccgaaagttacaaaacttgacgacgatcaaggacgccgcagcacaaactgttaataatgaaggtaaataaacaagaaaggatttttaacatgacaaaattagtttatcaattagatggtttaacctgcccaagttgcttgcagaaaattgaaggcgcattaggccagcaagccggtgtcaaaacagtgaaagccttgtttaacagtagcaaggtcaaggctcagattgatccaagcgtgaccaacgccgatgctttgaaaaagacgatcacggacttgggttataccgttgtgaatgtgcgcagtcaagaagcatagagcgagaactggcgcggttagaaaccggagcataagcagccttgggtgtggtggctgagccaattacccccaaggtccttatggaggaggtttcgatgctatagaacgcttttaaaaataaacaagcgcggttaagaggagaagaacatgagtgtaacgacaggaatgaaaagtattaccgctgatcaagttaaagaacaacaagcagctgctgctaaacaggctgaccatgaccatcatgtgccaactgctggcgcgatgagtggccacgtgttggggaacttacaggtgctgactcgcaagctgacgcagtttcgcgtgaccttacgaggtgtggccagtgaaatcgatcggcaactgttagatcagctaatgcaacaagcacaagaccattttgacgaccttgtggctgatttagctgcccaaggcgaaggttttcccacaacgacagcggagttcggtgaatacacgatgctcaaggaagacccagcgtttcgtttttggacgaatgatatgaaattggacgccgttgtcaatgatctcgatacctgccagttgtttgtcagtcgggcgattccgctggccaacaaggagaacaaggctgtattggcagcagatatgttacaattgcagcgctggcatgaacaaagcattctgcgcttgcaaactcgacttggccgccaagtgacggcggggcgggcattgcttgacgaggatgaagatgacgattgatcaagcttgttgcctagattgcataattaaagttaccacccagaaaatgtgaaaaaagacctgtccgtcttcatggcctttatggtctagtcgtcagggtgttgcacttgaattgtaaacttggggttcttttttgatatcaaaaatgtcagaatgaccttaaaaggatggcgcaacccgttgtcagtcagctggtaaaacgcgtatactaaatgcactgattttaggcaatgagcgcgaactggaacggttagcttggtttgacaaagtggcactggatagttgaccaagtattggttcggctaacaggctttcttcacaataaccgagcgccatctggagaacgtatttcaaaagaaggagaatgatcgacatgacatttgaagcaattttaccgttcctcaaggccggcaagaaggccgttcgcaccggctgggaaggtactgagttgtatgtgcaactagttccggaaggcaaattcgaaggtgacactttgaatccgtattttttgatcaaaaccgccgacgaagctttcagtctctggtcaccgactgactgtgacattttggctgaagattggcagcttgtgaacgcatgacgcatttcgacttcaccgacaagaccgtcatcatcaccggcgcggcttctggcatcggtgcggcgcaggcggcggcttttcaggcagctggtgccactgtggtaggaattgacctccaaccaattagcaacctcacagacgccattcaggccgatgtgagcgatcctgccacggcagcagcgattgcggctcaataccagccagatattgtctgcaatacggcgggcgtgttggatggttatcaaactgtgaccgatacggcgctctcggcatggcaacacattctcgatgttgatctcaccagtcagttcttaatgatcaaggcgctgctgccggggatgctggctcgcggtcacggtattttcatcaatatgagttccattgctggtttagtcggtggtggtggcggcgtggcgtatactgctgctaagcacgccgtcatcggcctcaccaagcaattagacctcgattacgccgccaagggcattcgcgccaacgcgctcgcaccaggcgcgatcaacacgcccatgaacgccgctgattttgccggcgacgggaaaatggctgcgtgggttgctcaagaaaccccagccaaacgctgggccaagcccgaggaagtcgcgcaattatccttatttctggccagcgatgctgctgattatattcacggaaccgtgattcccattgacggcggctggctcgaaaagtaaacttaatgcattgcaacactaaaactgaaaacggaaggcaatccttccacgacgatacttactttcctttgatcgtcgttactactggtatagccacaaaggagaacaaacatgcaaacaacttcaaccacccatcgttcaatcgtcagtctcgccaaaaccgccatgatcacgtccatttacgtcgtgatgaccctcatgctcagtccactcagcttcggggtcgtacaagttcggttctccgagatgctcaactacacggcactcttcaaccgccgttatgtctgggccgtcatgctgggtgtttttttggccaatttaacctcgccaaccgcgctcctcgatgtcccaatcggcaccctcggcacgctcgtcttcatcatcatcagccgctggttaggcaaactcgtccagccaaaatgggctaaattcaccatcatgggcatccttttcgccttatccatgttcaccattgccggcgaactgaccatcctcacaaaagtcccattttggccaacctacgctaccatcgcgcttggcgaggctatctcgatggccgtcggtggcgttgtgatgatgattttgacacggtttgtggatttggataagtagtaggtgctttcaacatgctgcacaaactctcagccttagcgtcactatctacaatgatctaattttcgggatttataagagccattcaaggtaggacctgagacaaggacagtttttcctgtaagctgttatatcttcgaggaggttgctatgacaatggataggcagtacgcggttaaagcccatacgaacattttcctgattcgtgggagagaatacgaggtgactgcacccgccaagtttgaccggatcactggagaattggttgacgataagaagctcgacgacgccgcggtagaattggcaaacgagaagtatcgtcaggatatggatatcatttcacctgaggaaataaagaaataccgtgcaaacacaaatttgtctcaacgggacttggcaagtttgatgggatggtgcccaacaacgctggcgttgtatgaaaaaggtgcttttccatctgaggcgaataataaggcactaaaagcgctgatcattgaccggcagatttggagagacatttataaggcatcaagaaatgtgaggatgcctcaagcctgaaaaattcagctcgatcacaaaaaataccagttcagtaaccttcttgaatgaaggctattgagctggtgtttttaaatggaggggacacgccctgaatcttttctgacaaggtcccgaattcttgggagttaatgccccattaagccattacttcttcaatgtctgcatgacatccttagcaatcaacgtatagtaatgcggccggccagcgtcgttcggatggacaccgtcatcagcaaaccagtcgtcattgccaccagccagataataccaatccaccacatgcagattagcatgcgttttcgctgccgcatgaatcaacttgttaactggatcaatccacgcctttccgggagcatacgcggtcacccagaagacctggcgatcactaccgagctgatccagaattccgttaatgtcagcctccgtcatcggtccgttcgtccccaaactgatcacaaccgtgttagccaacttaccacttgccttcagctgactaataatcgcaggtgctgcctgcacctgcctgccaacctcagcatcaatcgacatctccggaaaaagcaccttcaaatatgccgaactccccagcataatcgaatcgccaatcgccgacaccggcaaagttttggccgcattaatctcgctgtcagttaagccataaagccgatactgattcagcaccttttccttcttcaccttcgccttagaatccttctgaatgcgctgccgcgtcgattgattaaccgcaatcgcctgctcagactgagaatgcttgacgtagaagaaccccgcgacaccagcaattgccaatcccaacgcgatacttaatagccagtcacgtagacgtagcttgttttttttcatagtttagtgaacccccaaaagttgcattgcttatattttaaactaaaaatcaggttagtctggttacaagttagggttattctgacgggtttttgcggaattgtaaagagactgtcatattgaagtggcataggcctaaaataggcttttatttttgttaaaagaggttttctaggtactatatgcctaagcatcgtatattatgattgatactgaccattggcttccaacggtaaatctctgtgatcaacagtcgatagacgagaaaagctatttatgtttttgagattttgtgaagaagattcagtgccgatgaacttgaaatacatctcgcaataagggaggcagactaaactttgaacttgttaatcacgggtggagctgggtttattggcagcaacttcgttcactttcagcgtcagatgcatcctgcggatttaattgtgaatcttgatctgctgacatatgcgggcaacaaaaataacctaactgacctaaagcatgatccaagtcatatcttcgttcaaggaaacattaataatcgagaactagtggcttatttgattgaacagtatcatatagacgccattgtgaattttgctgctgagtctcatgtggatcgcagtatcttgcatccggaaatctttgtcgaaacaaatgtgcaagggacacttgctttactgcatgaggcttaccgacacgatattaagctcttacagatctcaacagatgaggtttatggttcattaggaccgactgggtacttcacggaagattcgcctttacaccccaactcaccctatgcggcaagtaaagcctcagctgatatgcttgttcgttcctattttgaaacttatggtacacatgtcaatattactagaagtacgaacaacttcggaccatatcagttccctgagaagctgattccattgatgattacacgtggactggatggagaaaagttgcccatttatggtgatggtaaaaacatccgtgattggttgtatgtacgtgataattgcagagggattgatttagttcttcgtgaaggtaagaccggtcagatttacaacatcggcgcacacaatgaatacgataacaacaccatcgttcaacttattgtcaagcagctcgggttgtcggaatctcagattacatatgttgaggatcgccctggacatgatcggcgatatgcgattgatccaacgaagattctggatgaacttggatggaggcctgagtcaaactttagaactggacttgacgaaacttttggatggtatgcagtacatcaggattggtggcagccactgaaggataaaatgattcgaaagtagtttttgcaagtttaatactcagtaatttgaaagagttcctaaaatactctctgagaaaaggtgaatcaagtttttaagaaaactgatcaccgtcacaagatgaaccaagctcttttcatgtcgggtaagtagaaatgtaaagagactataatacgtacaatagccttaaaagttgtcactttaagaaataaaaagtgatgactttttgttgtttgcacggctgagccccatctggcctacgattgctccgccttggcactaatatctttaaaattccaatagattacaataagaaaggcaaacagtttccgctttacagtggaatttgtttgcctttttgatgattatgagtgatgtcccaaactattatgtctgaagacaacggtggctaaggtttacatggtgacggccaaggtttcgcgcaggccgctggtttggtaaacgcgggtatctttagtaacgaagatggcttcctcaccctcggcttcaacggcatcgtaaccggcagggatgccagcataaaaaccgatggaagataacacgtctccgatcaggccactatcggccacgacggtaatgctggccatgtctgattcgacgggatagcctgtgttaggatcaagcaaatggtgatattctttgccgttgatctctgagtgccgctcataaataccagtcgtcacgacggctttaggggtggttgtcaaggtggcgatactgcgttttcccggtgtccgcgggtcagtgattggccactgccataacggtacgccgctggctgcattacccacgagccgctgattaccacctaagtcaatcaacccaccttcaacgccggttttgtcccaaagatcatagacttgatcgacaatgaaacctttggcgataccgccaagatcaagggccatgccgggtttggtcagaaaaacagtttgattttctgaatcaagctcgacaagatcgggatctgtcaaagcaagcgcggcagtgacttcttcggcagtcggaacatgggcatcatcgaaaccgatgcgccaaagtttgacgatcgggccgattaaggcgttgtaacctaatccgcgtttgctccaggcgatcgcttgagcaatcagattgaacacagggcgaaccggaatgtgaaccggttctttgccggcctgcttgttgatcaaagtcagcagggatgcttcatcatacagcgataataaatgggcataagcattaatcatgctgatgctttgattcaatagttcattagcaccatctgcataaacggtaagcgtgttatccgcacccaaaccatgaaaagtggtcgtcgtggtcatattggcacctccaaaaataatcgattgacatgcattcagtatgaacggtttgcatattggttgcaatcgttacgatttcaggtaatattcgttatgagtgaaatttgatgcataccgtgttctaaagacgcaagtttctgcaatcgtaaacgcgtttataaggaggccatcataatggcggcatatagctctgcgcaacaagaggctttaaaagagtttaagcaagatattggacatctcaatgcgttatcgaattcaagtcgacaaaaattgattatgattttgggaacggcagacaatgatacaggcttaaaagtcaacgacttggctgatgctatcggtttgtcacagccagcgacctcgcaccatctgaagcatctcaaagacattggcatggttggctcacgccgcgaaggcaatatggtttattattatctgaccttagatgacaccattgctcgattggaacgattgacaagcgctttgaagcggcaaaacgaaaacggctgatatgaacgatgcttgataaaacccggctattgctgggctttttttttattgttatgaaaaattttgtaagaaagcgctctcgctatcattttgtaaagttataaccagtcaccggtgcgttatttgaattataatagtctttaataaacaaattaatttagtcaggaggatgtcgcatggatgctggtcgaaatattttaaaagatgaacaacgccggtttgcccgcctgaaaagtgcccagcatgctgctgcactgaatctgattgtatatggcgggttgaccgtggcagaattgtggatcgcgcagttagcgcattctcgggcattggctgcggatgggttgaataacctgactggtgtggcctctgcgctgattttactttggggtttgcagatttcccaacaacggcctgacagtgaacaccgatttggccactggcgctttcaaaccatcgcaacactcttttctggcttaatcatgctcgtcgtcggtctagatgttgtcattgacggttatcacggtctgcaagcttggtatcaaggtaagctgcaggttcccggagaacttgcggtttatgttagcttagcggcaggattggcaatgggcaccgtttcactgattaaccatattagggcgaagcaattggacagcagtgttttgcgagcggcggccaaggatagctttgccgacgctgtgaccagcggtggcacgttactcgccatcttaggtgccaaagctggctggctttggctggatggtggcgcagctgtggccgttggttgtttgattttatatgcggcttggactatcctgcgagaatccatttttgaattaacagatggattcgacaccaaaaaaattgctgcctaccgccaaaccatcagtgcagtcccaggtgtcaaaggcgttcaaagtattgaagcacgatatgcaggcgatgctgtcttgctaaccatcggtattcgtgtcaatcccaatatgaccgtagccgattcctatgatctaggagagcgcgtcgaacgcaggctcatggatgaatacgatattctagacgctgacgtcaaagcctatccagccgatcgagatccaaaagaagcaccacaggacccgcaaaagtgaaaagttaggcgcacttcagaagtactgcgtcgttagcgcgaactccggaagaatgtccaaaaagaatagaaccgttcgcctacatgtgttaagatctaaaccataaagtcaccagatgagccgcagtagtggtcctaggcaggtctaagaaaaacggtggttgctgcaaaccgttccgcctttgatcacgaattacacctcaatgaaagcctggttaacgggtcatgccgatatccattagagtgatgcaaagcataatgtgggtggtaccgcggtgaaaatcgtccctgatcgttgaagatcaggggctttttttatgccattgtgaatgaccttgaccaacgatctagacgttgccatcctgcatctcagctcacaggtagcggtaaattctggcaaagacaaattttagtcaagagcgtgaactggcgtgcttaaaagttaaatgtaagcgccttttggccataatagccccaaggcgcttatacagcggttgctgtgccagcaaatgtgtttagggaggaacaagtaacatgacagacagaggcaaaattttagacgaattaaagtggcgtggggcgttgaatcaattaactgatgaagatggtctgcggaaactgactgaggaaaaagcagtcagtgtatactgtggcaccgatccgactggcgattcactacatgttggccatttgattccgttcatgattctcaaacggtttcaacttctgggccatcgtcccgtgattgtcattggtgggggcactggctcgattggcgatccatccgggcgtaattccgagcgggtcttacaaaccatggacacgattgctgcaaataaaaagaaattgaccgcccaaatggagaacctattcggaaccgatgattttcggattgtcgataattatgattggttatcgaaattatccatgcttgattttctgcgggattatggcaagcttttttccgttaacagtatgctaaataaagaagtcgtcgccagtcgtttggaaaacggcatctcgtacacggaattcacgtatcagattctgcagtcggtcgatttcctgcacttgttcaaacacgaagatgttcaattgcaaattggcggggccgatcagtggggcaatattacggctgggatcgatttgattcatcgcatcgagggaccagaagcccgtgcttacggtctaaccaatccattgatgttgaaggctgacggtaccaagttcggtaagtctgctggcggcgccgtttggcttgatccggagaagacgtcaccttacgagttctatcagttctggttcaatcaggatgatgccgacgtcgagaagttcctcaagttcttcacgttcttgtcgcgcgatgctattgccgaattggttgaagcaactaagacacatccggaaaaacgtgaagcacagcgtgaattggcgcgtgcggtgacaaagtttgtccacggtcaaaaagcggttgatcaggccgaaaatatcagtgctgcccttttttccggtgatgtcgctgagctgagcgctgatgatatcaagcagggtttcaagcagtttccaacagttgaggcaccggagaccgcagaaaacattgtgacttggttagtcgacactaccaaaatcgaaccaagccgccgtcaagcccgcgaagacattcaaaatggtgcgatcacgatcaacggtacacgtcagcgggagctcgatttcgaggttgatccgagcactcattttgatggccaatatgtcatcgttcggcgtggtaaaaagcggtactttttagtcgatatcaaggcagcaaagtaaccccgtaagtcgcatgattggtatagccaattgactattaaacaataactgttaataaaaatgacgatgagcgatttagacctgtgataaaacaaacgtttaccacaggtcttttttggtgcgttcgacgctctttttcttcttgaaaataactgaaataaaaaatctttatgaacttccttatatcaaaccatgacaatatgttgaagaaagtattctgatagtaaacatgctgtaacgagactgtaacagtccagtgttaatgtagcagttgtgaacaaaacgaaagcaggagtgacgataaagatgaaattaaagcaattagttacaggctttatcacagttgcaacattggctggggttggggtttcaggggtggctgccacaacagttaaagctgatgacgataagtctagtttgactgccaagaatgatgccttgctcaagcaaatccaaacggcaaatgaaaaaaccgcgaagttgagcaatgatgtttctaacaaagcattagacattaagaatgcggaagaaaaaattagtgctagtcaggctaaaattgcctcttacaaccaacaaattgttaaggcgcaagtcgaagtcggcaagcgtaaagacaatctgaaggaacaattgatttcattgcaaaagcaggttggtaattcagttacaggcaatatctattttgactttgttttgaattcaaacagccttacagatcttgttggtcgctcactgacggtcaacaaacttagccaagccagtgcagaagcattgcaggcggttaaggattcacaggccaaagttaagaccctgcaaactgaacaagaagccaagcaagaaacacttgttgcgacaaagagccagttggaaagcgacaaggctaaaatcgaaagcttaaagagtgatgctgaaaaatctgcatccgatttacagcaaacacttgaagctaacaaagataagttggctcagttggctgccagcgaagatgctgctaaagctgccgcagcaacagctgctgttgccgcaacaccatctgcttcttcaaccagcaccgcctcaagcagtgcagcatcaagtagcgttaacaccagcaccaataccagcaccaccagtgcttcttcaagcgccagcgcttcacaagcgcctgcttcaaacaccagctcggtttcagtttccggtggcagtattgccagcaacgccgctaagtatatcggggttccgtatgtttatggtggcacttcaccatcaggctttgactgctcaggcttgatctactatgcagctaaagaagctgggatcaacttaccacggacttcccaagctcaaagtacgcttggctcatatgtttccgtttctgacctacaggccggtgacttggtcttctggggcggcgttggtagtgcttaccacgttggtatttacattggcggtggccaatatcttcacgcaccagctcctggtcaaagcgttacgattcagagcatggcatacttcgcaccaagcttcggtcgtcgtctgtaaaaatatcgttcacatcctgcaatagcatttgaaaggtcgatcaagcgtgatcgatctttttttctactctaagcaaaacattcttttataaagggggacacacgccatggtgacaattactgatcaaaaaccaactatgcccgaggttttggcactttataaaagtgtccgttggagcatgtatactcgcgaacctgcgcgacttgaacgggcactgacccattcattgatggtgttaggtgcgtatgagggcaaacagttagttggcttaatccgagcagtcggtgacggcgaaaccattctttttattcaggatctgttggttttgccagaatatcagcgtcgaggtatcggcaaacaattaatagaagctttgctggcgcggttccctgaagtgcggcaacgggttttattgacggacgatgatccgaaaacgcgaaacttttataaagccgctgggtttgtggagagtcaacaagtgggcgtgattgctttttatcatgataagcattagccattcttagttggtaacagcgttattgataaaccgaatcaattaacctgttttcaagctgactaatccgcgctgatttggtacaatcgaggcaatcatttaagaggaggctgatcatgaaagctgcgcataagttgattgtgatcactggggcaacagggactggcaaaacgacggtgagtggttatcttcgcgataattatcgcatccaccgcgtgatgacgcacaccacccgtccggcgcgcacaggggaaaagaatggggtcgattactatttcgaaacaccggcgagttttgcgaccaaacattttatcgaaaaagtcacttatgctggttatgagtacggttcctcccatgaatcgcttgaaaaaaactggaccaagcatcccttccttagtattgttctagacacaaaaggtgccattacctatgtgcgtgagttgccaaaggaggtcgtggtcttatttttaacaattgataacccaacggtattaaaagatcggttgttgagccgtggtgacgatcctgccatggttgctgcgcggttgaaaagtccggaatataaacgcgatttaaccttgccagacgaactaaagccgtttgccactgtgatcaaaaatgacagttgggatgaggcgcgcgagcaggtggatcaatttatgaaaaccttggctttgaaaagttgcggccttgcccgcatcgatttagaacaaaaataaggcgcgagcaccggtgatcatcaccgtggctcgcgccttgctacatgttgtttgaatgttggcgctacgatatttggaggtaagcgcacgattgtgaggtacatttaaaacggcttcggattcccttatgattcaaggtccttatgtgtaggtttctgggctggttcgcgcgttatagaaagctaacctcgctccccgagcctcgcattctcaacctatcaaaaacttcaaaaggagcaaactattggcacagtcagaatcaaatcaagtcaaacgtgaactcaaaactcgccatctctccatgattgccttaggcggcagtattggcactggtctctttgttgccagtgggagtgcgattgccaccgctggaccaggcggggccattgcggcgtatgtcggcatcgggttgatggtctttttcctaatgaccagtctcggtgaaatggctacctatgttcccgtttcggggtcgttctccgagtatgctagccgatttgttgatccggcatttgggttcgcacttggttggaattattggttcaattgggcaatcacggtggccgttgatgtgtccaccaccgcaatcgtgatgcatttttggctgccagatgtgcctggatggctgatttcaatggggttcttagcgttgatttttgtcatcaacattatttctgttaagtcctttggtgaaactgagtattggctttcattagtcaaaattgtcacagtgctggtctttctcgttgttggtttattgaccatcattgggatcatgggcggcaatggcccgattggtttgaaaaattacacaaccggagcggcgccatttgttggtgggttgccagctaccctagccgttttcgtcgttgctggtttttcttttcaggggactgaactgattggcattaccgcgggagaaagtgccacgccggaaacgagtattcctaaagcaattaaacaggtgttttggcgaattttgctcttttatattttatctattgcgatcattgctgccatcattccctataccagcccgaatttattaggtgcgagtgtcgatcaagttgcgatttcgccattcactttggtatttgatcgcattgggttagcaggagcggccagtgtcatgaacgcggtcatcttgacatcagttttgtcctcggctaactcaggaatgtatgcctcgacccgcatgttgtgggcaatgggtggttccggctttgcgccgcgcgttttccagaaaacgaataaccgggggattccagttgcagcactgctgttaacaaccttggttggtgctttcacctttttaaccagcattatgggaccgcatgtctatcaactactggttgcagcttctggtctgactggctttcttgcatggttaggcattgctgtctcacattttcgctttcggcgcgctttcgtggagcaaggacacgatctgagtgaactcaagtatcatgcaaaatggtttccggttggcccaattctggcgattattatgagtctcattgtcatcgttggtcaggatttgcaggcagttcaaaattttgcctggggtcgattactggtttcctacatgtcaatcccgctttttattgtcttattcgtctggtacaaagtgaagcatcggacaaaaatgattccgttagaccaagttgatctgtccgctcaccgagatcagcgaaattaacgatgcaaaaaggcagtttccacacattgaactgagtgggaactgcctttttaggtgatgctatcaccatttaaaagtaccagtttctgatgagcgtgctgaagctgttttgccgagataaaggcggcgaatcaacatataaagttggaaaatagcactgtcgtcatcatcaataatccaagtggcaacctcgcctttgaaatccgatggtgctgctgctctaatggcggcttcattgtcgacactggtgatcaccaagtcaacttcctgacaaggcgcatcatctggcaacaaatcaacgacactaagatcgtccagaaagtttaccaaacggcgattgaggagatcatgtcctaggtaaaccagcttcacttgcacaactagtgtttctgagaagtatcgcaaataaggagccaaaagataatgaataatgcgcaaaaatcctgcatttttaccaagaaaacgacggtaggcaggggtgtctggcaaaccagcgatgaacgtttgcaaggtatggtacagcttagtctctgtgtatggcagcccttcaggttgatagtaatccacgatgtgcatgaaatcgccgcccagaaactcattgttcaacgcgatccgagctagattcagaactagctcgtgttcgtgataaacatcgaaatcactgtcaggtcgaacatgagcattcaaaaaagccaagagtcgcttagtgaaatctgtcgtcacggtttttttgtcacttaggtagcggataaaagcatcactcgtggcgtcagttggtaaaaatgtaatggtgcgattttgctgaaagtagaagaagtcgttttcgcttttcataaaccgtgtgtcgtaagcaggaaacatttctttcgtgtaaaccggatattgaaaaggtgaatactcatcgaaaattttgtcaaatggcgccgcgccgtcaacgaaatggttgccacttatgcgtacgcggctgatggcccaaaacaatacttcttcaagaatatcgaccggattctttttggcactaggtaaggcggtgtattcctgaacaattttttgttcatctaaaactttgaatggccaatcgacgccgtggtagccaatccaatagaaggcgaacaagaacaatctgatgcggctttcctgaccggcaaagcctaagtcgctaaaggacagcttaagctgataccgtttaagaagattgcggagagcagacgtcttgcgaaccaacgtggaacggctgatataatgggcacgacagaacttgtctgtggacgggtgattagcttgcacaatgtaatcgacaaattggaacgcgatagcgtgctgtaacaaatacagatgataatcgtccactgtaatatcgatatcgaccagaagactgatttgtttccgtttcattttttctggatgttttgttaaaactgtcaagtcgcggaaaagttcctgcaagatgttatacccttgctgataggaaaggtctaggtgctgactgagggtattgatcgtgtatgtttgaacattggtatctttgatcgctgcgaacatttggaacttctgcagatcagcgcgatctaaaaaagtttgttcatacagcatggtacacccccttatctaaaagcaattcacccctacctacgtcaattataacaaaaaaagtaaaaatgatgacagtttgttagtgaaacattgaactttagggaaacccgctattttctaaagccgagtaaatgaacaataacaatttggtatagtttttagacccgaattgtactcgtaacaggggtgaatgcctgcgtcttgacaaagtatgacgtataataaaagacacaaaatcgtattttaggggtggggagtccatggaagccaatcacgacatctttttgtcgatgtccgatgctgaaaagctcaatttgtttcacgccattatctcggcacgaattgcgcagacgccggtgagaacgcagttggctggtgatcacgcacattattcggttgtcggcgatgtgaatttaaaacaaattgcggcgattactaatcgtaactatgggagtgtctataatacctacactgggttggttaactctctggaggagatactgggtcgcaagcatgcgtccactaaaatgttgtttgccattccaattgatgaatttcgctatgatctggtgaaaaagtcgaacccatatcgttttttggacgcagttttatataagcgctatcaaaactttgatgactttttaatggcgtccgatagttccaaagccaccattttgcgacatctgaaacctattcgtggttacgccaaaaccagtggggttcaattttcatatgagacattgtcgtttattgggtcagaattaaatatccgaatttttttggggttaacatattggttagcaacgaacggggcggattggccatttgaaaatatgacgcatgagcgtgccagcgaaattcttgatgccgttcttaaagcctttaaaggcggcgatgtgaatgtcgtgacacgtgaattgttgctctattacattgcggtggcacatcaacgcattttgacagggcaggtgttgacgcatgatccggattcacagattttacggtatccaatgccaaatctgttttcaccaattgctgaagcgctgactgacggacatccagttttagatggcttatctgagcagcagcaacaaggggaaagcgatgcgctctattttctgtttaattttgcgccgctgtatattgtcagtgatggcccgcttgagcgacgtgtgatcgaacggtacaaccgctataatcccgaaatttatcagttgattcaagccttctttgcgtgtttcccatataactttaagctacatctgcagttgccagaagagacgtataatctgttgttagccaatatgctgagtgtcaccgtcagcgtgctggtgttcaaaaaagacttcacaacaactttactcgctgagttcagttccaacatgcagcagaccaaagatgatccggctttctatgctcagatcaaagccacgcttgaaaaagtagtggatgaagaacatctcgaatcgtttgacgggtacatcgatgttttggccgaagcgctgtatcgcaacttgcaccaactactcatccaatttcagccgccaaagaaaattgtggttgcgccagttgttgaacaaacgattaccggctatattgacttgctagcgtttttgcacgctatcccatttgtcgaattagcatcgcccaatgctaatctgaaagatgccgatttggtcatcacgacttcggttgagccagtcaaaaaagtagccggcaaggcacagatattcccatggcatatcaatgttagcaatgaccattacggccaactgtatgccttactccgtgaactttgggataaaaaagttttagaagatgcccggttcatttattaaaagacaaatagctgcttgcatttgggccaagaggactggctcccattatttttgaataaaaacagtgtgggcgcttgttaatcagtgctaaatgcggtaattttaagaatgaatagcaaacacgtctgaagcgtctattggatgatcaagagagacagcggctggtgaaagctgttagccatccatattccagcgccttagtgggtagtgatgaactgcacggccactgaccgttatcagttattgagggtggcgcataggcgtcaaacttgggtggcaccgcggaatggcctttcgtcccaacgagatggaaggctttttgtgtgcactgagatttcagacgcatcatgaccatatgaggaggacaaaccatgttagatctaaaactgatccggcaaaaaccggaatgggccaaggaaaagttagctgcacgtgcgattaaaggtgaagagattgatgaattattagctttggatacgcgccggcgtcaggtgaccgttcaaactgaagagcttaaagccaagcgcaatgatgtttcaggccaaattgcggttatgaaacgtaacaaggaaaatgctgacgatcaaatcaaggccatgcgggaagtaggccaaaagattgcggctttagacaaagaactcgcccagctgaatgaaaaagtaacctacattctcgtccgattgccaaactttccggctgatgacgtgccaatgtcgttaaatgaagacgattcccgtgaagaatacaaatggggaaacatgccaacgtttgattttgaaccaaagcatcactgggatattggtgaaaaattaggcattctggattttgaacgcgcggcgaaggttgccggtagcagatttgtttactataagggtgctggtgcacgtcttgaacgcgccgtctataacttcttcttggatgagcaccaaaaagaagggtatgaagaaatcattcccccatacctcgttaacaatgattctatgttcggtactggtcaatttccaaagttcactgatgcgacctatacgatcacgaatgatggtgaaccactgactctgattccaacagcagaagtgcctttggtcaactattatcggaatgacattattgatgctgaaaaacttccagttaatttcaccgcacttacaccggcttttcgttctgaagctggcagtgccggtcgcgatactcgcggcttgatccggatgcatcaatttaataaggtcgaaatggtcaagttctgcaagcctgaagattcttggaaacaacttcaaaacttgattcacgatgccgaagatcttttgcaaaagctcggattgccttatcatgtcatcacgctggcaagtaatgacgctagcttcaccagtgcgaagacgaatgatctggaagtatggatgccagcgcaagatcgctatcgtgagatctcaagctgcagcaattgcactgatttccaagcgcgtcgtgcacaaattcgctatcgtgatgacgatggcaaattgcagtttgtccacacgctcaatggctcagggcttgctgtagggcgaacagtagcttctattttggaaaattatcagcaagctgatggttctgtgaaaattcctgatgtgcttgtaccatacatgcaaggacaaaccgcaatcaccaaggaagattaattgtttcatgcatctttatgcagcgaatcgcaaatgattcactgcttttttaatgcaaacgttcggactttaaattcttagcaaaacctcatttaaaaagtgttgacgcgggttcgtaaagttgataatatattctccgttgtcaaattcataaccgattccgaaattcatatcggttgcatgtttattcaaaaagttgttgacatatttcaacagctagtgataatatatgaaagttgtcttttgacaaggtcgtcctttgaaaactgaacaaagtttcgtttaaatcaaattcacgtttcaggtagccggaatgttgcctaattcaccagccactacttaaagaatgttgatggtatcacaagttttgactatgatgctgccatgcatgacaatgttgatcccgttgtcctaaaaattggcgcagaaataaataaatgggctcgcagtcttaaaaatgatggtccagaaaaaggcatgctgctctcaatggctaggtttaatttgctggtgtatgggaattattgcggtaaaggcaacaacggcaaagcgccgattgatgatcttgatggtgcatgccaagcacatgatacatgttatgcgtggggcggaaacaatgaaaaatgtaatcaggaatttcgtcaacgcttattgacaattatgcagaagacatcgctttttgattacaagcacattgttgccgttgcggcatataaattgtttggtggttgaaaatcaatcatgaataatggttagaagaaggctttcgttttatctaaagggatctgccaaaggcacttttaatggagaactgaaaaatgaagactaaagggaaaatcttcattggtagtggcggtatcttgacagtcatatttgccttaatgaccatcatagctttctctgggataaagaacttcgttggaatcgagcttggcactgggttcattgggctattagtgattgccttgctgattatatgttggcaaatttaccttttattagaaaagtccgcccttggctggagctttaacattatcctcggtagttacacattggttgttggagtagccattttttttcattgcctcatttttcattggctttgcgctatttccgtgattttcccacctaggaataacggtgaagggcctgggctataatgcgacgttaccaaacagactagtgagaatgatttgccatgtttaggcaaatcactctttttatttttccataaatagtctggttaagtttaaagattgtggcaaatggcatggcaagccacttcatagaccggccttgttgccactattttgtaaacgtgatgctatcaagcaatggctaggtcactcgcagaatctaattgtacagtatggtagaatagctaaagaaatccttaagtatctgcgctaagtgaaagcgagtttttctatatgaagaaattgtttgagcggattcgtatgccggagtttcttgaagacatgcgaatgcgatatgcagctattgcgatggtcgtgctggcggtgatcggtattctgatgggagcactgatccgtccgtggttggctttgttgatgctgctgattttgattagtctagtggccacgattttttatgccctagaaaccattgccaagaataccaatcagtatatttcggatctcagttatcggatcaagcgtggcgaacaagaagcgctgatcaaaatgccgattgggatcctgatttatgacgagaatctcaatattgaatggacgaacccattcctgcagaagtattttggcgacactgacgttcttggtcagccgttggaacatgttgatgcggaattggcggagttgattcgcagcaacgagaacaccaatgaaacgaaaatggtgacttggggccagcatcagtttgagattatcgtgcaaaagagtatcggggttgtctatctgatggacgtgactcgatatgctgagattgaagagcgggcagaagacgagaagatcgccattggccagatcttcattgataactatgacgagatcacacaaaccatggatgatcaggtcattactaatttaaatagttacgtcacgaatcagctgacggattgggccaatcaatttggcatgttcttgaagcggattgacaacgatcgctttttcctgctggcttatgccaagtcgctgaaggatgttgaacgtgacaagttcaagattctagatgtgattcgggaagaaacctcgaaacagaattatccattgacgctgtcgctggggatcgcatatggcgatgaagacttggctcagttagcggtgacttcgcagagtaacttggatctggcgcttggtcgtggcggcgatcaggtggtggtccgcgccaaaggccacgaagcccgtttctatggcggcaagacgaatccaatggaaaagcggacgcgtgtgcgggcgcgtatggttgcgcaggccttgcaagaattgtttaagcagacggacaaggtctttgttgtcggccataagcggccggatatggatgcagttggcgcctcgatggggattcgccggattgcgcagatgaatggcaaagagtgttacattgtgattgaccctgaccatctgcactccgatgttgaacgcctcatgggccaagtgggtcaagatcctgaagttgctaatgccattgtgacgccggaagcagcgctgtcgcaagcgacggatcagagcctgctgatcttggtcgatcacagcaagccgtcgatctcagcggcgcctgacttgtacaaacggttggcggcaagaacggttatcatcgatcaccatcgacgcggcgaagaatttccggacaacccgatgctggtttatatcgaaccgtacgccagctccacttgtgagttgattgcggagatgtttgaataccagccgacaaatgtgccaagtcttgataagcttgaggcaacggcgatgctggcagggatcacggtggataccaagtcctttagcctacgcaccggcacgcggacgtttgatgctgccagctatctgcgttctatgggcgctgatggcatgttggcgcagaacctgttaaaggaaaatatcgacagcttcatccaacggaatcatttgatcgatacaattgaaatgattgcgccaaatatggcactatgtactggggaagaggataagcgttatgacccagtgattgcagcacaagcggctgatacgatgttgtcactcaatggtgttgatgccagttttgtcatcaccaaacgcccaagcggtgatgtcggcatttccgcccgctcgactggggatgtcaacgtgcaggtcatcatggaagccatgggcggcggcggtcacttgagtaacgcagccacccagattaagggcaaaacgatcactgaagttcggactgatctgcttgctcagatcaaaaaagcagacgaagacgcatagaaagcagggattttgatgaaagtcatctttacacaagacgttcgtggcaagggcaatcgcggtcaggtgaaagaagtacctgacggctatgctgaaaactttttaattcgcaaggggctggctaaagcagcgacaccgcaggctatgagtgctttgcgcggccagcagcggcttgaagagaagaaggaagctgaaaagaaaaccgaggctgaggccatgaaggctaagatcgaagacgacaaaaccgttgttcagatccaaagcaaagccggcgaagattcccggttgttcggttcgattcctagcaagcagatcgcgcaggctttggataagcaatatcagatcaaagttgacaaacgtaagatcgatctgaagcagcctatccgttcactgggtttcactaatgtcacggttaatttattccctggcattgatgcccgcattcgggtacacgtgattgaacaaaagtaaattatgatttgttgttaagcagagctgccaaaaggcggctcttttttttgcaggaaagactattcttaaattgacagaaagtgaccccaaaccgtttagtttgtaaagtcgatgctctagttagccggctttaatgagatgggggcgcttttctttttttcgtgcttttaaaattggtatgtaccaaaatcgtggcaagcggacgttatattaagaggaatataagacgacgtatcgattcggaaactcgaaagaaataattaccgttcaaaaaacgcctattggctcgattaatgcatcgaagagagggtatcataattttgatcgatattttcgatattttgatcatagaacaatacgctgaaatttaaattgtactttttttgtttttaacatgatttttaatttaaattagataatgctataaacgctttcttgaaaccgttgaaaaattagggtttgttgtgaaatgcgttttatagaatctcttaatttcaaaaataatttatttccccagtttacaattcaagtgcaacaccctgacgactagaccataaaggccatccaagcttcacaaaaagtcgcttagcaaactgtccgaaaaagtgttgacttcccatgccttgaagtacggcatgaaaacccggtccgatttgatgattgtggtgacctgtgagcagttagagaacgcagtgacgttcacagtgatcgataatggtggcggtttttcatcagaaaagctaatcagtgatttgccgccagtagaaagtgagacgcatcacggtctagcaaatagttttcggcgactgcaaatgttgtatccgacagcgaatatgcagcttagtaacacagatgacggcggcgctaaagtgacgcttcatgttgccagagcgtgaacagccgcggtcagaaatcggagtataagcggcctcaagtgcgatgatcgcactttgatcattgtacttgaggttcttatgtgtaggtttctgcggctgtgaacgcgtttcagctagagcggttagaaaccaattctgccgttgtgactgtggttaaggagatgaaaaatatgtacaaacttttgatcgttgaggacgagcacttaattcgccgatatttaactgatgctttagattatcaagaactcaatattatggtggtgggcgatgctgaaaatgggcaagaaggtaccgccatgattcaggatttgcagcctgacattgtcttgaccgatattagtatgccaatcatggatgctttccagatgtttgaagccactaaagcccaagattatcaaaaagtgattctctctggctacaatgattttgcaaatgcaaaaaaggcgattcgcagtggtgctcgagattttctggttaagccaattgatctggaagaattgcgcaactgtatggtcgatgtcaccacccagattcaactgcaacgcggtcaattagctgatacagatggcattgcaattgatttgctaaaagatgtccgctactcccgcgaccatgttgtaacccaagtgctgacgtggattagtgaacactatgcctgcaaatttacgattgccgagatggcgagcgaccttggttacagcgaaagctacatttataagaaaatcaaagatcaccttggcgtgaccttaaacgattatctcaatcgttaccgtattcgcatggcgatcaatcagctgattgaagatcccagcatgctcatttatgaagccgccgatgcctccggtttctcggactataagtacttcaatcaagtcttcaaaaagtatcttggtatgacaacaaccgatttcaaagcgaaggtcctccagtgatggaggattttctacgttttggatagaattgtcccattttgaaagcgctttaaatgggctaatcttatagttggcaatgaaagtcaacgataacgtgctcccagtgctgaaacccgcgctggttcgcgcttagtcaagaacgggaggaaaaagatcatgaagaaagtttgggcagggttagcggttttaggcatcgccgcattgggactggcggcttgtagcaatagcacaaagaaaacgagtgatagcagtccaaccacaagcaaaactgcgaaaaagtctgacaagcttgttgtgtattcacccaactcagaaggcttgatcaatgcaacgattccagcatttgaagaaaaatatggcgtcaaagttgacttgattcaggcgggcactggtgaattattcaaaaagcttgaatcagaaaaaggtgccccagttgctgatgttatttttggcggctcatacacgcaatatgcaaccagtggtgatttattccaaaagtatacggccaaggacaacaataaagttgaaaaagcttatcgaaatacgaccggttattcaaccccatatacccttgacggcagtgtcattgtcgttaatccgactttgaccaaaggcatgaatattaaaggttatggcgatcttttgaataaagatttaaagggtaagattgccacagccgatccagccaactcatcatccgcgtttgcccaactgacgaatatgatagcggcagaaggtggttataccagtaagaagtcatggaattacgtgaaaaacttattcaccttggtagacggcaagatcagttcaagctcatccaacgtctacaaaacagtttccgatggtgaaatggcagtcggactttcttacgaagatccaaccgttcaattattaaacgatggcgctaaagtcaagattgtttaccctgaagaaggaaccgtcttcttgccagcaagtgccgctatcgtcaaaaaagcaaagaatatggacaatgccaagaagttcattgacttccttgtttccaagaatgtgcaagatacgttaggcaccacaaccacgaaccgcccagtgcgcattggagcaaaaacgtctagcaatatgaaaccatataaggacatcaagaaaattaccgaagactacgattatgtgattaagcataaagatgacattgtgaaaaaatataacgaaatttttgttgaaactcaatctaagtagaggtgaaaccagatgagtgaaattcgtattgagggtgctaagaaggtttatggtgatgtcaccgtcatcgaaaatctcagtctgactgtgccggacggggcacttttcacactgttaggcccatctgggtgtggcaagaccacgttgctgcgcatgatcgcaggttttaactcgatcgaaggtggggatttctacttcggtgataatcgcattaataacatggaacccagcaaacgcaacattgggatggttttccaaaactatgcaattttcccacatttaacagttcgggataacgttgcgtttggcctaaaacagaagaaagcaaccaaagaaaaagttgtggcggaaaccgataagtatttgaagttaatgcaaatagacgagtatcgggatcgcaaacctgatcaactgtctggtggtcagcagcaacgggttgccttggcgcgtgcgttggcagtgaatccagatgtgctgctgatggacgaaccgctgagtaacttggatgccaagttgcgcgtcgatatgcggcaggcaattcgagaaattcagcgtgaagtcggcatcacaacggtttatgtcacgcacgatcaggaagaggccatggcgatttcggattcaattgccgtcatgaatcaaggccggattcagcaagtcggtcggccgaaagaattgtaccatcggcctaaaaatgaatttgtggcgtcatttattgggcgaaccaatatcattcaggcgaatttgaaacatgatggggccactgctttactagaattttcgactggttatcggatgccgctgccgattttgaataacgttgctgaccaaccagtgcacgtcagcatccggcctgaagaactgattcgaacggcagatggcgacatcgatgctcagataacagatagcgtttatctcggtatggatactgaatactttgttgacttgccgttcgctaagaagattcatgtcagtgaagaatccagtctgaccgaagatctcggtgaaggcgatcatattaagctcaagatcaatgcccaaaagatcaacgtctttaccgccgacgggtcgcaaaacctgctgggggtggattaaatgaacaccaatcggaaaaagtttaatatttggacaggctcatcgttcatcatcttcatcacgtatctgctttttctggtttatccgattgtgatgattcttggtcaggcgttgttcacgcaaggcaagttctcgttagccaacttcacgaccttcttttcacgaagctattatttttcgacattagccaatagtttcaaggtgtcgttaaccgccaccgtatcagcagttttattaggcacattgctcacctacttttttgcgatgtttcaattcaaggggaaaaagtttctgcagatattgattatcatcgcttccatgtcggcaccattcatcggtgcttactcgtggatcttgctgctgggtcgaaatggcgtgatcacgaaatttctggtcaacacacttggctttcctaactttgatgtctatggctttttcggaattgttttagtattcacattgcagctgttcccgcttgtgttcctctatgcgaatggcgcgtttaagagcatcgataattccgtcttggaagccgcggagagcatggggagtcgggggttcaatcggtttcgaaaagtcattatgccactgttaattccaacactattggccgctgccttacttgtgttcatgcgggccttctctgattttgggacgcccatgttgatcggggaagggtatcgaacatttccggttctgatttatacccagttcatcagcgaagtgggcggcaatgcggcctttgcttctgcgttggcaattattgcgattatcattgcactgacgattttcctaatccaaaaatttgtctcgcatcgatttagttacagcatgaactcgttgcatccggttgaagcaaaaaaagtcgggccgttacgaacggtactcatctacattcttgtttatggtatcgtgctactagctatcttgccgcagggttacttgatttatacctcattcttgaaaacatcggggatggtctttgtaccagggtactcactgggaagttacacgaacgcctttgatcgaatggggtcagccattttcaacacgattcgaattccgatgatggcgctgatcattgtgatcatttttgccattttcatctcgtatctggttgttcgcaaacgtaatttcttcacgtcgcttatcgacagtatgagtatgatcccttacattgtgccaggcactgtgcttgggattgccttcatcacatcatttaatacgggtgttggcggcagtggtttccttgctatcacgggaacagcgttcatcatggtagtgtcactatccgttcggcgattgccttatacgattcgctcctcagttgcgaatctgcagcagatctcgccctccattgaagaagcagccgaaagtttgggatcaagtcggctgaataccttcttcaagattacggtgccaatgatgatgtcaggcattgtgtctggtgccattctttcatgggtcacgatgatctcagaattatccacatccattctgttgtacaacgtcaagactcggacaatgacagtagccatttataccgaagttattcgtggaaattacggcgttgccgctgcactatcaacgattttgaccgcgttgacagtgatttccttgctaatcttcatgaaagtttctaagaatggggatattgcgatgtaaccacaaaatttcgtcggaaataggacaaaagggagttgaccgtgactggttgactctctttttgctgtggaagcgacttttgttggcaaaatggctgaatattcacatgaacgaaaaaagatatatgtggtgaacctatttacatctagtcttagaaaccatataatatggatattaaagccgcaaggaggcagaacatgaccaaaaaaattgcaattgtcgttgattcgggttctgatgtccctcaaagtgttcttgatgaaaataaaaatattgcagtcgtacccctgaatattactatgaatgggcataattaccttgatgcagttgatatcacaccggatgaattttattcggggctagcaacggcagaaacattgccgcagacttcaagtccgtcaccgcaagctgccaaagaggcgatggataggctgttcgcggctggttatcagcaaatcctcggtatcacaatttcgagcgcattgtctgtgacgaacaacgtctttcaattggctgcgcaagattttcccgctgacaccgtaaccattcttgacacaaaaagcatcggcattggcagtggcatccaagcagcctatgccgcatcattgatcaatgcaggggaatcctttcaggacgtgattgcaaaagttcgtgcctcaatcgtcaagagtcggatttatttctacgtaccaaccttgaagtacctcagtgccggcggtcgaattggccgagtggcaggccttgtcggttcggttttgcacattaaaccggtgatctcatgtgatccagaaggcgtctactaccctctttttaaggcgcgatctgaagataaagcgattcggaaattggttgaacaagtcaaaacggattgcttaaatagcgctcattatcgtctaggagttgtccatggtcaaaatccagctttggttaaaaagttagcagaaaaattgcgcgaagtgactggtcgaccggttgattttattggtgagatctcgccgtcattgggggttcatacaggaccgggactgattggggcgacagttcagtcgtattaaggtgttacaaaaataagtcacgcctctcaagctttacctaaaacgaaaagcagatcaaaattgcccgtttctcaatttgttgagaaacgggcaattttgatttgataaaacagtcattccaaccacttattcttcttagccatctgcacggcctcaattcgattatgaacaccgagcttactgaaaatagcggacaaatagttacgaacggttccttctgagagaaatagcgaggcagcaatttgttttgacgataagccgctggcgactgctgccaaaacagcgagttcgcggtcggtgaggggattgctttcagccgtcaccatattcgtgactaattccggggcgtaaaccgtttggcccgtcatcacttttcgaataacgtcaatcaaatcatcactggggctgtctttgagtagataaccatttacttgggcagcaatggcgcgttcaaagtaggctttttgcgcgaaggtcgttaaaataatgacttttgtttctaactcgctcccgtgaatcttatcggcaacgtccagtccggttaacttgggcatctcaatatctagaacggcaacgtccggtttgagttgctgaatgtcctgccatgcttttgcaccatcaccagcactgcctagtacgtgtagatcatcttccaagtctagtagctgggtgagggcggagtttaacatactctgatcttccgcgagatataaggtaatcatattaggatcgcacctcctttggtagtgttaatgaaacgagggtgccttggcgattatggtcaatgctaaacgtgccatcagcttcgtgcatgtgactgcgcatgccgctaataccaatggaaccagcccggacatagtttttggatttgccatcatcctgaatggtcacggaataggtggtgggactctgatcaaatgtgatttccacctgatgggcctgggcatggcgaatgacatttgtgatggcttctgtcatgacggcactaaactgactctgaaccttagttggccattcagttgcttcgttttcaccgctagtgatcaacatgacgtcagcctcagcgagattttttccttgagacaacaacatttcgctgagggactgctgatggagatcattcacaattgcccgtacgagttgcaaatcatcacgacttgtttgcgcgatatcatccagttcctgtgccactcgctccggagctttgacaagtaactttttcgccaattcggtttttaaggtgatcatcgaaaaactctgaccgagcgtatcgtgcaaatcccgcgcgatccgttctcgttcgccacgttgaatgaccacttgcagccggcggttcgtttgccggagttgccgctgatggatgactgatcgggaaaaagtatacgccagcattggcgacgcaatcgggaaaatgagtcctgagatttcgccaaatgatgactgaaagatgactggttgcgctaaattagcacgccacaggccaataccgatgatgacatagtatgctgaagcaaaccaccgaaaatattttcgcggataccaacccaacataaaagagacctgccatcccgggaagattagcatgtagttgttgaaagcaaagatcgaaaataaccctgtaatgcctaattcaagtggtattgtgaccgggagccatcggtcaatttcattgacgagtatgtagacaatgagaaataaaccacacaagccaagccaaaaccaatcagcctctgatttaacggggatgaactcagccatgatcgcaggcaaatagaccagccaaatatagctggtccattctagatttttaatgcgtgtgattaacttacgcctcacccaaggccacgccctttcgctgtgcatgctttgagagcacgatcaccagtaaaccagtcaccacaaaccaagcaacaatgcccagcaaattcgttaagtctactttagcacgggaagtgagttgatttaatagttgattcacaaaataggtgggcatgagttcaccgattgactgcaaccacttaggcaacatgttgatgggccaccacaacccgctaacaatcgccatcgggaaagtgatgaggttgctggcaagactgagcgtttcatatctgcgaatgtacgataagccgataccgatcaacataatgggcaattgtccgatcaaaacgacaccaaatagcgagagccattgatcgaaatgaagactaacaccgttaatgccaacagctaaactacccatcacagcaactgagaacagactcatcattaacatccagaaagcgactgaaagatagtagggaaaggtaccgtgagcagataagctcaagaaagtaacaagcccttggtcacggtctcgtttcagaatcgcggcaattccgaagagggcactaatcagaacactataaacgatcatgctatccatataacttacatagaacggcttcatttgtgttgaagagccgctgaccatgacttttgtgaagagcaaatagaagccagccggcattaacagcgaaaagaagatataggaaaagttacgtaaaattaatcgtttgccatcaaaggcaagttgcgttttaaaagttttcatttttcgtcgtccttcccagtcaattgtaaaaagatatcctccagcgattcccgggtcacgctgacttgatgaagccgatccaacatgggtgccaaggctcggagtgtttgatcaccatctgtgctatggatgattagtttgggggtaacaagttggatgctatccactgctggcaatccattgaaaatcgctggctgcaaatcggtttcgcaggtaatggtggccccaagatgctgcttttgaagcgcttggagggagccattaaagacaaagcgaccgttttgcagaatcaacagccgatcagcaacttgctgaatctcttcaagatagtgactggtaatcaccatcgttttaccttgctgccgcagttgttcaatttgagtccaaaaagctttgcgagattgcgcatccatgccaacggttggctcgtctaaaaacagcaaatcaggattgccaacgagcgcaacagcgaacgtgattcgccgcaactgaccgccggaaagactgcctagccgttgtggtttcaaatcgcttaaatgaaactcattcaacaaagcatccgggtcaagtgcacgaggtgattgcgccgcggcaagctgcatcaggtccccgacggttgtgcctgcaatcaccatgtcgccttggagcattgaaccaagacgaactttactatcaggcgcacctgggcgctgaccaaaaacgctgacttccccagtacctgctaaaagaccgagtaaaatattcagaaatgtggttttaccagcaccattggccccaattaagccgacaacttcacctggctgaaccgtcaaattaatgtcatttaggactgctttatcaccgtagctaaattttaaatgttctgcttgaattactgtggtcatttcgtccacctccaccattgatactacgcggtgagtgggctggccaatagtcgcgaatgtcatgaatggcatgtgacaaatgtcatgatccctatgaaaaagagcctatctttgaatttaaccaagcatgatcaataaaaagcggctatctgaaagcttagtgaggcttcgcaggtagtcgctttagttgtagcgcactatagcggtatatccgccccttgatgcaagcctttcttagtctgatcgaaacttttatcggacttaaaggccccaatgagctgccgcatgttcatgtcactgtcacgtatttcaggcatgctaggccgcaaagtggtaccggaaaccgtgaggctgtattgactagcaagactggtaataggcgttttggactgatacatattgtagaaggcaacctgctcaccatcaatcagggcataaaacatatagtctgtctgattgaccgaagggataaactcagagaacatgatgagtttgctgctagatcccgggacgagatgataactgtaggtttcactagtactgtttgcgtagtcagcgacttcggattgttgtaagccgttgagggtccagtaagccgtgaagaacaaggccgcccggtcagcgtctgtcagacctactagctcactggcaggagcaagtggtgctgttttcatagcatcaatcgggtaggtggtgtcggtattttgtgtccatgaacttgaagtggccgattcattggtgacttcggacgaggaacttgcggtggaggcactgctgctagataccgtccttggtaggcgcgtttgtgaagccatctctgacgcgactggcaaccagttaaagccaccagttaaagccagaaaaatggcaccgaccatcaaaatgccctgaagactgatccggagttgatattgtcgtttcaataaatgcttcggcgtccaataaaggtccgttgcatcgctatcatggtcttgatccgctttctcaagtagctgaaataaccactgcgtcaggtaaaaccagatcatgcgactgatcaatgctaaggccataccaccaaaaagaaagatgttttgaatctcgttgtttgaggccgcgagcatttcggctagtcgaagtccgaatggtgacgtcatcaggtcagcggaaaatgcgtcctggtaatgcatgacaattgctgttacgaggccaattgccgcgagtatatccagaacaattgcaacgagtcgccagttgcgtttgctaggatgagatcggtagataccgcgcacatagacaattcgggcaccgcggacttggctaggaaacatcatcttgtgctgctcaagctgaatatccacgattcggttggtgttgagatgttgtaacgcgatcactactaagacggcaatcataaaaagactgagaatagaatagaaaatcatggggttctcctttgcggcatagcggcttaagcagatggcgatcactgtttttacagatgcggtgtaacgatcaaaaaagttgttgacagacatcatgataattagatctaggaatagcttgtcgatcattttctagtccttgaccttgatgtatactccaatgttattctgatgacacgaaaaaaggggattttcttatgaatattaggacatgtgcgcaacaatccggtgttagcaaagatacgttgagattttatgaaaagattggcttgattgtgccatcaaggggtgaaaatcattatcgcgattataccccagatgatgtggttaagttgcagatcacgcgaaatttaaaagcggttgggttgtctttaaatgaaatcagcatgatattgcgaatgtatgatgcgccagcgacaaaggcttgtcgcgaagataccttggccattttgcaaagttatcgcgaagtctttaaacgccgggcgaagctggatcttgcccttagcaacatagcgcttgatatgaccactgccattaaaatgcaggcaggggatgatgcaatgatgacattatttaaaaaaataggggcacttaatgattaaaacaattgcagatgggattcgttttctgttagaaattgcaacagttgtgttattgatcatcgctgggttcaatagtagcgatcttgtggttaaactaactgtaggtgtgatagtgccggtgctcggcattcttttttggggtcggtttatggccccgatgtcgcttcacaggttaccaacaattggccgggttataacggaaatactcatatttgggggaacggcgttggcaacgtatttgctaacaacacataaaaccgcattgatttatggcggcatagcattgatagatactttgattgagcaactaataccgtgagttgatttaatttaactggcagtaagtattttgtcttaacgcgtgcatacctgtgggtgaaacgctttgtattgcagagctcaaaacttaccatttatgacttcatcattcacgacctgtattgctactgtgcaggtcactcttcttgtataatgaatgcaagttagtcaaccaggtaacaagaagggaacgactcatcatggcagcaccattaactggtcctttgcgtaatctattgttagctagtcagctcggcttaagcgtgcaccatccgttggccggctggtttgtgctgacgattctttatcatgattctcgtagtagcagtgagccaattactttgagttacttggctcgaacgtataacaacgaatatctggatgcggccactgatgaagacccgatcgctgacgatgttttgaaaaaagtgttggatgtccttgtggcccaagctgggttggtcgaggttaatccgcgtaaggtccgtgcccgaatgcgcagcggtcagtatcatattcgccaatcctacgtgtatcatattacgagcagcggtagcgaatatctgaaaatgatgcagaaggtgattgatgcagaaagtactatctctgctaacacgaaccggattcaggagtacgttgctttagttgaaaagcttagcgtgccagttcgttcgggcgccgatacgcaactctataatgattttaaaaatatgcttgatgcctacgatgatgtgatgaagggcattcacaaacttgaagacgaccttgacgagctggcaaatgatattgcctttaaccacggcagtcaggaagcaggacatttgcaaaagatgctgcgcgacaaggcaattcctgcttatcagctgatgttgcaacaggcagcgcggattcaaggattggcgaatgatccgacttttcccgaccagattgctcattctcagcaaggtagcgatgatctcgatgcggcgcacgctgttggtcagcaggatgttttagttgtccgattacaacgaacgaaaaaatgggcggccgcgcagttaacccgacttgccttgagtatgagcccgacttcctcggccattgatagcagtttggattcaatctatcttgtgtttaatacgttgctaggcatcgtgcatttattgagtcaggaactggaacatgccaagcgccaagcaattgatatcaaggcgttgtcgcgccaactagataccttgttatctcattaccagcagctggagattcccgcccgcgtaccgcgtcatctgccagttgatcgcgaggttgaagatgccagtgatttgctagatgcctcaactatgggacctgtccgctatttagccaatgccgcggttaaaaagccggcgagcgaagcggataatccgacagtgacggatgacgcgccgagtgaacaggcacaattagcagggttgcgcgagttccggcaacagttgatgattgatgacaatcacggacgagttgatcatgatctgaccctgaaaacagttagcgcccgcgatgagattgttaagttatttgcagcgacctaccacgatgacttgactggatttgccccgtttggtcgggacgctcagacagtgcaatcaataccgaacacaccgccattgcagttgcgggtcgccggtgaagattacgcggtgatgttgccgtgcggtttcatcttttcgtttgcttagggggattttatggctaacatgacgaatcttgatcgattgatcatcaatgaattgctagatcacggggtattcacaacgacgccgttgacagccgcgacccaacaaagccgtgccgccatcgccgagctcaaaaaaccgtctgtgcagcaacggatcggcaattattttaaaaatcttctcggccttgcactggacaactttcaagaaaacttattgttgttgacgggcactgccaagctaaatccaatgcaggtgcacgtgcttttagcaatcgtaaaaacggtgatcaatgagcctgaattgcaaggcaaaggtggggatcgcgcagttgcaacgcagaaaattgtgcggcaggtgcacagtgaagtgacggagctggatgaacgcgaaatcttgcggttaatcgacagcctgtttgtgaaaaggtttggcttgttcacgccggatcggttagaggaagaccaggagaacaccccggcggaaattgacgattattgggaagtcagtccggactttaacgagtttgcccaaaatttagtcaatcatttgacccaatccgcgcctgcaaacgacttgaatgagctgcaacaggtgaatcgagtgctgctggccgagcagtttatgagtccgaaaaccaatccacaaacttggccattgctcgttgctcataaagaggagatcgctgaccaatggcaccaaggcggccggtttatcttagaagtcggcgaccactacgccttattattagacagtcagcggcaaccgagtgtcgcaaaaccatatttggtggcgctgacagttgcccatgagttgggtgccggcgtgcaggcagatgagctgacaccgacaatcaaagcggcaactgaagccctttttcctgggttcaccatccaaccgagtcaggttaaagcggcactaattgagaacgatttgatgagtgatcaggacgattattgggtaccgacgccgattgtcgctcgctttttagttgaaacagatgaacagtcagaaggagaaacgtgattgtgacagcccaactagtgccaattagttatcatcttcgtaattttaataaatacgtcaagctggacatgacagccgccgaaaatggcaatctgaccttgattggcgaaaatgcagtcggtaagaccactctagcaaactgtttctttccgatgctgatcgatggcgcgataaccacgccgtcatttaacccggctaaaaataccgaaaaggtttcgcaaagtgccagtgttcgcaatagcagtcgtgatacacggacgtttgagtcgatgttgctgggctggggtcctggggcaatgaaggtccgaaccgggtacagttacgttcattttcggtccgaccaacggcaagtcttgctgggtctgggagcgactagagtgcaggatgacccgcgccggccaacatggtggtttgtcgttattgttcccagtgcaactgcatcaatcacgctacacacaattgatgatgatggcaaaagccttaacaaggaggcattcaagaacgcaaatgcggcgcttggcgatcagttgcacgtgtttgaccgtcctgaagattaccgcgagtatgccgccacccacgtctatggtttcagtgatggcaaggttttgggacggctggccaatgcttatcgcttgcttgcttcaccgacgttaacctctggcaatgaaaagttcgcgcctattttagcggcactgaaagatgcgcaagaaggcattgacagcatggtcattcgccgtgtggctgacagccagcggcaagtgaaccaatatcgaggcttattaaaacggatcaaagaaggccaacgtcgcttgcaaagtatgaaaaatcggattttttggcatagtctgaatcatattcaagaaatccaacttgatccttacagtcaacgatttgcccgtaatgcaacgaatcaggaaaagttgacccatactaagcaagaagttgttgcatatacagcgcaactggccgaccttaaaaaggctgcagacgagattgcggcaagtttagaagtattgcgcgaggccaaagctgaacaggaccaactggtgaagcgccgtgaacagtatgatcagcagattaagaatagtcaggctcaactcgatcaatatcgcggcactgagatcaaaataacgactttggagaaacaattgactgacttaacagcagcccaggcgaagttggcgcaccaacgagatgcccatgtgcagaacaatctgacgccgcttaaagtacggcttttagcgcggacgagcgtgctcaatgacttttccagcgttatggctgatgacgattggtcggtgattgaagaccaattgagtcattacatgcatcagttaactgccgcgaaggttcagtatgatggtattgaggaaacgatcaatcgcctgagcgccgatgtcggcattactaaacagatgcagactaaaatgggcactgcgattgatgaccgcgtccaaggtttcggcagtaatcgggttcgtgaaggattgcaaaaggataacaccagcattcacgaggctggtgcggcgcaaatgaatacgcaataccaaccgttacgtgatcaacaggccgccattttggccaaacatcctgatctgaaagttatgttgcaagatgcgacaattttgccgcagttgaaggcaatccggaagcaactcaaaccattagtggcgaccctgagagatttgctgacagaaattgctgccaacgaacgaaatcaagtatcgctgcgagacagaatcgcggaactaaaaggcacgattgatcctgatttcgatgtagctaaactggctgataccattgctaaactgaaggcagatcgcgccgctctgaaaattgaccctgagttaccacagcgtttggcagcggcaatcgccaagcaaaagaaattcacgcagcagcttcaggccgttgaatcggaaattaatcggcggcaagggatcatccaaacactaaccaccacaatcgaaatcgactcagcgcagttgcacctactcgccactgacattgtgtcgaaattgaagactttaagcccgtactttcctgaagatgtgcatttagcgaaagttgacgatttattagcatttggccacagcaatcgcagccggatccgcagcagcaatttttcggatattaccaatcaaattagccgcctcattcatcggtcggatgggcacggtgaagatttgaatgctttggacgtcttgtttgctgatcgcggtttcccggccgaagccagcgccatgcggcaacaacgttccgtttcagaaaacgacctgacgattgttgcttttgatattaatgaagccttgaaattgctatacgatgaccacgctgctgtcgaaaaggcgcttgctgaagaaaaaagcggcaatgacatggcctactcgacttttgttcaggcagccgtggcagcgattagtgcgcagtatcaagtcatcgaggcctacaatcaaatcttggcagaaggcgctggacaccagcacattaagctaaaagttgagctgagcccgatcagcgggattgcccctgaagcgatccaagaagcctgcaattcccaactgcaacagcggccccatctcgaagacttggtgaagcagcgccttgatcagttggctaacaacacggaaatttcaaacgacgacgaagccttttttgcgacggctgaggaactgcttgacacccgggaatggtctgacttcaaggtcttgattcgccgccgccaaagtgccgaggacgactttgaagtagttgatgacaaatttgttcaatccggtgggtccggtgcagaaaaggcgcaggccatggtcttgccgctgctcttagtgccaaaaatggtcctgcaacgctccaatcgcgcggatgccccacacttggtcatgtttgacgaatttgcggataaactggatccagaaactgcgaagtcgtttgcgaaaacgattgtcaattttggcttcagttttatcgccaccatgccaagcggcgcgcaaaacaagctcctggccgatggggttgataacatcgtttgggatgtgatgggttctccgcaacaaggtgatggcaaattccaccttaatcgcgtccaacaaaactttatttggaaaaggacgactaatcagagaatcgtggggtagtagaagtgagctcatatattgacgcctttgaaaaggccaccgggcagccggcaccgccggaagctggcaaactcgatcaacttttcaatcaaatcagacaagggaaaacgttgccgccacgcgggcagcaagccgttgcgatgggattaactgcgcacacgcttaatgacgcacgggaagatccagcactttttgcctattatcgctgggtcatgacccactgcttcaagtcgggtcaggtcaacgaactgaccgcccgactcatcggcatggcctttacctcggctaatatttttgacaccgacttgccccaaccgctgaccctcaatccttggcagctcacgcctatgctcgactttccactgaaaaacaaacaagccgttgtcatcgaaaacaacggcgtctttgctttactacaccaagaacatcccgactggccgttaatcttacaatccggcaacgactttaacgaagtttatgtccaactcatccaacgacttgaggcgcgggggatacgctacgtttatctcggtgatctcgacagcgccggcattcaaatggccgatcagtttgcaaggctgttgaagcaaacaccagccgaagaagtggcggcgttgcaacaaccaaccgatgttcgactttggttagctgatcttggcaaaatagacgttcgccgcaccaagcaacgcaaggtcgtctcgccggtctatcaagcagagatgacgacgattgcactttttgggaagtttattgagcaggaacagttgatgggggtttatgaggaacggattgctgagtggcttgaagcggcagaagtttgatgaaaagctatttgataaaggccctatacacattaggagaaactatggttacttacacaatcaaaaactatcatccagaaatgctggaaagttggcttcgttgtcgcgccttggcctatatgcgaagttcgtttcaagacgaaatcacggctgaaaaagagcatgtttcggctgacaatggcatctcattagttgccgtcaaggatcagcaggtaattggcattgccgaggcgatttttttagatcatggtgaggcaaaggctgagtcatatggtttgcctccaaacactgtgcttacaacacttgatacgctggcggtgcatcctgattatcagcatgtcgggattgccaaagcattgctgacacatttaaagaagcaactagagtcgcgaggcggcgttttgctaatttatacgctagatgatgaggcggcaaatggattatacaagacaattggcgccaaactttgttataaagcctcaattgttcatggccacagttcccacaatcacgtgccgcaatggactgattttcaggtgacaaaagatggagaagttactgtttatgatgaacacggtgatgaagtcccatatgggcaagatatggaaacatactatgtcggtaaggtcagaaacttcaaacagcttacgagtattagtgaaattgtgaccgagcatgtgtatacattggcagtctaagcaagatccatctttatgtattgataaatgattcaacaaaccttgtttactgcaaaaattaagttcatgatttttcgttaaaagtttgatcaataaaatgactaatccgtagtgatcgatctttgaggaccggttgaattttacttatttagcggctgttgacctagccagatacaaaatatcttgcagaaccggtttcacaatagtggttgttgaataattcataacgtctgatggcagttacgcttccatttgtgcgaagaaaaagccagaaatccggttgaattcatctcacatgatgttatcccgctgtgtttacattgggataattcgtgatataattaggttgttagataggaaggagtggttagcaatggcagccacaaagaaagaaactcgcttgaatattcgtgttgatccggaattaaaaagtgctgctcaaatcgtagcaaatgatatgggcatcgacttgaccgcagctgttacgatgttcatgacgaaaatggtgaaagatcacgccctcccgtttaccccaacaagtctaccagttgaaaccttacaggcgctgaaagaagcaaagcacccagagctgctcaaaaaatacagcacgcctgatgacatgtggagagacttgaatgtatagtctggttccgacgcctacatttaagcgcgatctaaaacgactctccaagaagcattggccgatggacgaactaaagacggctgttaatctcctagccgctggtacaaatgctgaactattaagcaaaaagtatgcagatcatgccttgtcctcaagcagcgagtggaaaggatatcgtgaactacatgttgacggccctcgtggcgactggttgctaatctataaaattgagcagcaagatcttattttaaccctagttagaaccggatctcatcataaccttctgggtaaatagaattacgaaaggccgtccaaaaagggcggcttttgtgttgtggtcaaccagcagattcattagtcaatatacacgtgacttaacgccaatcttcaatcagcgattagaaatcgcgaactcgtcggcccagtaaaaatgttcagctatccagatgagttgggtgatctggggaagtgagcatcaataagatgccaatctttatcatgcagggttgggacgaaaatttagcccaatggtgacacggttcatcacttaaaacggtggactatgggttacaacggccaactaaaatatcgattatcaattctttggtgactaatagagtgaagctgccacctttgcctgacagaagaaatgcgttgattgggttcatcatgaaggcaaataaggcgacttatctggcgaatgaccgcggctttgatgaatggtatgtcaaacattatgagcactggttgaaacaggaagcttctgttggaaaatagtaagggttgccgatggccgtctatcaaattcgcacgaaaaccattttgctggataaaacgctgattttatggctttagttttgagatgagcgtaggttaaacttaagatgttcatggatgactattagaaagttttcagtcacaggactagacggctttctagagcaaaccagtttcaaaacggcacttgaatttgcaaaaaaatagaaagctaggggtggttgcagtgagcggcaaacttggaccaatgctttacaaggttggcgatatcgttaactggtcagacggcaccgagaaacatgtaggcgaaattatcattgctgattttggcggctcattggaaatgctgggagagcagcattcttatgacattagaagtgtgctgaatgggaaaccaacacttgtcaaacatattccggaagcttggatcaagcagcgactttcgactaaacttgaacgtcaaaaaggtcttgaagagttgcgcgccaaggcagcacagtttgacgatgacgcgtctcggactgaatttgatcctgaagatggcttaaacatggccactccagatggatattatgaatttgaaacgtattcaggaagtcgttatcaagttgccattcatgggaagaatcggcaactgatccgaaaaaatgccacagccgctatgcgtcaggacggcgccgctatcgagatcatctatatggaaattatcccgggtcgatcaggctatcttgttttagaacctttgggggaaggcgaggtaacaacacgactgacttcgcaggtcgttcgtgtttggcgaatcgaaatttcataaggcggcttactttcgacttcttgccaaaatagtcggttagccacgcattgtgagtgcgtaacgctacctgacgatcattgtcataagcgactggccttttggaatttttcgtgatcgaatcaccgagcaagagtggttactgatggcatgaggttttatatcaggcaactggttgttataatggtgactgctgaataactaattatcttgactagaaatcgtgaggaacaacaacttgattgaagaacaaactgttcaattagtccaacaaagtttaaccggcatcaccgatcgacagatcaataccgttttgaatttgatgcatgaaggcaacacggtaccgtttatcgcgcgttatcgtaaagaaatgacaggcagccttgatgaagtacagattcaggcaattgaggaagcttataaacgtgcgactgctttgcaagatcgtaaagcggccgtcattaaaagcatcgccgagcaaggagcactgactgtcaagctggaacagcagattcaagccagtaccaaactgcaagatgtggaagatatttacctaccatacaagcagaagcgccagaccaaggcgatggtggctaagtcacgcggccttgaaccattcgccaaatggctactagcttttccaagtggatctcttgagcaggaagcccagaagtacgttgatccagccaaagaaattgccaccgtccaggatgttttagatggcgcccacgaaattttggcggagacttttagcgaaatggctccgcttcgtaactgggtgcgcaattttaccatgcgcacaggaaccattagcgcgacagtcaaaacgaagggcaaagaactagacgaaaaaggcgtttatcagcaatactacgacttcgaggaaaccgtcaagaagatgtcctcaacgcgtacgttggcgatcaatcgtggggaaaaagagaaaattctgacggttaaagtcaaagtcgacactgatgctgtcctgcattacttccattttaaaattatcgacaatcggcccagtacggaagcaacggcgtttattgaggacgcttacgaagatgcatacaagcgatttgttgggccagcgattgagcgggaagtacggaatgcattaacaactgatgccgaagagaaatccatcaaggttttcggccaaaatctgtacaacttgctgatgcaagcaccaatcaaaggcaaggttgtgttaggttttgacccggcataccgcactggctgtaaattggccgtcgttgatgaaaatggtaagttcttggccaaggctgtgatttatccgcataaaccagcaccagaaaaaaagcgtcaggaagccgcaccagaactcattgcgctgcttgaaaagtatcaagtgacgatgattgcgatcggtaatggcacggctagtcgggaatccgagcaatttgtcgccgaaacgttgaagcagatcaagcgtgatgttttttacgtgatcgtgaatgaagcaggggcgtcagtttactctgcgagccaagaagcgcgtgatgaatttcccgacttgcatgtggaacaacgcagcgccatcagcattgcgcgccgcctacaagatccgctcgccgaactcgtcaaaattgatccagagtcggtcggtgttggtcagtatcaacacgacttgccaagcaaagatctgtccaatgaagtcgatgtcgtggtcgaacgcgctgtgaaccaggtcggcgtgaacttgaacacagccagttaccaactgctgacgcacatttccggcctatccaaaaccatcgcaactaatatcgtgcactaccgcgatgaaaacggccgctacaacagccgtgcagagttgaaaaaggtgccacgtttaggaccgaaagcatttgagcaatcagtcggattcctacgcattatcggcggtaaaaatccgttagacaacaccgacatccatcctgaaagttatccagtcgctaaaaaagttctggcggcagcaggtgtgaccgccgctgatttaggcgatgcagcagtagtcgctaaaattcgcgaggtacccattgcgccattggtaagtgaaggggttggcgccgaaaccgcgaaagatatcatcaccagcctgcaaaatccgggccgagacctgcgtgacaacatggccgcgcctattcttcgacaagacgtcttgacaatggaagatctgaaagtggggatgaagctagaaggcaccgtccgcaatgtcgttgacttcggcgcattcgttgacatcggtgtgaaacacgatggtctcgtccatgtctccaagatggcgcgcaaatttgtgcgtgatccaaagaccgtggttgctattggtgacattgttgaggtttggattgagtcagttgatttagcgcgggaacggattcagttgacgatggtggatccggctgttagctaatgcgtagggagagtgactgttagttacaaaacctatttaaaaaagaggcgttgcttttgatgttggtttgaagccaaacatcaaaagcaatgcctctttttttggataccaatcagttaaagtaaagccacttggtcttattatctgggctgtgaccttcagggtgcttgtttaaggtcaagctagccagttcatcactgaaccaaggacattgctcgttgccgtgccatgtcatgttacttattgatctacctgtgtcgataacaagtacaagcttaaaattttgcaaacttggagatcaaaaaaactaggcggacgttatacgcggtcaaactggttttttaccataggcgcagcaggcgcagcgtttctgcacgcaaactcttgcaccggagaacgcttggcaagtggttttcttgaactggagaaaagcttagttagattgtgcttcatgatcggcatcctctgtgaggcgaacaccaaacgtaccttttttgttaacttttgccgtatatgcgagatgataaacagtctcaccatgaagcatggcatcttgaatctttttgatctctgtttcagctgcctgccttgtttgataccagccaagttcaacgagacgggtagtccctagaaagccacgttggctactttcaccaattaatagaaaagaaggtgccgttttgctaggaatgccttccgcaacttgaaatcctgtgtaactgcccagccggtcattgatcaaggaagtaatcgtgatcgaggcacttgaaacgttattagaggttatctgctgctttggttctttaccgagaagatcagcataagaaatgcctaaaatatctcttaattttgcaattttatcaaggtcaggttcagctagaccgttttcatactttgatatggcttgacgactgatgccgatggcttctgctaggtcattttgtgagagtcctttttgttttcgtaactgcgtaagtctttcgccaaacatttttctcgcctccttctatacttcaattattcgataaacatctatgccatacaagcaatcaatgggtgcaggttgtcaactggcggttgcgaaagtaagcaaagagggattatttcaagaaaatgaggatcgaactttatgttctggcgaatttttggcaaattaaaaatccggcctaaagtttgttcgttatattagcaaaaaaacaaccaaccccgttaaggattggctgtgatcgtgaagtattaaagtttctggttatagtattcaacaaccagtgattcgtcaacttctggttcgagttcgccacgttctggtaaacgaacgagggaaccggtcttcttagtgtcgtcaaaggtaacgtaggccggacgggaaacggtgttctcgatggcttcattgacgatagcaaggttttgtgaacgttcgcgaagagcgatcacttggccaggctctacttcataagaagggatatcgacgcgcttaccatcaacggtgatgtgaccgtggttaacaagttggcgtgcttgcggacggctggaagccagacccaagcggaaaaccagattgtccaaacgggtttcgagcaggatcatgaagttatcaccatgggtaccttctttgatcttgccggcgcgcaggaacaagttctggaattggcgttcgtttaagccgtacatccaacgtaacttttgcttttcacgcaattgttggccgtattcagagatcttacgacggttgttggcaccatgatcaccaggtgcataaggacgacgagctaattctttaccagtgccggaaagggagaggccaagacgacggctctgcttccagcgaggaccagtataacgagacatatagatattcctccaagattttatttggagtaaaataacgaattgcggctttagcacacgggcagtcctgcaaaggttcacctttgcagccgcggttactactgtcaccggcttaacgccgaggcaggactggagccgaccatgccggccgctgctgcattattttacacgcgtgctagtataccgtgtttagcgcagcagtgtcaaggtgtgccgccaacgtctcaccaaacttagtgaggatggcttcgtcattttcactaaaccgatcaagtgtcggcgagtcgatgtccatgatggcgaccacccgattgtcaactgtgatgggaacaacgatctcagcgttgctggcagagtcgcaagcgatgtggccagcaaattcgtgaacgtttggcacgcgcagcacagcgttttgggcgtaactggtgccaacgacaccgttgtctggctgaatgtgcatgcaggcgaccttaccttggaatggcccgaggtcaagctggccagttttatcattataaaggtagaaacctgcccagttgaggtcagtcatcaagtcgtttagcaaagcgctggcattggcaagtaccgtaattgggttagtttcgccggttagcaagccgtctaattggtcaacaatgatgggatcaagggtcgtcatttaatcagtccttttagagaatttatgaaaagcgatgtgtaggccttttaactgaagcctttttttgcgatacttgtacttaggatattctcacattttgatgcttaacggcattttagccgtgaagctgtcaaaatgcaattgaaatgataataggtaaagcagagggtgtagggatgatctggttctttgttatcgtagtgatcatagttgtcgctgccggcggtgtctggtggctgcagcattattttcagactcgaatcaagaacttggacgcgcaagtcgaagcgatcgacgttggtgcgctgtcgagtcagattcgcagcatcgagcagttaaagttaactggcgatagtctggcaacgttcagcaagtgggaacgggcctttgatcagttgaatgatgacgacttggctgacctacagaagattctgcttgatctggaggaccaggccaagcgttttcgctttgatcatgcccagaaaattgctaaggtgctggaagcaaaaattgacacagcccgccaacaatatgacttgatcagccaagccttacaagacattcggcatgacgaggcggataatcgcagtaagatgttgcagctacgtgatgattatcaagtgtcgcgtaaaacgatcctcgccaaaagttttgtcttcggggatgcccaaccggctttggagcagcagttgcaacaacttgctgaactttttcaaaaaattgaccagattaataatgatggcgatcatcaagctgccaagaacgagattaagcagttaagtgatgagatggcggcattgcggcgtcaagttaaagaattgccaccgcttgtcaatgaacaggtgaacgaattcccggcgcagattaatgaaatcgagcatggctatcggcagttgacaacggctcattatgttttcactgatgatattccgggcatggtcgaggatgttaacgaaaagatggctgacgctaacaccgcgctcaagtcgcttgatgtagacgccacagaagcggctaacagtgaaattgaagctgagattgataagatgtacgcgattatggaaaaggaaatgcaggctagaaagcgcgtcgatgctgctgcgccagacctgcgccaatttattgattacgctttgcgtcaaaatcgcgagttgcagacagaactggatcatttgaatcagagctacacgttgaatcacaatgaaatcaaaattgccaaggatttaaagacgcagcttgattcgatcgatgccaactatattaaggatacggatgcgattgaagctggtaaggccgtgtattctgatgtgatggagcggtttgatgccaccaaagatgagttgacagcgattgagaagcagcaggttcaaattaatcaagcggtcgcaggcttaaagaaaggcgagattgtcgccaacaagcaggcagagaattttgaactggatatgcgtaacatcaaacacgaaattttacggcatcacctacctggtctgccacaagattatgtgagccaggtcaagcacgtcactgccgagatcgagcaattaaaccatgatcttgatcaagtgaaaattaacatggacgcgattgcgaagtttctgattaaaattgccagcgatattgatgcgttgaaaaaagctaccagcgctttgattgacgctgcgggtttgacagaagaattgatgcagtatgccaaccgctataaaacaacagtgaaaccagtcgccgaagcagtgcatcaggctactgagtcgtatatgcaatttgattataagcaagccgcggataccttagcgacggcattggagcaaaccgaagccggaagctataagaaggttgaggatgcgtaccttgcgcggaagaaagcttcattatattagtgattcggatttgggaaaaccagccggtggtggctggttttttgtttggaggttgttgttgtgcgaatttgtgggtaattttcgtaggacttgttgtacgaactttctgatgtgatctaggctccgataaacgcgctcgccagtccagaaacctgcgtgtaaggaccttggtcgcaatggtcaaagtgcgaccatcacgcccaaggccacttacactccggtttctcccggactggctcgcgctcttgaaacttactaactttttgtctataattcaacgcagtcacaataacggaaggggccggcagatgatttattttgataatagtgcgacgacgaagatttcgccggaggcattggctacttataataaagtcagcacggatttttttggtaatccgagtagcttgcatgccttggggacacgggcaaatgaggttctgcaaagttcacgggcgcagattgctcagctgatcggtgcgaaaccaaacgaaatttacttcaccagtggtggtaccgaaagcgataattgggtgatcaagggaacggcgatggcgaaacgtgaattcggccggcacctgatcacaaccagcattgagcatcctgcggtcattaatacgatgaagcaactagaaaaattgggctttgacgtgacctatctgccggtcgatcatcgcggttttatcaacatcgatgatctcaaagcagcgattcgcaaagatacgattttggtctcgatcatggcggtcaacaatgaaattggcagtatgcagccgattgttgaagcagcacgcgtgctggatgcctatcccaatattcactttcacgttgatgctgtgcaggcagtcggcaaggggctggatgctgccatgcaagatccacggattgattttatgagcttttcggggcataagttccatgctccgcgtggcacagggttcatctatgccaaggaaggccggatgatcgcgccattgctgacaggcggtggccaggaaaatgactggcgctcaggtacggaaaatgtgccagcaattgccgcaatggcgaagtcactacggctccttttggccaatgaagcggataacgtggctcgtcagcaggctgttcgcaaacgaatttacgatcatgtcagtcaaaagccaaaggtgacgatgttcagccaattgacccctgattttgccccgcatgtgttgtgcttcgcgattgccggtgtccgtggcgaaacaatcgtccacgctttcgaggcgcaagctatttacatttcgacaactagtgcctgctccagtaaaaaaggcacggaaagcagtacgcttgcagcgatgcataccgattcccggattgcaacgtcagcgattcgtgttagtttagatgaagcgaatactttggccgaggcagatgcttttaacaaggcatttgatacgatttatgcaaagtttgctaaacttgataaggcgaccgtttaactgaaaggattatagtatgcaatattcagaaattatggttcgttatggcgaactttcgacaaaaggcaagaaccgtcaagcctttatcggccgattaaacggcaatgttacccgtgctctgcacgagttccccaaactcacgattcgccctaagcgtgatcggatgcacatcgaattgaatggggagccgagtgatcaggtgatggcccggttatcacaagtttttggcattcaaaatttttcaccaagtattgcggttgaaaaagatatggataaggtacatgcagttgccttgcaattaatgaacgaaaccgcgccaaagggcattagctacaaggtcaacacgcgccgcagtgaccacgattttgccttagatacaaacgccatgaatttggatctgggtgactatctgacagataagcggcctgatttggttgttaaaatgcatcagcccgacatgattttgcgggttgaagtccggcgcgaggcgatttatttgtccacgaagaccattcaaggggcaggtgggctgccagtcgggactgccggcaaagcagccttgatgctaagtggcggcattgattcgccagtggctggctattatgcgttaaagcggggtgtggacattgagatggttcactttttcagtccgccgtacaccagccagcaggcactcaacaaagctaagcaactgaccgcgaagttgacgccatatgtcggccggatttactttatcgaagtgccatttacggaaattcaagaggaaatcaaggcgaaagtgccagaaggttatctcatgaccgttcaacggcgattgatgttgcggctaacggaagccattgctcagcagcgtggcgatctcgcgattttcaatggcgaatcggtcggtcaagttgcctcgcaaacgttggagtcgatggcggcaatcaatgatgtgacaacgatgccgattattcgaccggtggcaacgatggataagaatgaaatcattgctgaagctgagaaaattgacacttatgatttgtcgatcatgccatttgaagattgctgcacgatttttgcgccgccttcaccgaaaactaagccaaagacagatcgcgcgcgttactatgaaagcaaaattgatgtcgccggtttgatggatcgcgcactggctggcgtgaaaattcaggagatcaagtcatcggatcaatttatgaatcaagatcaagatgttattgctgaattactttaaaaagaatgcctgttgtttgcctattgatgatagtggtcatggcaaacaacgggcgtttttatttaataaaggaaacatttcacaaaagctgagacttttgacggtttttatcttttggttagttgtggtgataaagtcagaagcacagaccaaacagctcggtcgctgacagataatatgataacatcagtacaatcctaacgattcatgccagtcattacttttgaaaaaagatagccaagcaagccgaattctggtaagctaatatgtgaaaagagtaacaaaagcgtgcggaggtgttcaaagtggtagtcagcaagcaggcgttatcacaggcaacaattaaacggattcccgtttattatcgaacggttaaagacttgcagcggaccggcgagaaacgggtgcggtctgatcgattaagtaaattggtgcacattgccccagcaacgattcgacgtgatttttctaattttggcgatttaggccgaagtggctatggctattcggttgacttgcttgcacaggtttttggcgagttgcttgaagtccactcagaagaacagatggcgttggtgggttgtggtaatttgggccgtgccttgctgacgaataattttcgccgcaaccctgatctttctatcacgatgggctttgacaccgatccgcaattaatcgggacaacgatcgccggcgtgccgatttatgatttggccgctttatctgaaaaattgcgtccgagtatgcacaccgctattgtctgcgtcccaagctcggcccaagctgcagtggtgcgtcaattagaagcgcaaaacgtcactgccattttgacctttgctcccaaaccggttcctgccaaaccgacgaccacgattcgctacatagatctcaccagcgaattgcaagccttattgtttgtcgatcatcaaaagcaggttaaacgagtgtcgcaagggtagcacaactgagccgtagcaggctatgtttccgaaaaggatagcgctagcgattgacccgtcaaaatcaacgggttataattcagctaatgcaatgatcaagagggtcatggtctttttttccagcgacaaggtggttggtgcaaaccttgaaaaaggctatggttgtagcttgtgagctgccgtcctgaagtgagtagggagcggccggtgacagccgttatcctgaaccaagtggggattgtttcccaatttaggtggtaccgcgagctgactcgtcctaatttttttaattagggcggtttttttattctcgtaagtcagcttgcgggccgcgttactgcaggaacagaaaaaaattgtgaggtggagccaatgaaagagcaagcattagcacctaagtacgatcataaggccgttgaagctggccggtatcaagaatggctagatgaggatgttttcaaaccgagtggtgatcaaaaagccaatccatactcgattgtcatcccgccgccaaatgtgacgggtaagttgcacatgggccatgcatgggacacaacgctgcaggatattgtgattcgcgaaaagcggatgcaaggttttgatacgttgtggctgcccggaatggatcatgctggaatcgcgacacaagccaaagttgaagctaagttgcgtaaagagggcgtcagccgctatgacctagggcgcgataaatttgttcaaaaagtttgggaatggaaagacgaatttgccaagacgattcacagtcagtgggcgaagatggggttgtcacttgattacagccgcgagcgtttcaccttggataagggacttaacgaggctgttcgtaaggtcttcgttgagttgtataagcaaggcctgatttatcggggcgaatatatcgtcaactgggatccgcaggcccgtacggcgttgtcggatatcgaagtcattcatgaagatgataaaggcgccttctaccatgtgaaatatccgttcgcagacgggagcggttatattgagatcgccacaacccgtcccgaaacgatgatgggcgataccgccgttgctgtccatcctggtgacaaacgctatcaggacttagttggcaaagagctgattttgccgctggctaatcgcaagattccaatcatcgaggatgcgtatgttgatccagcatttgggacaggggcggttaaaatcacgccggcacatgaccctaatgactttcaggtaggaaatcgccatgacttgaagcggatcaacacgatgaatgaagatggcacgatgaacgaaaatgctggcaagtacaatggcatggatcgttttgaagctcggaaggccatggtggcggatctggataaggaaggtctgctactgaaagttgagccaattgtgcatagtgttggtcatagtgaacgcaccggtgttcaggtcgaagctcggctgtcaactcaatggtttgtgaaaatgaagccgttagcggacgctgccatcaaagcacaacaggaagctgataaaaaggtgaccttcgtgccagatcggtttgagcacacctatttgcaatggatggaaaatattcacgattgggttatttctcggcaactttggtggggtcatcaaattccggcttggtacaacaagcagactggcgagacctatgtgggcatggaagcaccaaaagacattgaaaattggcagcaagatccagatgttttggatacttggttctcaagtgctttgtggccattttcaacgatgggctggccggataccgattcaccggattacaaacgctactatccaacggacacattggttaccggctacgatattattccattctgggtggctcgaatgattttccaagggctgcatttcactggcgagcgtccgttcaagtacaccttgatccatggcctgatgcgagacgaacaaggccgcaagatgagtaaatccttgggcaatgggattgacccgatggatgtgatcgaaaaatacggggccgatgctttgcgctggttcttgattacagggaataagcctggtcaggatactcgctttagttacaaacaagttgaagccgcttggaacttcattaacaaaatctggaacatctcccgattcgtgatgatgaatctcggggacttggagaagccgcaacaaccagatccaagcaccttcgatttatctgataagtggttatttgcccaattgaacgaaacgattaaacaggtcactgatttatctgaacgcttcgaattcggcgaaatgggtcggactctttataactttacttggaacgtttttgctgactggtatgttgaaatgagtaaagaagtgctttatggcgatgacgaaaaagcgaaggcagctaagcgagttaaccttgcttatgcgcttgaccagattctgcgcctgttgcacccagtcatgccgtttgtgactgaaaagttatggcttgctttgccacacgcaggacagtcaattgtaacagccagttatccagttgctaatgatgcttttgaaaattcggccgctgttgatgccatggattcaatcatcgctttgattcgtggcgtccgtagcattcgtaaggatgcaggtgcgccactcaagacgaaggttgacattattgtcaaattaactgactcggctttgaagccaatttttgaggacaattttgactttattgatcggtttgttaacagcaaagctttcacagtaggaaccgatgttgccgagcccaaaatggctggcagcaccgtgatcacgggagcaacaatcttcgtaccgttaaatgaactggtggatcttgatgaagagcgggctaagttgacaaaggacgctaagaagcttcagcaagaaatcgatcgcatcgataaaaagctgaacaatcaaggcttcctcgccaaggcacctgaggcagttgttgaagaacaacggaccaagcgcagcaattttgccgatcagctgaacagcacacagcagcggttggcacagttgcagcaggcttaatcaagtttcgctttaaggtaacgatcagattgacgttggtttgctttttgttaatagattgattgaaaaggggactgaccatggtgacatggccagtcctttttgtttgcctatagacggctgaccgtttaaacgcttttggcacaaggttacgtctagttatcattcaaaaatcactgggtaaacatcataacttctccagaatttctggtatcatgaaacttatgaagctagcacttgcacgctggcatagaaaccgggcgcgttcatgccctgaggaaagaagttaaccatggactacaccgaaagtgtcgcgtatattcattcgtttccgcgcttcgccaaaactggcgaccatcagcgcattctcaccttgttgcatgccttgggtgacccgcaaaaacgaggccattatattcatgtcactgggacaaatggtaagggctcagccggtaatgccattgcccatatccttgaagcaagcggtttgagtgtcggtttgtatacatcaccgttcattatgcggtttaatgagcgcatgatgattgatcatcagcccattcctgatgctgagcttgttaaagcggtcgctgtcggacaacaggccttaacccagctgcggcaagcgacaccagatttcggggtaacggaattcgaatttatcacggctctggccttttggtattttgatcaaaaacaggtggatttggcagtgattgaggtggggattggtggcgacacggattccaccaatgtgatcacgccggttgtaagtgtgctgactgaggtagctttagaccatcaaaaactgcttggcgatacgattactgcgattgcaacgcataaagctggcatcattaaaccgcacgtcccggttgtgactggcaatttggtaccagatgctgatgctgttgtggcggcaaaggttgcagcaacagctagcacgtggttgcgatttgaccgcgacttttccgttcccaaagcgcgcttgcatggctggggtcagcgattgacttatgccgacaaggatggtgagctgacagacatagatataccgctggttggtgattaccaacagcgaaatatggcaattgcgattcagacggcaaaagtctatgcctctgcaacgaattggccgttgaagtcgcaggagattcgcaaagggctagcggccagtcgatggccggcgcgattagagaagttaagtgacgaaccactgattgtgattgacggcgcccataatccggacggcatcaagggattaattgccgcattgcatcagctctttaaacaaccggtgacagtgattgctggcattttggctgacaaggattatcacaccatggccgatgcactaacgaaggcatttcataccgtgtatctcgtaccggtaccaggcaatgcccgggctttgcctgaggctgggtatgcagccttgcatgaaggccaattaaaggactcctggcaagaagcaatggccgcgagccttgctgacgatccggaccagccaatgatcttaaccggctcgctttatctggccgctgatgttcgacaaactttaagagcgtgagccaacccgggtagaaaacggagtgtaagcggacctgaacgtgatggcagggctttggccattgcgtttagagcgtgagtaggcgcggttagaaaccggagcataagcggccttgaagtctaaatggctgatccttggccatttagacttcaaggtccttatgtgcaggtttctgcgcctgcgaacgcgtttcataagagtcgagaccagctcaattagaacagcgcgtgagcagttttttttgtgtcacgagcgactttaaggaggagaccatgacgactaccattatttttgatcttgatggcactttggtgaacaccgaggcactttatctcaaaagcaatgtcaaagctgccgctcaactgggattgcatcgcactgaggctgattttcggccgttagtgggtgcagccggccccagcgaggccaaagtgattgccgacatgattggcgccgaacatgctgcttggtttcaaaagttttcgacggcggatgttcttgatcaaattcaaggcggcgcagattttgttttgccaaatgtacagccaactttagcggcattgacaacggcaggttatccattggcgctggcgacgagtagtccgcggcattatgtggatgttgtcttggcagcaaccggctggcagaagcagtttcacccgattttgactggtagcgatgtacaggcgcataagcctgatcctgagatgtacgaagcaatgaaagttaagctgggaaatgtaccagctgttgtcgttgaagatacccatgttggtgttgaagcggctgttggggctggcctgccagtggtcatgattcctggtattgcgcaaaaacccgattcaaaagcgaccgcgattctgtcatcaatcagcgaattaccagcttggttgaaaaatcagcctgcgtttgcgtaattttctaatgacaccgataactgatcggtgaagtgagaaaatgccaacagggggaattttcatggcagatgcaacagaattgccacgtgaacggttattagcgcatggtccgcaggctttgacggatgctgagcttttgcagctggtggtgcgagcaggaaatcaacattatccggttaagcagatcgtgagtgaagttttggcgacttatccgaaacttcagggcttggcagaaggggatcaagggttgcttgagcatattcggggactgggcgctgccaaacgagctagtattttagctggggtggaattggggcggcgggctatgcaacggcagacggttcgctacgggcaaatcaaaaatagcgaacagttaggcaaaacgatgatttctcggtttgctggtgtgaatcaggaatccatgttgattttatttttagatgttaagaatcagattattactgaacagattgctgcaattggtacagtaaattcagctatggcagatccgcgtattgtttttagagaagcgttaaagttgagcgccacaaacctgattatggtacacaatcatcccagtggtgatccctcgccaagtcaggcggatcgggacaccacgactcggtttcagttggccgccgcgttgcttggcatgcatttgattgaccatctcattgttggtggggaacgctattattcattcgcgcgcgatgatccggagttcaattaggcaggggaacaaagttgtaagcttttctcaaattgcccatctggcatgaaaatcgggtagtttcacattttgtcacagaaataaatatgctataatgcatggagttatacgaaatgagtcagcataaggggagaacgtcttgtttggatttggatcaaaaaatatcgggatcgatcttggcactgcaaataccttggtttacgttgacggtaaaggcatcgttttaaacgaaccttccgttgtcgcgaagaatacccaaacggaagaagtcattgcggttggtgaagaagctcgcgacatgatcggtcgtaccccgaccaatatcgtggcgatccgcccaatgaaagatggggtcatcgctgactacgatacaacggcagccatgttgaaatacttcatgcaaaaggcgctcggcaacggtagtcatccgcaggtcatgatttgtgtgcctagcggtgtgaccgaagttgaaaaacgcgccgtgattgatgcggctaaagttgctggtgcacgcgatgcattcgtcattgaggaaccttatgctgctgcgatcggtgctggcttgccagttatggatcctaccggcagcatggttgttgatattggcggcggcacgactgacgtggcgaccatctcacttggcggtatcgtgtccagtcgttctattcgagtggccggtgacaagtttgatgaagcgatcatcaatcacttacggcagaatttcaacctgttaatcggtgagcgaacagctgaagccatgaagattcagattggctcagcatctgttgaaaaggcaaaagatattgacggcatgacggttcgcggtcgtgatttgttgagtggtttaccgaagacaatcgaaatttcagcgactgacattgccagtgccattcatgaaaatgttcttgatatcattacagcaattaaagagacgcttgaagaaacttctccagaaattgctgccgatgtcattgatcatgggattgttttaacaggtggcggtgccttattgaagcacttgccggatgtcatttcggatgaaaccaaggtaccggtcttcattgcccaagatccattggattgtgttgccatcggtactggcgagtcattgaagaatattgatgtcctaaagaagcgttaacagcccataaatgaagatggttcgtgtgtggcaagaggctgggatgatttgatcctggccttttttcgcgagtatgacggaggaaccaatgcagaaattcttttccaataaaaaattgatcgccctcatgatcgcgttgctggtcagtcttggtttgatcgcagggtcgatgtatgcgagtaataatcgtaacaccccgccatttattcaacggattgccaacgatgtcgtgggcattggcggtcacttggttgccattcctggggattttgctcggaatggcttggatgacatcaacaatcttttggatacctttcaggagaatcaacggctaaaaagtcagctggataatttagctcagacgaaggttcaggtgcagacacttaagcgggaaaacaagcagctgaaaactcagttgaagttaaacggcaccttgaccgattattctcaaattagtgccgcggtgattttacggacaccaagtgactggcgcaacatggttgtgattaatcaaggcagcgctgctggtgtcaagaaaggtatgccggttatggccggttcgggactgattggtcgagttgttgaagtcaatcggacgaacgccaaggttgagatgttgtcgacggctaacaagtctagtgatcgcatcgccgccgctgttgaaactaaaggcgataaagaagtgaacgggatcattactggttacgacgagaagtccggtgatctcattttgggtgagctgaatactgatactgatattaaaaaaggcgacgatgttgtcaccagcgggttaggcggtatgaccccgaaaggcttactcatcgggaaagttgccagcgtcaaaaaagatgactatggtttggccaacagtgtttacctaacgcctgccgccagtctgaatgatgttactgtggtgaccgtcatttcgcgcacgattgcaggtgactaagatgctgaatgaaaaacactttactggtcattggtggattgttctcctgttgttgctgctgatgttgattgatggtagtctggcatcggtattagcccaatggatcatgcgcccgaattttatgggcacgccgcagctgacattacttggactcattatgatcacgttatttgtccctgaggaaaaatatattacttggattgctgcgatcattggactcttgtttgatacgttttatactggcattttaggggtcaatgcactactgtttccattagttatttataccattcgacagattcggccgtatattccgcgaacgccggtgtttgtcggtatggtttatattattgggttattactgtatggcattgcgaactacatcatgaatcgattcatcggtttcggtactggaaatgtcgtgatgcttattgcaaaccacctcggccctggtctgacagtcaacttggcgttgtttgtcattgtatatgggccgttgcaccgtttgttagacaatttagctgaagaatagttggggtgatgatgtggacagtgtcgtcttaaaaggtcgtaacgatggtctggcgctgcagcttcaagatacagcagattttgagcagatcatgcgcacactgaaaacattactaggcaaactttacgaagaaacgccaactggtgatgtcagttaccgacttgaaaccggaaaccgtttgctgaccgaggagcagttagccgatattcaaaagatttttgctgattttccgcgtttttcaattaatggggttgtcagtgcggtgatcgacaaaacggttgttaacgaaatgattgcagccaaaacaacccatcgtatcggtggcgttattcgttctggtcaaaccatcgatttgatgggcgacgtgctttttctcggcgaccttcattctggtgctaccttgtgtgcttctggtaatatctttgtgatgggtcaggttggcggcgtggttcgagccggcagtcaaggagatgctcgtgccgttgttgtcggtgatttgaaaggtgcggggcagattcgaattgctgatgtcgtggagattgtggcagatcattacgatcctgaccgaccagtggcttatctgaatgagttacatacgatgacacatgcgggattagcggatctggccagcattcgaccgcgattattcaagcaaatggaggcaatgtagatgggtactgcgttagttgtcacatcaggaaaaggcggcgtcggcaaaacgacatcgtctgctaatatcgggacagctttggctctgcaagggaaaagggtcgttttgttggaccttgatattggtttgcgaaatctggacgtcgtgatgggtttgtcaaaccgaatcatctatgacattgtcgatgtggcaaccggtcgcgctaaactacatcaggctttgatcaaggacaaacggtttgatgacttgttgtacttactgccggctgcgcaaaacgcggaaaaagatgctttggagccagaacaggttgttgaaatcgttgagcaattacggcctgattttgactttatcattcttgattcaccagccggtattgaacaagggtttagaaatgcaactggggctgctgatggtgcgattgtggtgacgacaccagaaatttctgccgtcagtgatgcagatcgtgttgttggtttgcttgaacaacgtgaaatgccaataaaaccgcgcttggtcattaatcgcattcgccaaaacatgttagccgatgggcgctccatggatattgatgaaattacgagtcacctgggactcgatctgctcgggattatcgtggacgatgatggtgtgatcgcaagctcgaataagggtgaggcgattgtgatgaatccagacgatcttgccagcaagggttatcgtaacattgctcgccggctgttaggcgacagcgttccattgatggatattcggataaaaaagcagggcttttggtcaaaactgttccatcgtcacgactgaaatacgtgctggcgtgacagcaaatcggtgaaacttttcagaaactagttgacattgattaagattcggtgtaatttagtgacaattcattaaagcgttgagtggaatcgatgagtggtcgtgtcttgaagcgagtccgggatgatgggaaccggatagacatccattgatcacacatccacgagtggacgattgaacgaagtaggtcgtctcggttgggctcgttatcgccgtggttgagataactacatgaggttagctgtgtgagcagttaacaaatgtgaggtggaaccgcggtaaaagccgtcctcttacagcaatttgctgtaggaggacggctttttgtttaccggacatctttcttggacatgatttttcaaccacgtgaggctgattgtgtgaacaatcagcaaactgaggtggtaccacgcaaaagcgtcctcttgcagcagcatgcaagggggcgcttttttgacgagttggcgcgaacagtcccagctatgcgaacgccatcagtcacactgacacagcgctgaaacgaatatcattaggcttgaatacgaaaagggcgtgaactggtgtgattagaaacccgagcgtaagcgaccaaggtccttatcagcaggggttttgcaccagtgaacgcatttagaggaggaaacaccatgagctatatttttcagattttaccggcattattatctggtgtgaaaatgacgttgggtatttttgctatcacactgattgggtccattccattaggcttgattctatcggttgggttgattccaaagctaaaatcgatactgggtaaagcagggaaagggctgcttgaaggttatgtgtgggttttccgcggcacgccattactgctgcagttaatgtttatcttttacggactcccgattattggattggtatttgatcgattctccgccgcactggtcgccttcattttaaattatgccgcctattttgccgaaattttccgtggcggcttcggggcaattgatgaaggccaattcgaagccagcaccgtcttgaacatgacgcgttggcaggcgctgcggtacgttgtgattcctcaagtggtcaaaattgttttaccgtcaattggtaatgaagtcatcaacttggtgaaggattccagcctggtgtacgtcattggcttgggcgacttgctgcgagcaggtaatatcgccagtgctcgtgatgttaccttggtgccactggtacttgtggggatcatttatctgttgttgacactgatcctgacatttttacaaaaacagatcgaaagtgcattttcatattatcgctaggaggggcaacctatgttagaactcaaacaaattaataaatcatttaatggccagccagtcctggtggatatcaatgtgacgattgaagatggcaaaacgttagccattgttggaccaagcggtgctgggaagacaacattgttgcgaatcattagtggactagaaactgcagattccgggacgatgatctggaacggtcagccaacgacagcgcaagcattacgcaaagaaggcgtcattggcgttgtattccaaaacttcgaactttttccgaacttatccgttatgcgcaacatcacgcttgcaccaaccttgcaaggcgttgatcagaagaaagctgatgaaacggccaagaagttgctagatcggcttgaattagtcgctcaggaaaatgcctatccgtattcattgtcaggcggtcaaaagcagcgggtagctattgctcgggcgttggcactgaatccgcagatcttgctttacgatgaacccaccagtgcgcttgatccgtttttgcgggaaaatgtggctgccttggttaaccaattcaaagcttctggcatgacgcaggttgtcgtcacgcatgacatggactttgccgaaagcgtggctgacacgacttatcacgttggcaaaggcggtgacggtcaatgaaacgccgaattgtactggcactcatgttactcgtcacattgctaggcaccgtcattagcggatgtgcgcgcgaaaccgtcggcaattcctggccacggatcgaacgaaccaaaaaagtcgtcatcggtttggatgacacctttgttccaatgggattccgtcaaaagaacggtcaactggctggctatgacattgatctggcaaaagcggtattcaaacgctatgggattaatgtcgattttcaaacgattgattggtcaatgaaggaaactgaactgaaaaatcaaacaattgatttgatctggaatggttattcggtgacaccggaacgaaaagagaaggttgctttctctgataattatttgattaatcaccaaattttagtcaccaagaccaaaagtaatatcaaaacgatcagagatatggctgggaaaaccttgggtgtccaaactgggtcaagtggcgcctttgatctcgatgcccagccaaaattgctgaagaatttcattgcaaacaaaacaccaattctgtatgacacctttaacgatgctttcattgatctcgatgcaggacgcattcaaggaattttaatggatgaagtctacgctcgctattacattgcccacaaaccggacccgtccagctatcgcattgccagcgacgactttccacctgaaaactttgcggttggcatgcgcaagtcagacaatgtcttacgcagcaagattaatgccggtttgaaagcacttaaagctgacggcaccgtagcaaagttgcagaaaaaatggtttggcaaagtcgaggagtaatcagcgtatttgcgaagaaaaaatgaggttgtgccgctggcaattgtcagggcatgaccttttttcgtcaagaggcacctaaaaagggaacttcgggaccacttgggtgagtatggaaatgtattttttaaaggcatagctgggctaattaggttatgatacttaagtaaccttcgccaatgaaaccacttgtaggctcaaaatttgctggcagttactgggaggaaatgttatgtggatctggttggtccttgggtttctttacatcatcaacgcactgacagcgatcatcacggtctttcgttcgcatcgtgatatttctgcagtttgggcatggctattggtgcttttactgttgccggtggtcggcttcttgatctattttgtttttggccgcaagttacgggctaatcgcatgcaggatctgatgacgcagcgtttgctgggcatcgacgatttagttgatcagcagcagcaagccttggcagctggccaaccgttgattggaacgcctggcagtggcggtgtttccgagctggtctgcaccttattgcgtgctgatgacgcgctagtaaccacccacaatgatgtgcaagtcttagcattgcgtgaagccttttttaagcaattgttcgaagatattgctgtggcaacggaacatattcacatcgaagcttatactattcggcctgatgcaattggccaccagttgcgcgatttgttaattgaaaaagcccacgccggtgtcactgtacgcgtgctttacgatacatttggctcccacgacctaccaaacaatttttggaaaaaattaacggcagctggcggtcaggttgagcgttttgtcgctacgaaactggggcgttggaatccgcgaatcaactttcgtaatcatcgtaagctgatcattattgacggacagcttgcctatctgggcggttttaacctcggcaaggaacaccacggattgccaatgttgcgcgatactcagttacgaattcagggcaaggcggtcgccgtggcccaggcgcgctttttgatggactggaacggaacgagcaagcaacaaaaagtaaaaaatgttgatgtcctgtttagagaaccggttgtcactgggaacacgacgatgcaaattgtctctggcggaccagagcagcaggttgaagcaatcaaactaggctatcttggcctcattaatcaggcaaaaagaagtatttggatcgaatcgccatatttcgtcccagatgacagtttgctggatgcgctaaccattgcggcgaatgccggcgtggatgttcgagtgatgattcccaagaaagccaatcagatcctgatggccaaggcttcgctgttttatcttaatcaggttgtggcaaatggtggacaggcatttttatatgaagaaggttttttacatgctaaaacgattgtggttgacggcaaatacgtttcaactggcactgccaacttcgatatccgttcgtttaaactgaactttgaaattgcggcatttatttacgaccatcggattgggaagactttccaaaagttgttcttagcggacatggaacgggcaatgccttacacgcaaaaagtgatcaaagcaaaaacgcggcctaagcaactcagtgaagaactctcccgcttactagcaccaattctgtaatcgccgcgccatgaagctgagttgaaaaagggcagataaaaagccgctggcacacagcggctttaagtataaggtgagatcggtttagatcaattgtaaacttgctagggcacccagaacaacgcctaaaacggtaatgatgatcatgacccaggcgctgatgatggtcatcttctggaacttgctttttttctttttctgcaccgaaaacaccacctttgttgttctgctggctatcattgtactggtttttgccggtatcggcaagataatcgctgctttttgtggtcttttctagcgactaggtcggcgaggcagtattagttgtggtcaagtactgcggcaatatcgggggcttcattctttaaaagcctaatagacgagctaacagggtgttattcaattttttgttaaattttttcaaaaaagcaggcaactttaccacgcaattattttgcaaagcttgacgctccacggagctttggttagggttaattgagagatgtatcaatacgcggcaccgaagacggttgctgcttttggagggaatcatcatggtgttgcttgcgatgggtttgcccattctggtatggctggtcgtcgttgcggctgtcgttcaattcgattttcatggcggttcgtggttttgtttactcgcaatcgttaatttttgggctatttttaaactaacctttaccaagacaccaaattttatttgggtcattttgtttaccacgatggtgattgccttgattttggtcatttggcaggtggtacgtgaatatgacctaatcgttcgtcgatattggcgcatgttgacccgtgttttagccttagccaccacatgttggtggatggcgggtgttttaatcttttttctgggttaattccccacttttctcccacaactcattatcgcccgtgatccttgtgatcacgggcttttttgtgctcttcaaaatgattagcttattaaataacccaattttcattcataagtggttacatgtggagaagagtgggtcattgtggtagactgaaaaaagtagggaggtgtcaaccatgctcatgggtgaatttgaacgcagtattgatgcaaaagggcgtttaattattccagctaagtttcgcgatcagctgggcgcctcttttgtgctcacccgtgggatggatggctgccttttcggttatccgattgctgaatgggacaaactccagaccaaacttgcaaccttaccattggcaaaaaaagatgctcgaacctttacccgatttcttttttctgccgcaacggaatgtgatatcgacaagcagggacgaatcaacatcccaaaaccgttgttcaaacatgctggtttgcaaaaagattgcgtactagtcggcgtgaacacgcgtatcgaagtttgggatgccgaacggtgggaacagtttgctgaaaccgctgaagaaaactttgatgatatttctgaaaatctaacggactttgggttatagcgatgacagaatttaaacatgaaacagttctattaaaagaagcgacggcggcattggcggttaaacctgctggtacttacgttgatgcaacgttaggccgcggcggccatactcgacagattctcaatcagctgacaactggtcgattaattgcttttgatcaagatgaggcggcgattgcaacggtcacagccgattttggaacattaccaaaacaactcactttggtacatagaaattttcgagatttgaccgatgcattaacgacgctgggaataactgaagttgatggcattttatacgatctcggcgtttcgtcaccacaatttgatgattcaaagcgcggcttttcctatcgctttgacgcgccactcgatatgcgcatggaccagcgtcaaacgctcgatgcaaaaacaattgtcaatgaatggccttatgccgatttggttcgcatcttttcccgatatggcgaggaacatttttctaaacaaatcgctcggcgcattgagcaagcacgaacagtccagccgattacaacgaccttccaattggttgagttgattaaagcaggcattccagcaaaggctcggcgaacaggcggtcatccagctaaaaaagtttttcaggcaattcggatcgcggttaatgatgagctatcagcgcttgagtcgtccttagaacaagcgttgaagttgatcaacgtcgggggacgcatcagcgttatcacgttccaatctttagaagatcgactcgtcaaaacgatgtttaaagaagtttcttcggttcaggatgtgccgcgtggcttgccggtcattccggcctctgcacaaccgaattatcgcctagtaaatcgaaaaccgattttaccaagtgaagaggagcttgcggtgaatcaccgcgctcatagtgccaaattgagagtcattgaaaaaattcacgattagggggtacaatctatgcttgagagtacagcaagaccattagtgcagcagccggaaacaccgccaatacataaacctgtcaccacacctgcgcccaacacacatattgcatttagcgggtttgaaaggacattgatgtttgcatgtggtgttttagcgaccgtggtttgtgtagtctgtttgtttatgcaaaatcggttgagcaatacacagcgtcagtatgaagatttgcagacgcagattgccaaacagtcccagacaactgcgaatctcaagcaggagattggtgaactttcaaattcagaacgccttgatgcctttgccaaagcacacgggtttaaggttatcaacggcaacataaagcgtgttgataataaatgaaaattttcaaatcaaaacgatcaacgaatgcacatcctgcccgaaaccgtaaaattttcggcatctggatgatcggggtcacactcctgatccttggtgggttcgttcttcgtttttcttttgtggcgactgttggcgaggttgattctaacaatctggcgaagcagcgacaaaaacaatatcaaactgatactgtcttgcaggctaagcgcggcgccattctcgataaaactggcaatgtgatcgcagaagattccaatacttataccatttttgcgattttggacaagcaaagcaaagacagcaacaataaacctgattatgtggttgataaagcaaaaacggcgaagattctgagccgttatttggcgatgtcagaagcaaaaattttggcgcgactaacgccaggtaaaaatatgtatcaggttgaatttggcacacctggcaccaaattgagtttggcgatcaagaaacaaattgatgctgaaaaactgccgggcatccattttagtgaaacaccgtcgcgactgtatccaaatggcgtctttgcgagtcacgtgattggtctggctcaggcacaaggcaaaagtaccagcttgacaggcgtcatggggcttgaaaagcaattcaatacggttttagccggtacgaatggttatcgtcgcagccagactgatgcatatggctataagctgcctaacgcaaagacgaatctgaaaacgcctgttaatggcggtaccgtctacacaacgctcgatagtggtttgcaggcctatttagagacgctgatgaccgacgtgcaaaataaatacgaaccaaaaggcatgacggccgtgttgatgagtgctaaaactggacagattttggcagcgactcaacgaccaacgtttgatgcttcaacgggtgaaggcttaggcgacatgtggcgtgactcgcttgttgaagataattatgaaccaggctcggtcatgaaaattgtgacgctggcggctgcgattcaaagtggcaagtatcacccaaatgattattatcaatccggatctatcaaattggatggtggtactgttaatgactggcgaaccggcggctggggatccattcctttaagcaaagccttccctctgtcgagtaacgtggggatggttaagattgaacaggcaatgggggctggcatctggaagcagtatttggataaattccgtttcggccagaaaactggcatcaccttgcctggtgaaactagcgggcacattagttttgaacggcccctcgaccaagcaatcacctcatttggtcaaggcattgaggtcaatgtgatgcagatgctgcaggcgatcagtgccgtttccaatggcggcaaaatgttgaaaccgcagatcgtttctaaagtcatctctcagaacggcaaaaccaaagtttataaaccggaagtcgttgggcaacccatttcaaaggaaactgcggcccaagtcattgatgcaatgcggcatgttgttaacgatgaagacggcaccggtgtcgcatacaagatgcccggtgttgatctggctgtgaaaaccgggacggggcaaattgccagtccacaaggtggctatctgacaggtgattcaaactataccttcagtgttgccggggttgcgccggcttctgatccacagtacgtcctttatctggccatgaaacaaccgcaaaaaatgacggaaccggccgaatccattttggctagcatttttaaaccgatgatgcagcgggcactggatacaactgctaatggtgcggttactgatgataccaacacggccaccattccagcggtcactaacgcggcattgacaacggctcaagatagcttgaagcaagccaatttcgacgtggcaactgtgggtacaggtaataaagttgtgcaacaattaccaacaagcggtaccaaggcactgcacggttcccgagttttgcttttgacgaacggggccatgaccatgcctgacttaactggttggtcaaaatctgatgtgttaaaatttgtacaactgaccggtaagaaattcaaacttgtcggtgatggttttgtaactcagcaaagtatcgctgcaggcacattgttaggcgatactagcgggaccattaaatttaaacaacaatagaattggggatagtcatgcaacttgctcagatgctcatcccgatggtttcggcatttgcaattaccattatgttcatgccattgttcatcggctacatgcgttacaaaaaagaaggtcaggtgattcgcgaagagggtccaagctggcacgagaagaagtcaggaacaccgactatgggtggtttgatttttattgctgcgatcattgtgtcggccatttgggtcggtatttggcagcatcaactgacgctcagtgtctgggtctccttgtttattttggtgctctatggactgcttggcttctatgacgattttgagaaactggttcatcatcgcaatgaaggacttaaggcatggcaaaagctagccggtcagattctgggtgcgattattttcctaatcgcttatttccatgaaggctttgatcacacactatgggtgccaattattggcaatgtcagtgccacttggttctacgttctttttgtcattgtttggttggtaggcttcagtaatgctgttaatttgacggacggcttggatggcttggttgccggtcaaacaacaatttcatttggcacttacgcgattatcgcggcacatgacggtcggactgatgttttgatcgtttgtttggtgacgatcggtgccatgcttggtttcttgatgttcaatcacaaacctgctcagatttttatgggtgatcttggatcattagcgctgggtggcatgttggcagtggttgctatcttgctgcatcgcgaatggtcattgttgttgattgggattatttatgtcaccgaaacagccagcgtgattttgcaggtgggttcttttaagttaaccggcaaaagaatctttctcatgtcacctattcatcatcattttgaaatgaagggctggtctgagtggcaaattgatctgacgttctggttggtcgggctaattggcagtggcatctatttagcattttttctttaaaattaaggcataagcaaagaaggatagatcgtgaagaatatttcggattatcgcaataaaaaagtgcttgttttgggattagcgaaaagtggcgtgaatgcggcacgtctattacataagttgggcgctttagtgacagtcaatgacaaacaacaatttgacgacaacaaagacgctcaggaactgcttgcagacggtatgcgggtcattaccggcaggcatccggttgagctcttagacgagcatttcgagttgatggtcaaaaatcctggcattccatacagtaatccgatggttaagcgggctgaggcgttacatatgccaattatcactgaacccgagttggcttatcaggtttcggaagctcaatggatcgggattactgggacaaacggtaaaacgaccacaaccacgctgattggcttgatgttgaatcagcagcggccacatcatgcgtttgatgcgggcaatattggcattcccgttagtcaagtcgctcaaaaagtcggcaaagacgatacgattgtggctgagttgtcgagttttcaactgtgcggcatcaaaacgttgcatccacatattgccgttctaacgaatatttatgaagctcatctggattggcatggcaaccgggcaaattatgttgcggccaaaatgcgaattaccatgaatcaaacaccagacgactatttcatcatgaactgggatttgccagaaatgcatgagttggcgaaacagagcaaggcacaaatcgtcccgttctcaagaaagaacgcggaaggcgctcgagctcagttaatcgatggttggctgacgtttgatggcgatcggattatgaaggccagcgagatgcagatccccggcttacataatatcgaaaatgcgttagctgccatcgctgccgtgaaactcgaaggggtcggcgacgatgctattcgcgaagtgctgcgaacattctccggggttaaacatcggattcaatatctagaaaccattgatggccgccgggtctacaacgattcaaaagcgactaacgttgaggcagccaccgttgccttgaatgcattcgaccaaccgattgtctggctggcaggtggtttggatcgcggattgccaatggatgcactgacaccactggttaagaaacacgttaaaagcatggttgtttttggtcaaacagcacccttgatggccaagattgctaaagatgccggggtaccagttcaaacgactgagaatgtgatgactgcggtgccacttgcctatgaagtcagtcgccctggtgatgtcatcttactttcgccagcggccgcaagttgggaccaatatcctaattttgaagttcgcggcgatgatttcattaaagctgtcaatcaattaaaagcaacagtcgaaagtggggataagtaaatgcggctggtgatctctggaggcggcactggtggccacatttatccggcactggcgttgattgaagccttaaaagcggaaggaaaacttgacgatgtgctttacgttggcacgaaaaggggcttggaaagtcggattgtaccagcgaccggacttaagtttgcgacgctcgatttgcaaggcttcaagcgaagtctatcgttaagtaatttcacaacagtccggaaatttcttggtagcttgggtgaagcaaaaaaattgctacaggattttcaacctgatattgtggttggtaccggtggctatgtttccggtgccatcttatttgccgcgacacgattgcatatcccaaccgtgattcatgaatccaattcggtggctggggtgacgaacaagtttctgagtcatttcgttgatcgcgtggccatcgtttttcctgaagttgctaaggcctttccagccaataaagtggtggtgacagggaatccgcgggcccaacaagttgctggtttgaagccgaacgatcggctccgtgatttcggccttgatccgcatattcgtactttgttagcctttggtggttctcgtggggcgccacggattaatgatgcggttgtggcggccttgccaatttgggcgaaagcagattttcaagtgctgtttgctactggccggacgcattacgatcaaattaaggctaaattgcctgatttgccggcgacaatcaaggtggtcccgtacatcgatgatatgccatccattttacccgatatcggtttattgatcagtcgggcaggggcgacgactttggcagaaatcacggcgcttgggattccggcagttctgattcccagtcccaatgtgactcatcatcatcaatttttaaatgcccaaagtctaacgaaacaaggggcagcgatcacaattacagaagatgaattagacaatcattttccacgtcgggttgtgaccttgatggaagatgacgaaaaacgtgccgcaatggctaaggcatcaaaaaaattaggtgtcccagatgcaagtgatcaattgatcgcagtgatgacaacgctactttcgaaacgtaggtgataactttggcttggccccgaaaaaagaaaccgcaacctgacccgctgacaccgtggcagcaataccaggcgcgccagcagcagacgccgcgacatgatcggcgccagaagccaaaattgaatgtcgatctgccgaaagtacagaacttacggcggcgtaagctggttagaaacctcacgttgattttgctccccctgctgatattgctgggggtttttggctattttgctagtccgctatccaaggttgggcttgtgagtgtgcagggtgtgcggaccgtgcctgatcagcaggtgattaatgccacaaaattgtcggatgatgatttgatgttaagcgttatattgcataaaaaagcgatcgctcaacgtgttcaagattctttaccagaaattaaacaagcgagtctgacgtttaccggcttgaatcatattgttatcaaaaccagcgagtatgagacgatcggttacgtctatcagaagcatacttatcacaagattttgataaccggcaaagtgctgaagaacgggacgcagacgccagttgacacttaccctgttttttcaggcttcacagcgaaggaattgccgcagatgatttccttgctgcagcagtttccaaaggccattcagcgagacatttccgaaatcgatgctagtcgtggtgacgcaaatccttaccagatctcgatgaacatgaacgacggttatcgcgtgattgccgattcgcgaacaattgctaacaaaatcaagtattatccggcaattgtttcacaggttaagaaaaaaggtgttatcgatttagaagttggggcattttggcaggcatactcaagtgcggaaaagtcgtcaaacgactgattttgtaaggtttgttttctcaaggcaaatcgagtgtgttacactgataatggcaccattcaattatgaaattaacctattaaacgttacacaaggaggttcccgatacatggataatcaaggtatttacgttggacttgatatcggaaccacctcaataaaagtcattgttgccgaaacagtaaagggacaaatgaatgttattggtgtgggaagtcagcgatcggaaggcgtgagccgcggggtgatcgttgatatcgataaggcagttgccgtcattcgtgcggccgttgcccaagctgaagacaaggcaaatatcaagatcgatcgggtcgttgctggcattcccgccaacatgctgcagattgaacaagtttccgggatgatcgcggtcggtgaagagaataaagaaatttccgacaacgatgttcgcagcgtggcagcggcagcattggtccgcaacttaccaccagagcgtgaaacattatcattagtcccgaccgagtttatcgtagatggttttgatgatattaaagatccgcgtggtatgttgggcgttcgacttgagatgcgtggcatcatgttaactgttcctaagaccgtgattcataacacgaagaaagccattgaaaaggcgggtcttcgagttggcggtttagtgatttcgcctttggccattggtcgtttggccttaaccgacggtgaacaagattttggcaccgttttgattgacatgggtggtggtcaaagcaccgctgccgtgatccatgaccgtaagcttaagtttacgtcggtggatcaagaaggcggcgagtatatcactaaagatatttcagttgtcctcaacacgagttttacggacgctgagaaactcaagcgtgaatatggcaatgctgattcactggcaacgagtgaggaagagacttttcctgtaacggttgttggcaaacacgagccagcgatgatctctgaaaaatacctttccgagattatcgaggcgcgagtggcgcaaatctttaaacgtctgaacaaagcgttggacgctgtcaatgcgcttgatttacccggcggcattgtgattactggcggcactacggcgttgccaggcgtgacggaattggctcaggacattttcggccgaccggtcaaacggtttattcccgatgatatggggttgcgtcacccatcgtttactgaagggcttgcccttatcaaatatgctgcccagatgacagatattgaaatgctggtctccagcgtcttgccgacaccattcatggttgatggcgccgatgtccgtccacaaccacaaagtaagcagccagagcaaccggctgccgctgtggaccaaggcaatcagcgattacttaagcgcaagcaggaaaaacaaccggataaaccaaaatccaaggagccttcagcattacaccggttctttggcaatttctttgaataaatctcgatcctaggaggaacacgaatggattttcaaatggacgcacaaaatgaaaaaggcgccaacattaaagtaatcggtgtcggcggtgcaggcggcaatgcgattaatcgcatgatcgccgaagatgttaaaggtgttgagttcattgcggcgaacactgatttgcaggctttgaatgccagcaacgctgaaaccaagatccaactcgggcctaaattgacccgcggcctaggtgccggttccaatccggagatcgggcaaaaggctgctgaagaaagcgaagaagccatcggtgctgcgctgcaaggtgcagatatgatttttgttaccgctggtatgggcggtggttctggcacaggagcagcgccgattgttgccaaaattgccaaagaccaaggtgccttgactgtcggcgtggttacccgtccctttacttttgaaggccctaagcgcgcaaagaatgcgacagagggcattgcacaactgaaagagcatgtggataccttggtgattattgccaacaaccgtctacttgagattgtcgacaagaagacgccgatgcttgaagcgttccatgctgctgataatgtgttacgccaaggtgttcaaggtatttccgatctgatcaccagccctggttacgttaacttggactttgccgatgtgaaaacagtcatggctaaccaaggatctgctttgatggggattgggagtgctacgggtgaaaaccgtaccgttgaagcgactaaaaaagccatctcaagtccactgcttgaagtgaatattagcggtgccaaacaggtactgttaaacatcactggcggcccagatttgagcttgttcgaagctcaagatgcttcccagattgtggccgactcggctaaagatgatgttaatatcatcttcgggacatccatcaacgaggaacttggcgatgaagtcgtcgtgacggtgattgcgacagggatcgaagaagatcctcgtcaggaaccttcacgtcgcaacgttgctaagaaccgcacaacggatcaagataatcaaggcggcggttatcgcccagcctatgctgatagtgacgccaacgagaatcggcaggcaaaaagcgatgatccgtttggcaactgggacttgcggcgcgaaccaagcaagcgtcaggcaccaagcggcgatgatatgagcaacgctaagaaaaaagatttcgacatttttgaaaatcaaactaacgcagacgatgctggcggcgatgatcagccaccattcttcaagcgtcggcgtcaatagtcaggaggtcatgatacatggcgtttgaaaagttaggcgaaaaatttagcaacttctttgccatggacaatgaagatgattatcaagaccaagaagacgaacaggcgcaacaacccgcaccagaacaaccggtggacaatcattatcgcagcaacaaggtggtttcaatggcaacgcccgctggtaagacagcgaagatcgtggtttatgaaccgcgagtgtactctgatgccaaagaaatcgggtcgcatttattgaacaatcgggcggttgtcattaactttgatcgcatcggctccgatgatgcgacgcgcattgtcgattttttgacaggtactgtgttcgccattaatggtgagattaaatgggtgggcgagtcgattttcctcgtgacccctgctaactttgaaattgatgggtcactcgccagcaccattgactctgacggtttgaacctttcttcgcaacattaacgaggtgtcaagtgttcaatttactcaatgcaatctatcaggtgggcagttgggcaatttacctttatatcatcatggtcttcatttacattttgatatcttggtttcccaatgctcaaggctcagcactggatcgctttttaagcagatttgttgatccgtttctgagcatctttcagcgattcatcccaccattggctgggattgatttttcaccaatcctagcattctttgtactttcacttattaaaatggcttggacgaaattatttatcatgttagtccagaagcttgtaatcgggtgacaacttatggatgccatctatcagcattttcgaaaagatgaagcggcactgatcgaccattttgcggaactaattgaaaccgcacgaacggagtaccggccagtgctgacagactttacagatccacgtcaacggttgattgcgaccagtttagtaagcgccgatgatgatattaagatcgtacattttggcgggtatccccacgctgagcggcaacgaatcatctttgcaccgagctatttctcagcaacggcggctgattttgatattcggttgttacagatcatttatccggagaaattcgccgaactgcaccatagtacagtgcaaggcaccctactgaacgcaggccttgatcgtgatgttttcggtgacattatcacggatggtgacatttggcagttctttgtggccgcacacatgcaagattgggtcacaagcaatgttgataaaatcgggcgcgtgggtgttcatttcactgaacatccgctggcggattatgtgacaccggaaaatgactgggagccgctcaatttttcagtcagtgctttacgcttggatacagttgtggcccacggctttaacatctcgcgtcaacgtgccaaaaccttaattcaaggcggtaaggtgcgtcttaactttggtgaatcggatgcaccggatgctgaaattgcaacatcagatattatctctgttcgagggtttggccgcttgcggcttgatgagattcttggagagagtaaaaaaggtaaactaagagtctcagcggccgtgattcataagtagtcacaccgccgagtgcaacaattgtcccagaaaacgaattgatgaggaggactatcaatggctttgagtccactagacattcacaataaagaatttagcagcaaaatgcgcggctatgataaggacgaggtcaatgacttccttgcccagatcgttaaagattatagtagcttgatcaaggacaacgagggcctgaaaaaagaattggcagatgccaaggaaaaggttcagtacttcacggatatgaaggaagccttgaatcaatcgattatcgtcgctcaggaaagtgctgaaaaggttaaaaatagcgcgcatcaggaagctgatttgattaagcagcaggcgcagcaggatggtcaggctattttgagcaaggccaaagcagatgctgaccagaagttgcatcaagctcaagctcaaacggaacaaaccttgcatgatgccgcattgaaacgtcagaatatttctgtccaaactgaagacctcaagcgacaaagccgggtcttccgccaacgtctgcaagtgatgttggagtcacagcttgaagttgtgaagagtccagagtggaaggaattgctttccagttcacctgaagctgccgatacgaccgatccgagtcaagattcgcttgacaatgcccacgagggtttcgtaaactcagagggagcagtttccggcgctgatggtacctatactgagatcattttcccagatgatcaaagtggcgcaccagcctcgcaagcagcagcagatacgccggctagttcggcggcggctgagtcagaatcgacaaatgacagtaccaataattctgagtctgcaaccgatcatgatgctcaataacgtatgaacacgcgtcgtttggtggttccctttgcagcgagtcaggaagtaggtgtgagcctgacaagtaccgctgaatgatatcagttcacagttgtcctgccgaagttggtaagcaggaccggttgattaccgttagtcaatcactgagggggacttgttccctgaagttaggtggtaccacgtttgctcgtcctaatattagggcgggcttttttgatttcaattaataaaggagcgggtcacgtgaaaattaaagataccttgaacatgggtaaaaccagtttcccaatgcgcgctggtttaccgaagaatgaaccgatttggcagaaaaagtgggatgaggaccacgtctatgagcaacgccaaaagttaaatgaaggcaagccaacgtttatgctacatgatggcccgccatttgcgaatggcaatattcatatgggtcacgccttgaataagatcagtaaagatattattgttcgctacaaatccatgaatggcttccgggcgccttacgttcctggttgggatactcacgggttgccgattgaacagcaactagcgaaacaaggtgtgaagcgcaaggaaatgtcgatgaccgattatcgtgaactttgtcggcagtttgccatgcaggaaatcgacaaacagcgcactgacttcaaacgcctaggcgtgatgggtgactgggaacatccttacattacgctgcagcatcattatgaagccagtgaaattcgggtttttggtgccatggcgaaaaaaggctacatctatcatggcttgaagccggtttactggtcatggtcatctgaatcgactctggctgaagccgagattgaatatcacgatgataaatcaccatccatttacgtcgcctttaaagtggtggatggcaagggcttacttgacactgatacctatctggtcatctggaccaccacaccttggaccattccggctaactatgggattacggttaatccgcggttcgattacgttcaggttcaagttggcgacaaaaagtacgtggttgctgccgaattacttgatcgcgtagctgaagaaattggctgggaaaatccgaagatcctgaaaacctttaagggcacggatatggataaaatgactgctcagcatcctttatatgatcgcacgagtcttgtcatgaatgctgatcatgtcacgttggatgctgggactggacttgtccatacagcgcctggtcatggggaagatgactacaaagtcggagttaaatacggcttgcctgtcgtctcagtggttgatgccaaaggttacatgaatgaatatgcgcctggttttgaaggtgtcttttatgatgatgccaacaagcagatcacccaagcactggctgataaaggcgccctgctgaaacttgatttcttcacccatagctatccgcatgactggcggacaaagaagccggttattttccgggcaacgacacaatggtttgcgtcaattgatgctttccgtgatcagattctaaaggctattgatacggttgactttaagccgagctggggcaagacacggctgtacaatatgattcgtgatcgtggcgattgggttatttcccgtcaacgcgcatggggcgtgccgttgccgatcttctatgctgaagatggcgaaccgattattgaagaagagacaatcaatcacgttgctgatttgttcggaaaatatggctcaaatgtgtggtttgagcgagaggcgaaagacttgttgccagaaggctatacgaatccgcatagcccgaatggtcaattcaccaaagaaaaagacatcatggatgtgtggttcgattccggttcctctcatcaggctgttttggcggctcgcccagagctcagtttcccagctgatttgtatttggaagggtctgatcagtatcgcggctggtttaattccagtttgatcaccagcgttgctgccactggggtcgcaccttatcgcggtattttgtcgcaaggtttcaccttggacggcaaaggacgcaagatgagtaagagcctaggtaacacgattgtcccggccacgattgaaaagcagtttggggctgaaatcatccggctgtgggtcgcaacggttgactcttcctctgatgtgcgagtttctgtagacaactttgcccaaacttctgaagcttatcgaaagattcgaaatacgatgcggtttatggtagctaacacaggcgacttcgatcctgaaaaagatacgcttgcttatgatgaacttggatcagttgatcgttacatgatggttcgcttaaaccaaatcatcaagcaagtcaaaacagcttatgatgtgtatgattttgcgaccgtcgagaagactatcagcagtttccttgtcaatgatctgagtgctttctatttggacgtcgctaaagatgttgtgtacatcgaggcgaaagatgatcctaagcggcgtggtatgcaaaccgtgatgtttgtcgccttattggccctcactaagttgatcacgccgattctgccgcatacagcagaagaagtttggccatatctcaagcagccagaagcgtatgctgctttggctgatatgccagaagcagaacagtttgatgatgaaagccaattgttagatatctggtcaggctttatggacttccgttctgaagtgcaaaaggctttggaacttgctcgtgacaacaaagttatcgggaagtcgcttgaagctgcagtcacagtttatccttctgaacctgttcgcgatatgctggatgacgtcgatgccaatgtgatgcagcttttgatcacaagtcacttcgaaattgcgcctgcaactacgaaggcaccggccaatgccgaacagtttgatgacatggctgttgttgtaaaacatgctgacggcgaagtttgcccacgctgccgaatggtgcgtacagatattggtacagatccaaagttgccgcaattgtgcagccggtgtgcagctatcgttgagactaatttcccagatgctgtcaccaacgggtttgataagtaggcgggtgaagacatgcaaggacgcgttaaaaactttaacgttgacaaaggctatggctttattgaagctgaggggcaaccggatattttcgttcacttttcggcgattaatgaaccgggatttaaaagtctgacacccggtgaaacggttgatttcgttattgttgaagggcctcggggtccacaagcagcaaatgtgacggttcatcggtctgaggatggtgctccgcaatagactttttgatgccccgttgtcggctggcgatagggcgcttacggaaactctagacagtaaaaaacaccgcgagatcaaatcgcggtgtttttgtatacagcattcagtttttgtggtgcaagtttttaaactttaattacttgttgatttcttcgatcttaccgtcatgcgtacgggcaacggtcatctgagtaacggggatgtaaccgagctttggtaccaatgtcttttggacattctttgactgaatataattgatgaaagctgctgtggaggcgtttggtttgcctttggtgtacatatgttcataggcccaaatcttccaagtgttggtggtcacatttttgtccgttggttggacatggttaagggcaagcttttgaacaccgtctttaattgctgagaaggcgagatagctgatggcacccggtgttgttgaaaccatctgataaacagtaccgctagaatcttgttcctgactggttttaactttatttgtcttgatcccgaactgttcgaacgttgctcgtgtcccggaaccttgtgcgcggttaatcaatacgatggcctgatctttaccaccaacttctttccagttagtgatcttgccttggaaaatatcaactaattgctgcgtggagatgtttttgacgccgacgtccttgttgacaactggtgcaatcgcaacaacggctacctgatggtcaaccagatcatcagctttcaaatcagatttttcttgggcaaaaatgtctgaattaccgattgtaactgaaccggctgcaacttgactcaaaccggcgcctgaaccaccaccttgcacggtgatttctgccttaggattgtctgtttgatattgcttagctgcctgttcaaccaaaggctgtaaagctgttgaaccaactgccaaaatcttgctctgcttgattggggcagagctggatttgcttgaactgctggcggatttggacccgcagcctgccaatactaaggtggcggctaaggccacggtcaaaccgacgaacaatttcgaatgcttcattacttttccctccaatacttgaataacctaagcataaggttgctgtgtaaagacttcgccacgttgctgtaaagaatacgttttacttttgtaaaggctgtaacggttcctttgaaatgccgacaacactcggcgtataatgacgcagataggctttattaaaggagcggaacacgtgaaaaattacattgaggacaaaaatgttcagaaaaatcggtggtggatcctaactgccatcggaatgtttacaattatgtcgacgctagatgggtcaattgtcaacattgctttgccagtgatgagtcgcgatttacatattccaatgaatcaagcggagtgggtggtttcgatttatctgatgatgatctgtggtttgttgctgttttttggtcggctaggtgattcaattggcaaaatcaaagtttttcgagttgggatggtgctgttcttaattggttcgctttttgccggtttcaacaatagtcttgccttgttgcttgctgcgcgaattgttcaagctaccggtgcatctatgaccatggcgaacaataatgggatcgtaacggagatttttccaatgaatgaacgtggtcgcgccttgggtctgatcggttcctttgtttcgattggcgcaattgctggtcctgggattggtggtttgattttaggccagttgccttgggggtatattttttggatcaatattccgattgggattgtcgctttgatcctcggaacgattgttttgccaaaagatctacccagcaggcgcgtgccgattgattgggctggttttgtgacgtttctagtcttgatcttgtccctttttatggggatctttttgggacaggaacgcggctttaccgatcccctcattcttgggctgtttgcattagctatcgtggcgttcgctgcctttgttcatattgaaaatcataaaaccgatccattggtcagcttcaagatttttcaaaacagtgcgtttaccctgagtttgttgtctgcgttttttattttcgtcacgaactttttcttcaacgtcatttcgccgttttatcttcagaatgcgcggggattatcaccagaaaaagctgggtacttattgatgatttttccgattgtgcaagtgatcgtggctccggtggcgggtagcattgctgatcgcatcggtccttatcgcatcacaatggtagggttgttgatcattgttgccagtcagattgggtatgctttcttcaatttgcagacatcgtttatgtttgttgcattgatgatcggcttagttggatttggcaatgggctgtttcaagcaccaaataatactgtggtgatgtcgagtgtgccgacccgtgatttaggaattgctggcggtatgaatgcgttggcgcgtaatttaggaatggtcgtcggcatctcaacggccaccacagtgctgttttcttccatgagtcatactgctgggaaaaaagtaaccacttatctgactgggcaaccggacattttcatttctggtatgcatgtttctttttgggttgcgacggggttgtgcatactagcggtggctttaaccggctatcgcatgtggcaggtacgtcatgagacagctgtctaagtgaaagacataaaaaaaacatccctgctttttagtttcattgcggggatgcttttttaattggcgaagtgtttttatagcagataactgactgatcagttgtctggtgtgacgtctttggggccttgatgactcatatcaccgtgcgtataatttagcagttgttccttcagttcgccttctatttgaaccagttgcttttcggcattttggcgtttaacccgaccgtcttgttgaatctgcaaggtctgtttcaaagtgtcaatcaagtcgttttgtgtttgcgttaacgtctcaatatcgacaacaccgcgttcattttccttcgcagtttcaatcgaactgatcttcaacatgtcactgttcttctttaacaggtcattggtggtttgcgagacttgtcgctgggccgtgacagcatctttttgccgcaacaaggtgagggctatggccacttgatttttccacagtgggatcgctgtgttgatgctggcttgaattttttcggccaaagcctgattcgtgttttgaatcaggcgaatctggggtgcttgttgaatggtaatttgtcgagccaattgcagatcgtaagcacgtttatccaaacgtgacgcgaattgtttcagatcattgacttgctgaattgccatttggtcattggctgcttcggctgctttcaccgcttcaggaatggttttgtcattgagttcacgcaacttaagattggccgcttcaatataaatattcagagcatcaaaataagctttgttttgatcatataattcgtctaacagcttgttatcattgagtaacccgcgttgtgatgtttcaaggcgattggcaatcgtatcaatttgagcaccgatcttttgatacttcgcagtgatttcatagattgatcgcttgacacggccaaataatttgcggaaaatattattattttcagcttttaattcgtctgggttagcctcgttcaatctcgtcatgagacttgtcaaggcatcaccgactgcgccggtatcctgactttgaactttagttaacatgttttgtgaaaagacaccaagttgtttttgggcatcagcgccataattcaaaacagtttcgcctttcgtcacatcgattttgctggctaattcttgtgcttttgcttcttgttcagcacttagttttggcctcgctgtggccgctgcttgaacagcctcagccgaattgttgttggtcattgaagcttctgacatactgaaaggatcggccaataaatcatctgtcagattggtttgtttgtcatcattcacattattcactccgtttcatgcgccttatctggatcaaggtgttttttggcaagacgaacatcgctatcgagatcatcaagatcatctttaatgaaggcttgatagtctgacttgatattgcctgccatagaagtcatggtcgaaaatgctttgtctaaggtttcgtacgtatctgccgttttaacctcgtgatgcgtaatctgggcatatttttgcatcagatccagtaaattaggtacctgctgataaacgaacgtaccggcatcggttaagcgttgtggtgcttgaacaagtgcctcaaaataggcatgcagcaggtcaaccaaatcggtatttaatgtgagcgcacgcaactttggtacttcttttgtgagtgcctcgatagtccgaatttgttcggcaagatcggccattgtttttctaaaaagtttgatttcctcatcacttaaaccggatgcagcataatgttcagccatcttcggatcaagtgacgggagactggttgattttggcttaggccggcttagttcaccgatatagcgggcgaaggcaaagaccacaccaatgggcaaggcgatcacccaacgtccggacagtgcacctattgccgcacccatggcggcccagagtataattcgccatatgcgaatacgtttgcttgtggccacgagatcacttcctctttcgtttgcatttagtgtagcacaaccccgtggcttgactatcagccggaagttggatattagtaattattttattaaggatgcacggttgtaggttggctggtgtaagctgataattagggtttttttggccattttgaaggttagaggcgagcatggactcgcgcggttagaaacacttaaacgggtttaggtggtgatgaccattttttggtcatgatggccggtgtccttatgtgaagatttctgcgcctgcgaatgcagttaaggagggaaaatcaagtggacgaagaaccgatcgctcagcaacgcgtttttactggacaattaattgctgtggatgaactcacagttaagttgccaaacaacacaaccgcacagcgagaaattgtacgcgcccaaccggctgctggtattttggccttaaaagacgacaaggcgctgtttgtcagccagtttcgatcaacaatcggtcagatgacattagagattccagcaggtaaaatcaatcaaggagaagcaccactcacagctgcacgccgggaattaaatgaagaaaccggcatgacggcgatgaagtggcaacctttggcgagttactttcagtcactgggtttttctgatgcaaccatggctttgtttctggccagcgagctgcatttggcaaccaatcaattgcagcaggatccggatgagttcgtcaaaggcgaatggttgacactgccagaagcttggcaagcagtcgatgacggtcgcatctgcgatagcaaaaccttgctggctttactttattggcagcagcaaggaataggagcgtgaaccggcttggtatataagaagtcgtaagtgtgatggtcattttttgacgagtgcaatgatgatccttatccgtaggcttctggcttggcaaacgcgttaaaggagggcaacatggcggaagttaacacgcgcaaagcatatcgtgaggctcaggaaaaagaacaacacgcggcgcgcgcccgcgaggccaaacgagttgaagttgaaaaagactatgctcgcaaatccaaaggcaaacccgaaatcaagaatgcccgttttgacgaagtgaccttcaggaaggtcaacagtctcaaaaaaagattgaattgggccatcgggattgtctttggcttgttggtgattgtttttctggtactctattttgggtaagctagctattcttggcacttaccagaaatggttactgtagcgcaagcgcagtggaagaaagttgattcactcatattatagaagaaagaacggagcgatattttgataaaagtcggcgttatttgtgccatggaagaagaaatcaggaccttactggccaaacagactcagcaacatgaaacggtgattgccagtcaacattattttgagggccaaattgacgggattgatgtgattttgattcagtctggtattggcaaggttcaagcggccatgacggcggctttgttgttgggaacttttaaaccggatgttgtgattaacaccggaagtgccggtggtattggtcaaggtctggcgatcggtgatgttgttatttcgagcggggttgcgtatcatgatgtggatgcaacggcttttggttacttaccagggcagttgccgcaacagccgcaaatttttgaagctggtttagactatgtggctaaaattcaggcggcagccagcacaaccggtttaacgtcaaaggttggcctcattgtgacaggcgacaagtttgttaacggtcaggatgcgattgcggcaattctgaaaatctatccgcaggcgttagcaagcgaaatggaaggggcggctatcggtcaggtggccaaagagttccataccccgtttgttgtcatccgggcaatgagcgatgtcgctgacgagcagtccggagtggattttgacaaatttgtgatcaaggcgggcgaacaaagtgccgcgatgcttcttagcttttttgctcacctacaggcatcacctcagtcttaggagttgattgttaatatgcaacatgtttatcttgataacgcggcgaccacacccatggcccctgaagtgattcagaccatgatggaccaaatggagcacgattttggtaatgccagttcgactcattggtttggccgaacagctcatactgtcatggacaagagtcgcaaagttttggctgatgcaatccatgcgcagcccgggaatatggtgatcaccagcggcgcaacagaaagtaacaatacggcgatcactcaaacggcgcatacgcgcgctagtttggggaagcacatcattacaacggctattgaacatccctccgttttgcagccgctaaaaaccttggaaaaggaaggctttcgggtgacgtatctgccagtcgacgaaaatggccgaatcagtttagctgattttgacgcagctttggacgatgacaccatcttagtgaccatcatgatgggcaataatgaggttggcagtcggatgccaatcagtgaaattggtgcgcgactagtcgatcatcaagcttggtttcatacagatgcaacccaggcttttggcttactagacatcgatgttcaagcgcaacacattgatatgttaagtgtttcggcgcacaaaattaacggacccaaaggtatcggttttctttaccgcgatcctaaggttcagttcccgtctttgttgaaaggcggcgagcaggagttgaaacgtcgtgctggtacagaaaacattgctggcattgccgggtttgcaacggcggttagtctgatcacgtctgatgagaaggctaagcggcagtcaaagtatcttggttttaagcagcagattatgggtgcattggatgatgcggagattccctatgcagttaatggtgatattcggccagataatgtcaatcacgttttcaatatctggttgaaggggatctcaacatacgctttgcaaaccaaccttgatttggctggcattgcagtttctggaggttctgcctgcacagctggttcacttgagccttcacacgttttaactgccatgtttggcgctgatagcccgcggcttggcgagtcgattcgtttgtcatttggcgcgcagacaaccaaagcagatattcaggcctttattgatgccctgttaccaatcgtgcaacggcttcaggcaaaacaatcagcgcgataggtttggtttgcgagtgccccgttaccatgcgtttcaacggttaaaaagctcaaagttgtctttcaccacctaataatccttatcaacctccccagtcttgcgaccaatatgctaaacttataaacagttaagcgtgttcctcgcatgcgctgaaataaaaaaagtttcaccacctttttgctggtgaaactgtttaggggaggtttttgtatggcactagcagcaaccggatccgcacaaggcgatccgaaaacctatcaaatcgggtcagcgttgaaacgatttaccttgatagatttaggctttgttcaaactaagaacggcaattttcaactgcaacgctcgcttgatccaaattcaccgtacacaacggcaaacaagctgaaaatgacggtggcaaagaatttagataagttccagctcgatgtcacaacgggcaatggtcttaaagcgattaacattttcaaaaccgatgccacaaaagaaaatgtcgagcaatatcaatattggatcaataatttgattgagcgcggtgtgattgaagcaaaataggatgtatgccgcgctttaacattaagctgccacgatgtcggcctcagggaggctgacagcttagcagcttttttgctttcttttgattagatcaaaccttacgaagcgatcgtattcacagtaaaaatgtcaatctgtagcaaattggtttttatgattatcagaaacgctaaagtgataagctgaaattaacgaagagaagaaatggagggataatatgtttgaccacggcttcattgaggtccacgatgctaaccaaaataacttgcaacacgtcaacgtaaagattcctaaggatgcgattagtgttttcgttggccgatcaggttcaggcaagtcttctttagtttttgataccattgccgctgagtcccgccgcgaactgaatgagacttttccgagttttacccaacagtatctacctaaatatggtcagccggatgtcggccaaatcgaccatttaccagtggcaattgttgtcgagcagaagcgcattggtaaaaatgcgcggtcaacgcttgccacctatacgggtatttattccttgttgcggttgttgttttcacgagctggcaagccgtttattggctattcggacactttttcttttaacctgccacagggaatgtgcaaaacatgtcagggactcgggtatgtggatgacattgatgttaaaaagttaattgacccgaacaaatcgttgaatcagggcgcgattacgtttgtcagttttggaccagacacgtggcggtggaaacgctacgcttacagtggtttatttgataatgacaaacgattgggcgactatacaaagcaggaaatggacaccttattgtatgccccgcagcaaacactagatcatgcgccaacaaagtggcctaaaacagctttgtacgaaggcgttgtgccgcgaatcaggcggtccattattggtaagaaagaggctgaacatcataagacggcgttggcagaaattgtcacccgtatgccatgtccaacctgccatggaacacgtttgcggccagaggttctgacttgtctcatcaatcaaacgaatattgctcaagtgctgcaaatggatctcgtcaaggttcgccattttctgaatgacattcaagaaccacttgttcaggacgtgatccgtgagctgttacgaaaaatcgattctttgattgacattgggttaggctacctatcccttgatcgaccgactgagacattgtcgggcggtgaaacccagcgcattaaaattgccaagtttttgactagtgccttagtcgatatggtttacattttggatgagcccagtgttggcttgcatccgcatgatattgaattaatcaagcgtgccattttgcgtttgaaggagaaaggcaacactattttaatcgttgaacacaatccggcactgattgcgattggcgataatattgtcgaagtgggtcctggagcggggacaacgggcgggcatatcacctttacaggtacctaccaagcccttttagacagtgacactttgacagggaaactgttgaaacagccattgacttttcgccagccgcggccagccacatcaacgatttcattacagcatattcatcgacataatttaaaagatgttagtgtcgcagtgccgctgggcattgaaactgtgatttccggggtcgctggttccgggaagagtacgttggtatctgctttacgtgatcagttaaccgcaccatatattgatttggcacaagccgatatcggtgctaatatccgctcaacgcctgccacatatctctcaatcctcgatccgattcgcaaagtctttgctgacgcgaatcatgtggctagcagttggtttagttacaacggtcgcggcgcttgcccacgttgtaaaggtaaaggcgtgaccattaccaatatggcgttcatggatccggttgtacagacttgtgaacaatgtcatggacgacgttacaatgatcaggcgctgagctacacttatcatgataaaaatatttctgacgtgctgcgcatgccgattacaaaagcacaaagcttttttgcggatgtaccagctattgccgcacccttgcgaaatatggcacgggttggcctcgactatttaacacttgggcaaccattgaccacactttccggtggcgaaaagcagcgtttaaagttggctgtcgaattgaaccgcaccggtaccttgtacttgcttgatgagccaaccgctggcctacatttgcaagatgtgaaaaagttgattcagctatttgacgaacttgtcgcagatggcaactcgttgatcatcgttgaacacaacttagaggtcattagtcaggcagactggctcattgacatgggtccagacgctggcatctatggtggtcaagtccgctatacggggacacctgaaaatagcatgactgtcaaacaatcacgaacgggccaagccatgaagcaatacaatcaggcgccggaacggcaacaaaataataggcattgacgccaaacttgatttatttgtattgaccgttctgcgtcacgttgcactgaaacaagaatgagctggtgacttgttgtttgcttggatcatcagagaaaaactaaactagcatagaccagaaaatgatggtttgcagttccgcgtaaacagccgccagcctaaatagccaaagcttagctatttggactggcggctgtttatgtctagatcgctactggcaagcttgttatttttggctgaaacgcgttcgccaccccagaagcctgcgtgtaaggaccttggatgcaatggccaaacccgggccatcacacccaaggccacttacacttcggtttctaaccggggtgggtcacgctcttgctgaaacgcgttcgcaggcgcagaaacctgcacataaggacctcaagccaaatggccaaagaccagccatttaggcttgaggctacttatgctccgctttctacccgcgcctgctcacgctctaacagttgctatctcatcattcactgttataatggtttttactggaattcgaccttcaaatcggaaatctccagaatctgatgaaatgatggtgattgttttggacaattccaacatccgtgttgttgtcggcatgtccggcggcgtggactcgagtgtcacggcgctgttgctgaaacaacaaggttatgatgtcgtcggggtctttatgaagaactgggacgacacagacgaaaatggcgtctgtacagcaacaacggactatgaggacgtcgccaaggttgctagtgaaatcggcatcccatattactcgattaactttgagaaggaatattgggatcgggtttttcaatacttcctcgatgagtacaaggctggccgcacaccaaaccctgacgtgatgtgcaacaaggagatcaaatttaaggctttcttggactacgctgatcagctcaacgcggattatattgcgatgggtcactatgcgcaggttaagacagacgaaaacgggatcgtgcacatgcttcgcggcgctgatggcaataaggatcaaacgtactttttgagccagctttcacaggatcagcttaagaagtcgcttttcccaattggtcatttgcagaaacccgaggttcgtaaaatcgccgaggcagcgggactggcaacggcaaagaagaaggactcgactggtatttgctttatcggcgagcgcaatttcaagcagtttttgagcacgtatctgccagctcagccgggcaaaatgatgacggtggatggtgtcgagatgggtacccacgatggcttgatgtattacacaatcggtcaacgccaaggcctcggcataggtggtaactcagataattctgagccatggtttgtggtaggcaaagatttagacaagaacatcttgtatgtcggccaagggtttgacaacccagccttgatggccaccagtttgagcgcttctaaccttaactggacgactggtcaggcaccggcagaaggcacccacatgacggccaagttccgttatcgtcaacgggatactggcgtgacgcttcattatcatgatgatggcaccgccaccgttgactttgacgtgccagtccgcgcaatcacaccgggtcaggcggttgtcttttatgacggcgacgagtgcttgggtggcggaaccatagatgctgcatacgcacacacgaatgagttacagtacgtttaattaaactgagtgcaaaaagaaagtcggcgattatgtcggcttttttacatagcggcggctgattgctgcttgaaacgcgttcgcaggcgcagaaacctgcacataaggaccttgaccgcaatggccaaacccgggccatcacgttcaaggccgcttatgctccggtttctaaccgcgcctgctcacgctctgcttgaaattttccttcaaaatctcgataatgaaagagttaagatgcgaaaggatagtacggtcattgattgggacttttgaatcattggctgtgactaaaggggattgacttgtgacgaagttgtattttgtacgtcatggcaaaacagaatggaataatcagggacgttatcaaggagctaatggggactcgccgttattaccggagagttatgcgcaaattaaggcgttggccggttatttgcaaggaattccttttatgcatgcttatgtcagtccattaaagcgtgcacgaacaactgcccaagccttgattaaagatttggatgagtcaattccgttgaccattatgccggctttgcgggagttcaatctcggtaaaatggaagggatgacgtttactgatgtaggtaagcattttcctcaggagctgcatgcctttcgtcatgaaccggcagcctatgatccacgaaaaatacatggggaatctttttcacaactgattaatcgggctattccggcgatcgtggcgactctggccatggatcgcactggtgaggctaatttgctgtacgtcagccacggggccgcactcgctgcggtgattcaaagtctgttgggcacgccactggcggatattcgcaaagacggaggtttgaccaatagcagtgtgaccattttgcacgcagatggaccgaccttgccgtttaccttgctggattggaatgaaaccagtttcttaccggaaccgccaaaagcaacggatacgatttgagttgctacggctgtcaacaacgagataagagggtcaaatggattcaaaaattttaaccatgttcaaccatggcaagcatgaggaggcgattcaagcggcagtcaaagccattgatgctgcccctgatgatccgaaacgctatgcgatgttggcaacaatgctgattagtatcaaagcgctggatcaggccggtgaattgctggccaaagcgcgccagctttttccagaggatctggaattgcaatacaccgctggcttgtttgcctatgctcaagcggactttgcggctgcagtttcatggtttgccaaggttagaaccgaccagactttgaaaaatgatgctacctacatgttggctttaagctaccaacaagctggccagccaacgaaggcattggcgtttgcattaacggcgcatgacttggcgccaaagcagctcgatgccgcccttttagcagctgatttgctgatggcaaacgatgtgtttgacgcagcagcccgagtgttgaaaccattgttggcaaccgaacagccacaggttctgttcacgtacggcatggcactgagcgccgctggtaaagatggcagtcattatttgaacaaggccaaggcacttgatccaaaagggtatgatcaaaaagctaacattgtcgctgatatcaaccgattcttgcgattgcaggaggggcaagatggacacgcgtgaggagactgtcactggtcgggtcaaaagtatctttttccagaatccaacaaacttttttaaaattcttctgatcgaaatctctgcgacgactatcacctggacagagtcagatattgtggtgacgggaacgtttggtgatattaaggaagatgcgacctacacgttcactgggcatgtcgtggatcatcctaagtatgggcagcagtttcaagcagacaattaccatgcggatcagccgacgaataaaagtgggctggtcgattatttgagttcggataagttcccggggatcggtccgaaaacggcaacgaaaattatcgatcatttgggtatggatgctattgacaagattctggatgatccgaaggttttggcgggcttaggcatgacagctgccaagcgtgatatgttggcgacgaatctgaaatcgaaccaaagcatggaacgggttattattggtcttaacgattacggctttactagcaatatggcaggtcgtatttaccaacaatatcaaaatgacgccttagatgtgattaagcacaatccgtatcaattgattaacgatattgatggtatcggctttactcgggctgatcagattgcggcaaaattggcgattgccccgacttcgcagcttcgtcttggcggtgcagtgatggataccctgcagcggttgactgatggcgaaggtgatacctatgtgacgctgaagtcattggtcactcagacacttgatttattggaacgggcgagaaacgttgccgtttcgccagacgcagtaggacaggcaattgtgacgctggctaaagacaatgccctgattgcagaaggcgaccgcattttcccgaaacgattatatgatgctgagtggcagattggtcggcaactaaaaggactggcagaggcagacgcaacggctactgaacctgaattggctgagattgaaaaaacgttagcggcggtcgaggcggataccggtattgcgtatgatgcgacacaaagaaaagccattgtcacggcgttacagtcgcccatttttctgttgactggaggaccgggtactgggaaaaccacagtaacagatggtatcgtgcggacgtatgcacggttgcatgacctttcattggatcttgatcagtatacgactgacgagccatttccaatcatgctggcagcgccaacaggacgggcagcgaaacggattagtgaaaccacccaactgccagccagtacgattcatcgcctgctcggtttaggtgttgacacgcaagaatttgcacctaatgagttaccaaatggcctgttgattattgatgagatgtcaatggttgacacttacttgttccggacgcttttaacggcattacatcccggaatgaaaattgtcttggttggcgataaagaccagttaccaagtgtcggtcctggacaagtattcgctgatttattgcgcagcggcgtgctgccgcaaacagcgctgacgcatattcatcgtcaggatgccgacagttcaattattccgctagcgcatgcagtgaatgctggcaagttgccggatgattttaccaagccgcaagttgatcgcagttttttggcgtgtgcgcctagtcaggtacctgaagttgtcggacaagtggtgcaacgagccgcagtcaaacaattctcgatcgcggatattcaagtgttggcacctatgtaccgcggaaccgctggcattgatcgtttgaatccgttactgcaaaacattttgaatccaaaacgcagtgcccgaacgaaagcaattcagtttggagaaacggaatatcgaattggtgataaggtgttgcaactggtcaatgatcccaaccaaaatgtttttaacggtgaaatcggtcagattgtcggcattactttgggcaaggaagccgaaagcaagacagacgaattaacgatagattttgacggcaatgaaatcacttgcaaacgcagtgattttaataagattacgcttgcttatgccacttcgattcataaagcccaaggcagtgagttcccgatggtgattttgccgctaaccttgcaaagtcgccggatgttgcgacgtaacttgttgtacaccgccattacgcgggctaaatcatttttgattttggttggcgaactggcagcctttcaggaagcggtcagtgaagtagccgttaatcgacatactgggctggtcgatcggctcatgaccgtatttggcaaaaccgttgcccctcaggttgctgatgcttcagcaaccaaggatatttcagcaagtcccagtgagccgcaaattgacacaactgcacttgacttggataatgaagttaaacaacaaccaccggcagcgcaccaattaacgcctgccttggtggcttctcaacgaatcgatcccatgattgggatggatggtatcactccgcaaatgtttatgacgaaggagaattaactagctatggaggacaacatacgcaagtcactggtgattaagccagtgacgcctcaggatctcgagcagttcaacgatctattaacttatgtgtttcaagtgactcaaaaggacttggaacaatccggttatgaggaaggggagttagaacgagctaagcgtccagttttagagaaatcggatgttttgggctggtttcacaaagatgagcttgtcagttcactggccatttatccttgcacagtgaatattcacggcacattatacaaaatggctggtttgacaggggttggcacgtatccagagtatgccggccacggtttgatgcacgatcttgtccgacttggcttgcagcatatgcgtgaccacaagcagtggatttcgtatttatatccttacagcatccctttttaccgaaaaaagggatgggaaatcatgtccgatcatctcacctttgacgtgaaagacacacaattacctaaacaggtgaatgtgcccggacatgttgagcgtctggaaatcgatgatcctgatgtgattgaaacgtataatcgcttcgccatgaaaaatcatggggcgatgatccgcaaccagttgaattgggacgaatactggcgttgggaaaacgaggaggagcgtacggctggtgtttattatgacgccaacgatgaaccacaaggctatgttctttattggattgccgacgaggttttccacgtcaaggaaatgatttacaccaaccaagaagcccgagtcggcttatggaactttataagtgctcatttttcaatggtgacgcacgttaaaggtaacatttacaaaaatgaaccgttgcactttttgttagatgatggtgatatctatcagacgatcaaaccatactttatggcccggattgtggatgtgaaggcttttctgaagcagtatccgtttgcggctgaaacgcctgagtcgtttcattttgtcgtaactgatcctttggcgccgtggaacaatgggacctttggggtttattgggacgaaaaaaatcaaattcaaattactgatcgaccggtgggtgaagagataaaaacagatatccaaaccctaacaaccatgttgatgagttatcggcggccatcgtatttggcccagattgaacgactttttgctagtaagcatgcgattaagttgctggaaaatgccattccaatggaagaaccttatttttcagattatttttgatcgtcatgttcaatcacagaaaaagcgctgcacctaccagaagaaaactggcggtacagcgctttttgatcggtttaaatactgcgatcaatccaaaatttttgtttggccattgagaagtcgatttcaaacggccgtgttcccatttcctcgccatccatctgaccaaactcgagcgaactggtctcaactgttaacttgtctgcgtggaaaatgtgagtagcccgacttgtcggttttttaccacgcatgagttgaatcatcgccaacgcccatgagacgatattaaaccattcaacaatcacgagatcaagtttcccgtcggttgggttagccggtttgtaaagacgaatgccgccgccaaaataaggaatgttggtggtggtgcagatataggcgcggtgaaaaaaatggcgaacgcctttttcatagacggcaaccgggaagggacggcgagtcatcagcataccgacaacatgaaataagtaggtgagtttaccaagatgcagcctattgagcaattgcttactatcactgcggttagcagcgttaacaacggcagcgtcaaatccaataccgatattattcacgaaatagccactttcgccgcgggtgcgttcatgaaatcgcccgatatcaatcgtgaccgcttctgtagcctgtaatacttgttccagcgcatgcatcggatcttcagacataccgataccgcgggcgaaatcattacccgatccggctggtacgtaagcaacaggaatctctgactggcgtgtgccagctaacccattgatcgcttgattcaaggtgccatccccgccaatgactaacaaaaccggatgctcacgtcgattgaaatcaccaatttgctttgtgattacgttggtatgtccgggatagcgggaagttttgatggcataagccaaatgacgctgatccaaaacggccttcacttgtttataaattggaatcgacgaaccaccgccagccgccggattatagataatataataaaaaacagccgtcatcagctttcctcctaatagacacgcactcaattataccgaaaataaggcgaaaaacaatggaacagtgacgaccttattgtcatcaaacgaacattttttgaagaggcagatgactacaaaccagcaaagtgtcggtccagcacctagcaaggcgataataggattttaatcatgatttttggcaataaatgctaataaaaaagccactcgacaagcacctaagtggttgtcgcgtgactgttaatcattttcagttaatgagtgacgttgccagctatctgaccggaatttaaagcaaaatcagcatcggtaaaataaccgggtgtcgttctgttttgtcgaacaaaaattcttgcaagttgctggtgattgcatcttttaagctagcttccgtcaccttttcactgcttgagaaggttgacttaatggtgcgatagacgcgccgctgagcctgattaatcaactcgccggattcacgcatatagatgaagccgcgagaaagcagatcaggaccagctaagaccgcttgtttttgcatattgatcgtggcaatgaccacaaccaagccttcctcagacaacatgcgccgatcgcgaatgacagcattaccgatgtcgccgacaccattaccatcaatgtaaacatcgccagcagggaagtgacctgcaattctagcactatcttgcgtaagggctaatacatcgccattttccataatgtagcaattcttttcagggacgccgcattgttgggcaagttcgcaatgaatcttttgcatccggtattcaccatggcaagccataaagaattttggcttgattagccgcaacataagcttctgatcttcttgaccgccatgaccggaagtgtggacattgttgaccttgccatggatgacctcggcaccagcttcacttagctgattgatcacgtgattaacactgacagtattgccgggaatcggattactggagaagatgacggtatccccaggttgaatactgatttgtcgatgcgtaccattagcaattcggctcagcgctgccattggttcgccttgtgaaccggtacagaggatcatcactttatcagctggcatcgaattaagttgatgggcatcaatcaagacgtcatcagggatgttaaggtagccaagttcgcggccattgaccatcgcagtttccattgaacggccaaaaacagcaattttacgaccgtgtgccattgccgcatcagctgcttgggcgatccgtgaaatgtttgacgcaaaggtggcaaatatgatgcgaccatcaattcgatcaaaaatgtggcgaattgacttgccaacaaatcgttctgacttagtaaatgtcggtacttccgcgttggttgaatccgacatcagtaccagcacgccttcttcggcgaaccggcacattttttggaagttaggggatggctgatcgccaacgggcgtgagatcaaacttgaagtccccggtttgaatgacgatgccttgcggtgtatgaaccgcgatgcccagcgtatccggaatactgtgggtcgtgcggaagaactcaacactaagttttttgaacttcaacacggtgtcttcgttaatttcagttaatttggtagtgcgtaacaaaccgtgttcttcaagtttgccacgaatcaaagctgctgctaacggaccagcgtaaattggcacattcggtacctgctgtaagaagtagggaataccaccaatatgatcttcatgtccgtgagtaataaccagtgctttgatcttgtctttgttttgaaccaagtaggaataatcggaaatgacataatcaatcccaagcagatcatcttcagggaacttgatccctgcatcaatcacgatgatttcatcttggaattgaaccccgtacatgttcttcccaatttcacctaaaccgccgacagcaaagacggcggtttcgttattcttaatatttaatttcatataattagaaagttgtcagcttaaagttggctgacttttcctcgtattccaggaagtttccggataattcctggatgaattcaatattataaggcgtgttcttttcaacaagcgcacgcgcttcaaccgcagatggcgcctcgaggtaaagcgtctgggttgtttcccgtcgtggattttgaatcttgtctttctgatataagactttgtagatcatgatggactccttccgtggtacaaaaagaaaggaagtgcaacaaaacggcttccgaaaaaaaggacataccatcaagatggaaaaccacaacagacatggtctatcttattgggatggccgatatttctcgtcgttcgaacccgaaaacaggcatacctgcgctatttcgtcgttctatttctgtcacaactcctaaatactttatgaccgatcgatttgttgtgaaaacaacagctagcaacagtctatcatatttgaaacggtgtgaacagaccagagcgtaaaccagcccggttagaaaaaccggagtgtaagtgctcctcaacgtgatgtccggattgaggccattgcgttcaaggttgttatacgtaggtttctgaactggcgaccgcggttatgcggcaattgtaaggtctatcctttggtgctaatgcggctggcacactgatcctagtactctcttaggaatcaaaccagatgatgctcacgagtttatgaccagctattattgtcaaactaaccttcgattgcaagaatcacattggcgatagcgtggttgttctgggtataataaaggtaagaatcaataacatattggcttttgaagggagtggacgttgtggtctggcttatcgttgttctagttctgatcgtgctcatcgttttgtgggtgctcaggaagcgccggcggcgtaataaagcaatccaaattgtgcttcatcatagccagcgactaagtgatcaggtcatggatgctgctttaacatcacttaaaatccctgtccaagaacctttgacttcaaaaccaattacggacatttggggtcatggtgtgatggcgttctcctatattttccccaagagcttttccaccattgatcagcatcaattagccgacgctttgcaaaaagcggctgaagaattggatattgccagttccgatccggcattaccgccttttgtgatcacggattattttgaactagaagggcagcaacatgttgatctcgcttttattgctaatgaggctaccatagaatatgtccgcgatgtgaatcgcgttgcttaattttaaaaagtgtcgaatggaggggttcaagtgaacgatgatcaggatttattgatgcgtcagatcaaaagttttgcccaaggattaggcgctgcgatgagtaagaaagatcgacgcccagatgatccagtcgtcgttttccacgatgcggaagtcagcttggccagctatcaagcaaaactgataaccgaagtgaaggaaaatggcttttcggcagctaaagcacttttgacaacatggcgggacacccgcttatcgcgacgacagtacgaagacttaacggcatggttgcagggacaacgatttgtgtataaagaatcgtaagttgggtgaaaaatagtttcaaaaaaagaaggctttaagccttctttttagtacaagcgtattttacttgataatgacggcatccgggtcgatggtgaaaggatgttccttattaatatgatcgtaaaacaggacgccatttaagtgatcgatttcgtgctggcaaacgatagccggatagttcttcagacgaatctttttatgttcaccggcttcattttgataactgatggtaatccggtcagcccggacgacatacccgggaacatctttatcaacggataggcaaccttcgccttcagccaaagcagcatgttgaacgctgttgctgatgatccgcggattaatcaaaacttccttaaagaggatttcattatcgtcaccgggaaccaaaacagcagccatcgccttgctttgcccaacttgtggcgcagctagtccaacgccaggacgcaaatgatacttttcgttttgttcttcatcttggctgatgaccaagtaagccatcatatcatgcgccagttgcttgtcctcgtcagaaagtgggaacgtgactggctttgccgtttcacgcaggaccttggccccatcgcgcgtgatatccttcatcaaatacacaatctgtacctccgttcatttcttctactagattagcacaggaccagaaggctgaaaagcttcgcgtgcaagaggtttgccttaaatgctgcaatagcagaaactttttctgtgtctgggtgataagcaagaaagaaactatttttgaagctttgctcattttcaaggaattcacgctatttcgattcccgtattgtcaatctaagtgcaacagtttctagtccaatcctataagtggtaccaaaagtcatcactttttatttcttaaagtgacaacttttaaggctattgtacggcattacgcggttacgtttttatctgaaggatgaacagttaccggatgatgacaccgttagaaatattcctggtgtgattgatgttgcgcatggcaatggtcagtatcaggtcgtcattgggcaagcggtcactgacgtttatgatgaagcaattaaacaattgggtcccggttatgctaacgcggaaggaactgcgcaagcaatccaggagactcagcaagaagctcaagataccagtgcaatgggccgaatcaaacacgggctgcaggcactaattgggacaatcacaggctcgatgattccgattattgggcttttggctgccagcgggatgttaaaagggattttgctcggcttaacaaaatggggcggtttatcaacgactaatccgacctatgaaattattaacgcgatgggcgacgcaaccttctactttctaccgatacttgttggcttcaccgcggcacaaaaacttggctctgatccggtgattgttggtattatcggcgcgttcctgatctatccttctattgcgcaaatcgccacagcaggtaaagtcagcggcacattgctaggcatgagtattaatgccaacttcttcggtttgccagtgcacattgccaattacacgtattctatttttccaatgatctttgcggcgtggatggcggcgaagctcgaaccgtggatcaagagttggatgccattggtgcttagaatgatcttcagtccgttggttgaaatcttcttggttgggatgactgttgttctggttgtcggaccattactcactgtggcatcaggcgctttgacatcagggattcaagcattgctgaatttgaccccaatgatttcaggtgccatcattgccggtctctatcaggtgctggttatcttcgggctgcactgggcggtcattccgattatcgccgcacaattatcatcggcacatcctgaatcaattctgaacgggattgtctcgatctccatgatcgcacaaggtgccggtgcgttggcagtttgggtgaagacaaaacacaatccagccctgaaaggtttgtcgctttcagcttttatcagtgcctgttgcgggattaccgaaccagccatgtacggggttaacctgaagtatggccgggtcttcatctttgcaagtatcggcgctgcaatcggcggtctggtcaatgggctgcttggggttaacatgttcggcttcaccggtagcttcatcgggttcttctcgtttgatgcgccggcttgggcaaacagtcccaataacttaatgaatttttggattgcttccattgtgacgcttgtggctgccttcctactggtttacttctttggttataaagatgctgacgccaatcaagcaaaaacggcgccaaagaaaaagcgtttaggcaaaacagttgaataatggcgtgttcaccaacacttacggtttccatgtgtgcgtgagcggcaacaattgattaaaaaagcacgatgtcagcggacatcgtgcttttttcgatttcaaggcatgccgaagagcaaggtgctcgtatgacgatacatggtactaacgcttagttaaaaatgagcaaatcatggcaatggtggataagcgcttttaattaagcgtgttattcaatcttcctgtctttgctttaaaaagtgatcctatttgaattaaattgcttgcagttgttgtaaaaataaggcaaactaagaagtgctctcatggaaagttaattttagatgaaggaggggccaaaatgtataaacggtacaaagatgtttcgttgatcttaaaaattgtcattgggatcattgttggggcagtgttaggggtaatggtgccctcctggtcctttattgatgttctcggtaaattattcgttggcgctttaaaagcgattgcgccactactggtctttctattaattatgtcggcgatctctaagtatcgctcaggtgcgaagaaccactttggcaccgtcattgtgctttatctcagtgccacgttgttttcatcaattgctgccgtggcggtttcgtatctttttccgatcaaattggtgttgcccggtgcgatgaagatcgccgaaagtgcaccgaaagatctggggactgttgtgacgagcttactaaccaatgccgttgccaatccaatctctgcattggttgaaggtaattacctagctattcttttctggtccttactgatcggttccggtttacgattgaccagtgctgtgaccaaaaaggtggtcacggaattggccgatactgtcagcgctgtcgctcaaaatgtcattcagttcgcaccgtttgggattgtcgggttgttacacgagtccttgagtaaaactggtgtcaaaggggtcatggcatatggtcagctgctcatgctgctggttgccacgatggtatttgtttacttagtcgtgtacccattcatggtttggttgatgacccggcaaaatccgtatccgttgactttttggacgctgaaagtcagtggcattccggcattctttacaagaagcggcgctgtcaatattcccatcaacttgaaggcatcaaaagatctcggattaaatgaagaaagttatgcgatctcaattccgcttggtggctcggcaaattctggtggcgcagcgattacagtgtcgatcatgacgttggcaaccgccaataccatgggtgtacatgtcagcattttcctagccttgttgctatgtttcttgtctgccatctcggctaccggggtttccgggatcgcaggtggctcactgttgttaattccaatggcggcttcattgtttggcatttcaaatgatattgccatgcaggttgtcggtattggttttatcatcggcgtggttcaagattcagttgaaacggctgttaactccgcgtctgacttgctgttcaccgcgactgccgagtatgccgacgatcgccgtgaaggacatccggttgatattcgagctaaggtcaaagcggcaggcaagggaacggcagaagttgtcacacctgaaaaggctaatgaagctgaagaaagtgaacaagtttagttcagtcaaaagaatcgcgaattttcgcgattctttttatgtccagctaatttgagacaaaatgataacgagtgtttttgaattcacatcagacaataacgaatgtctttaaactcacagcgctttccagccaagctgaaatgtgctaacctatttctcatacgttttttaaatatgtgagagactgactgcttgatgagcagtgccatggaggttaccgatggggcaagtttggcaacgattgattagaaaagaagatccaagtgtttatgaagataaggattcacatttaccgcgcgttttacgcgtccgcgattttcttgcgttaggggtcgggacgattgtgtcggcttcgatttttacattaccaggggtggtggcggcaaaacatgctggtcccgctgtgtcgatttctttcttagtagccgcgatagtcgcagggctggttgcgtttgcctacgcggaaatgtcagcggcgatgccatttgccggttcggcttattcttggatcaatgttgttttcggcgaattttttggctggattgccggctgggctttattggctgaatactttatcgcagtggcgtttgtggcgtcaggactttcagctaatttccgcgggctgctggcaaccattggcgtgaattttcctaaagccttggcgaatccggttgggaccgatggtggcatggtcgatctcgttgcagtggtcgtcatggtgctggtcggcttgttactgtcgcggggggtatcaagtgctgcgcgcgttgaaaacatcttggttgtcatgaaggtgctggcaatcctgcttttcttggtggtcggcttgactgcgattcaccctgaaaacttccatccattctttcctgcttatcatctcaatgctgacggtacaccatttggtggttggcaggggatctatgccggagtttcaatgattttccttgcttatattggctttgattccatcgctgctaattctgcggaagccattgacccagagaaaacgatgccgcgcggtattctgggttcgttactgattgcagtgttcttgttcgtttcggttggtcttgtgttgttaggtatgttcccatatcaggattatgccaataacgcggagcccgttggctgggcattgcgtcattctggccatgcagtcattgccgttgtggttgaaagcattgcggtcttaggaatgttcacggctttgatcgggatgtccatggctgggtcgcgcttgctttacagttttggccgtgatggcatgctgccgcaaaaactgggtaagctgaacagtcgtaagctgcctaatcatgccttggctgttttgattaccatcggcgttttgatcggcgctttcttcccgtttgcctttttggcccaactgatttcggctggcaccttgatagcctttatgttcgtgacactgggaatctatcgattgcgtccgcgtgaaggccaagatatcgccaaaccgcgcttccggatgccactgtatccagttttgccagcagttgcctttctgggatcacttatcgttttccttgggctcgacattcaagccaaactgtattccggtgtctggttcctgatcggctgtgccatttacttcctgtacggcatgcgtcactcggctctgacaaagggatcagcggttgagcaagaaactgcagcgttaggacaagaaaaagattaaaaaagccgctgcctgagattgcccgcgttgtgacgcgcggtctcggacagcagttttttggtacggtggcttagtgatactcgtctggagagacaccgttaagctgagcgcttaacctgacgagcctaagcttcttgagccttcttcagattttctttcaaaatagctgcagaatcggctaaacgcttatgatcttctgggttcaaatccagctcaatgatgcgttccaagccattagcgccgaggattaccggtacaccgatggagaaacacctgacaagccgtattcgccttccaaatggacggacattgcgaatgctgcgcgatcatcattcaagaaggcgctggttaaacgggttaatgaggcagcaatgcagtaaaaagtggcaccttttttctcaatgatgccataagcagccgttttgacgcgttcgctaatatcaggcagatctgtatcctggcgatctttaggaatccaatcaagaatcggtttgccgccaatgttggtgtagtcccaaactggaaattcagaatcgccgtgttcacccatgatgtagccgtgcacaatccgggcgtccacgttataacgcaggccgatctcagaccgtaagcgagctgaatcaagcgccgtccctgatcccagcacctgattacgtgccaagccggattcttgcaagactaattcggcaaggacatcgactggattggatgcgactagaataaacccattgaacccgcttgccataatgttatgtgtgatttctttcatgatctttgcgttgatggccaaaagttgtaggcgtgtctgacctggcttttgggcaattccggctgtgatgacgataatatcggcatatttgcaatcttcatagctggccgcataaatattcttctgtgacgtataaggtagggcatcagaaagatcttcgacgtcaccttgcacgcgtttttcgttaacatcaataataccaagactctggccgacgccggtggtgagacagttgaacgcataacttgatccaatcgcgccatcaccaattaaaataatattgccgttgttccgcatctcaaattcctcctcatgaagatcttgacgacaggtacccaaaactgcgacaaacgactatgagtgagcagtcatgaagccgattacgacgcgccataaaatcgattgccgccaaagctgttgcatgtatccgatttcattgtaacagaggtctgcatgcagggcttgataaacgactgggaatatttttaatatcaagataactatcttatcaaactgccatctttctgttagtcttgaaacaacgcttgtcacattttcttccagaaaggtggttcctcatgtcagcagcatcttacgtacagtccattctcacaaccctcaaacaacgcgatccgaaccaaccagaattttttgaagcagcatcagcttttttaaaaaccatcacaccggttctcgaaaaacatcctgaatatatgaaagctaatattctcggacgcatcgttgaaccagaacgagcgattcaatttgccataccgtggcaggacgataaaggccaaatccagatcaatcgcggcttccgcgtccaatttaattcggcaatcggaccatacaaaggcggtttgcgcctgcatccttccgtgaatttgagcatcgtcaagttcttgggctttgaacaaatctttaaaaacagtctgacgacattgccgatcggtggggcgaaaggcggcgccgattttgatccgaaaggtaagtcagatgctgaagtggtgcgtttctgccaaagctttatgacggaactcagtaagtatatcggaccggacttagatgtgccggcgggcgatattggcgtgggtgcgcgcgagatcggttatctttatggtcagtacaagcggcttaaaggcgcacaacgcggcgttctgactggcaagggggtgagttatggcggatcgctggcgcggacagaggcgaccggctatggcttgatttactatacagacgagttattgaaggccaacggtgaatctttggctggcaagcgggcggtgatttcaggcgccgggaatgtcgccatttacgccacgcagaaagctgaggagcttggggtcaaggtgatcacggtttctgattcaaacggctatatcgtagacgaaaatggtattgatgtcgcggtcgttaagcagattaaggaagtggaacgtgggcgcataaaagcttacgcagatcgggttgctgactcccattattatgaaggctcggtttgggacgcagatcttcagtatgatttagctctgccttgcgctacccaaaatgagattgatggcactcaggctgcgcgttttaaggctgctggcgtcatcgcggtggcagaaggtgcaaatatgccgagtgacccagaggccatcactgcctacactgatgctggtattttgtacggcccggcaaaagcggccaatgctggcagggtagccgtttccgcactcgagatgagtcaaaattcgcggcgcctcagtgacagttttgaaaaagttgatggccaactgcatgacatcatgcagcatatttttaaagctagcgcggatgctgccgctgaatatggtatggccggtgattatgaggccggcgccaatattgccggctttctgaaagtggctgacgcgatgtattatcaaggcatgtaggtatatttagacattaattagaaaaaaacacgaaataattaggtgtttttttccgaacgtgttatactctgtacatggtaatacttgaacgggaaacatcatgttacgtgaatttcctttttaggattacggttgtctgttgttgttagttttgaaaaggagattcattttcatgcaaaaaggtacagttaaatggttcaacgctgataagggttacggcttcatcactggtgaagacggccaagacgtctttgtacatttcagcgccatcaatggcgaaggctacaagagtcttgacgaaggtcaggctgtttcctacgatgtagaacaatctgatcgtggccctcaggctactaacgttaccaagctttaattcttggttcgttaaaggagatccaatcgggaaaccgattgggtcttttttatgagcgcaaacaggagcacctatattcaggcttttgcgactgcgacagcattattacggcgctggtccttgtagtaagtccaagtcacctgatttcattctaggcaggctctcacgcttgctgcttcaaggttaattgccacgcgctaacaagcacccaacaagcaaacggcatcgcagcgacaaacaagcctatgaagattaatcctggtgcatcgccgctttcggcccatagatagctgaaggttaagctgatgatcgcaatgatgatggttatgccgcctaggagccattgcaagcgacgaacgccgcgggtgaccttctgcggtgaacggatgatttgccacaaggtgtgatggcgctggcggcgatcccgccaagtacaagccagccgccaagcaggacgagaattaatgaaacagttggttggacggttagcagcagtaaaatcgttgcccataaaccgatagcaaggaaaaccacactgcccagtagcaggctaagtgccaaaacaagatgatgtttgcggacccacaaagatgattttgacattttaataacctccaattagtccatacgctagcgcattgttgcgttcaatagtcgagtgaccgcgcttcttgacgaaaaaacaaagaaggtatcagcctaaacgccggtaccttctttattatctttgagaaaaagtcgtggcgctgatgacttactcgcctagcgttggctcgtctgtgaaatcatcaacgatgcggaagctgacattttcattttctttcaaaagtttggcaactgggcattcgtccagtgcctgagtgacaatcttttgtgcttcttcgcgggtgtggctcggcatcaagatttgtgcgtctacgatgaatttgtagccaatcttgtcacgggtgatgtctacacgagtacggagctgggaatcttcagcagtgccttcgcgatgctgcacgatgcggatggtcgcattaaaacaggtagacaaggcaaaagcaatgaactgctccgggttggtcccaggggcgtcaatcaaggagctagaaacacctaacgccaagccttgattaccttcgacataactttcagcgactaaaccattttcgttgcggacataggtatgatacaaagaacgttctgccatgctattcatcctttcttatagctatcaccgtgagtataacatggaaccgctttacatgggggcattgtgtctcggttgcaacgcctgaatcgctacgtaccaaggcgttttggaacggataacaaacattttcaatgggttttgttttgccacaaaaactaagcagttatcgctagtgtcgccataaaagctcagtcagtcatggttgcaggcgaatgatttttgtcgcaacttgctcgataaaatgctcatcgtgctcgacaaaaagcatcgtcggttgataatgcttgatggcggcgaccagctggtcttggttgtaagtgtccaaataattgagcggctcgtcccaaatgtacaaagctcccggggtggctagggatcgcgctagttcgacttttttctgttggcccatgctcagatgctcaatcgacgtgttaaagtcggctcgcggcatgccgagtttgcgcaagttgttaagcaaggtttcacggctaagctggtgctgtttggcaaagtcgactaatgtaccgcggttatcggtgtattgttggcgaacaagactaagactgacgggggccaaggtgaggtgtcctgattgcatcccggtaaattgcttcaacaaggcacggatcaaggtcgacttgccgctgccattgtcaccaacaatggcaatccgatcgccgcgggtcaaagtaaaagagatcggctggaaaagcggttgatcgaacccgacttggaccttttcagcgacgacaagttgatggtgatgggtcgatactggcagcatggtgagtggatcaaccttttctaggttcttcagaagactttccttctcatcgatttctttagtcatccggtgttcgagatttttactttttttcatcgtccgtgcagctcgagcgctaataaacccgcgaccagcattatgaccactgtccttgatgtgcggattaccatagatactcttttctttattttccgcccaaacttttttatcatgagccgttcgtttaagtcgggtaatttcagttttaagttgaccatttttggccagttcagtttggtcttgccgttctttttcggtcatgaaggtggagaaattgccttgatagagggtaatttgctgccgctggattgctagcgtgtggtcggtgatgctgtccaaaaaatcacgatcatggctgacgacaataaagccgggtttttgttggagataggcggcgacttgtcggcggctgcgcaggtcgaggtgattggttggctcgtcaatgagtgcgaaaccattgtcttgaatgaacagtaaggcgagacgcacttttgtttgctcaccaccagataaatcgacaaatgggcgccagagaatgttaggatcagcgtgaagcagatttagttcacgttcgagttgccattgcgcaacatcggtgatggcttgtgcggcagtcagcgtcagttgggtttcatccagcgtttgaggaaaatattgcaactgcaagggaacagtcaccgtgccactgtatgggagtgcttgttgtaaaattcgcaacaaagtggttttgcctcggccgttgcgaccgaccaatccgagatgccagttggtatcaaggtcaaaggttgtgttcgtaaaaagcggtgcttgaccgtcataagcaaaattgagctgtttaatttgaatcgtagacatacagccacgtcctttcggggatgtgcctgcgtgatcagaacgtgaatcggtatgactttttatggctgaaaagtgttgaaagtttgcggcatcagccttgctattgggttatttggcagcataactgcgctggcttgtatgcaacaaaaaagccagtccaataacactttgggactgaccaaaataaacgggggtgccgtccttgatcaagcccaattgtcaaaaagtccgtactaatcccgttgatgatgacaggacttggacattttcaacaattggcttacttcaatggacgaaacctccctttcgaatttaacttagctttaaattaccacgtgaagccactgtcgtcaaacatgttatgctttcacaattgcctcatcaccgcttgcaatcttcactgtgtctcgatggcgattgctgtctaaggctgctactaggacgtcagcaacatctgcgcgtggaatggttgatggtcgttgcggttgcaaggtgatactgccttgtgcaggatcgttggtgagcgcggttggctggacgatgacgtaatccagatccgtgttgtgaatgagccattcgtcagcgtagtacttggcgatgtaataatcgtgcaactggtctggccatttgtccggatcttcagcatcaagggcgctgagcatgatgaatcgactaatatcagcgcgttcagcagctttcatcgttttgacagcaccatctagatcaacgccaagaagatcttgaccgcgggagcctgctgcgaagacaatcgcgtcatgaccagcatcaaggtcagctaagcgatcaaccggccatgaaagatcgagttccacggcgcgaaagtttttctcgggatcaggtgtctgagcgattggatcacgataaccgcctgtaactgtatcaccacgatcaagcagtttgtggaccagcaactggccgatttggccgtgggcaccgacaacaaagattttcaaagcaaatatcctttcatggaaaatgattgctattagtataacgttttttatgacagcaagaaagcagttgcaggcaggaatgctaaaaagtttagtgcggtgagcttctagaataacccggttacagtcgcagaaacccatgcatcagggatttaaagcagttctgtctgcggccataaaaaaacgcggctgcttgcatcaaccgcgctgttgccatcgttaaatcatttcaagtggaatatgatgccgcggggctgggaaagcttgatcgaacaacgccaattcgtctggtgaaaaagtaacatccgccgcggcgatattttccgccatgtggcttgcttcacctgaacgagggatcgtgagcacatcgccatgacgcagcacccatgcgagcatcagttgatgggttgaaatgtttttctctttggccaaagttcttagttccggtggcagtttaattgacttgccactgcctgacccaaatggcgagtaaccaattgtggtaatgttggcctgcttttgctgtggcagcagatcatattcaataccgcgcgattgtaagttataaagcacttcattagccgcaatttggtcgccgcccggttccagcgttaattgatccatgtcatcaacgtcaaagttcgacacaccatattgcttaattaaaccttctttttgcaaatcctgcaggccttcgagagtttctgctaacggggttgacccgcgccagtgaagcagatataggtcgagataatcagttcgcaatcgtttaagactattttttagggctgttcgcatctgtcgcttgtctgcgtgtgacggatagaactttgagatcagatagatgttggcgcgatcataatcaccaagaaaactgccaatcagtgactcagccgccccgttgccatacatctccgcggtatcaatcacggtcaaaccatgattcagtccatactttaaggcagcagcttcctgttcactttgtgctgcattgccttcgcctaagtaccaagtacccatacccatgatcggaacattgacgccaccaatcttgattgttttcatgatccgactcctttctttcaacacatctattatacaagttgtgaaaaaatgaccgctttaaatagagcctgtgaaagaagataaaaaaagcccgcgtttacaatctaagtgcaacacataattaaatagaccaaaaaggccatgataggatcaatagctggttagatggtcatctctcacactgtttgcaccagatccaaaattagttatggaggagtcactggtgttgctgacggttagatatactttttcgaagtttactttaagacactcacacacatattccaaatttgttaaactaattttgaaattatgtgtcgttgaaatcaatacatgtcgtttcacttagaatcccccaattgcctattacaggattaagttaagagctttctttaaatctagttcacggcctctattttaacttcatctaatagacttggaaccaatttacttacccgtcacaaggaagtcgacgagattcaattctcaccgtaagaatatacttcaattaactttgaaaggccctttcaaacactaattcatatgtcatatattattgaaatggagtgaatcatgatcatagacaccgacgacgtacaacgtttattgcaaaatgtcagtcctaatatgccgatttgggaaaaatataagcaacaaacttcaaaaacaaaattgtaccgagacaaaagcaatgagcctattgggttatcagtcttctctacaaacacatttcatccaaatgcattgggtttgactgtatacaccttatctgagaaccttttctcaatcattttagcagatgctcgtaaagaagcactatgccaacacaaagaccgcatagtaacctgggaatacgagccccttagtaaattctcagagtggttaattactcaagggttctctgtctggagacgcacggtcatgcctaaagctgaaatatcaaatattgttttagctaactctaaaaggggacaagtattgacattaagtcaagttctgaagaacaatgttctaaaaaacaaacttctaaaaatgagcctaaatgattatgcagatgctcatacagcaaacccaatgcgagtgacaacgattagcgagtgggaacagatcgttttcccggatgttctcagttctgcccctttagtattagtacaaaagagccaaatactggcttacacctttctttttgaagataatccaaagattctaactctgggttggcttggagccattaatcaaactagcttgtgggacttacaaactaagcaactaacgtgggccaaaagtcatgatatgcatgtcttaaccggtgagtttgatagcactgatcacatggccctttcgacatacaagcattggcccttcgatccagcccctgtttatacaatggttggacaattattgacaaatgaacaccgtgtctatgctatgaattcttgactcaacccgaaaggtcacaccctattgtgctcttagtggtgtctcttttttagtcactctttggtaatcaacgattccatatgttttattaacagtgattttaatgatttgcccagatttaaacgggcctatatcgtgctcatctgtttttaacttgagattctttatttttccctgtgcgttcttagcagctccttcgtaagtgtatccttgaatcgatattccaacaggtacttcaacgtttgaaataataggctgactatcaatcttcatgatagtggtctaggctgttacgccatgcatcggtagtaatcgcatgggcgaagatagttcagaatacgtctgggacgatggttcagtgcggattggactgcttgaatttcaaccagggtaactgctctgagagacttccctttcgggaagaattccctaagcagtccattggcgttctcgtttgtgccacgctcccaaggcgagtacggatgtgcgaagtaaatctgggttccaacaatctctgataacttggcaaactcggaaccattgtcaaaagtgatactctcaaattccttggccccgtagtcgtcgatcgtgtcctgcaaggctttaaggcaggtgcccgcatgatagtcaggaatcttgacgatgatctcagtccggctgtaccgttctgtgagcgtcattaatgctggctcatcagctaagcgaatacctttgaccaagtcgccttcccaatgtcccacgcctgtgcggtcattcacggccgcaggacgcaactcgattgagtcgccgtatatcttcttattcttgcgcttgtgggcgttcttatagcctttgatgcggcgtcggagcttcttgggaagtgtcatgttgtctagctcaagcagcccggcgtcgatgtagcgatacacagttgtcgttgaagggcaagccttgccctggtcgcgatagaagtgtacgaagctatcaacgctgtgtacgcgcggcttacgagtaagctccctggcgagagccttgaagaacgcacggccggtcttaagaaaggcgtagtgaccggttctatcgcgtttacggtcgtgcatggcttgggcagtttccgcaagatagacttgatgcgagtgacgcttcgagtcgagctgagttacagatccacgcgtgatttctcgtgagattgtcgctttactgcgatgaagcttctgtgcaatcacggtcgcggtgtcaccagcagcctgaagggcctgaattgtagcacggtcgctaaaactgagttgttggtaatgcttgtgggtgttagtctgagagtgggtcatgaagattcctgctttcttgtttagctagcactaacaagaataggtcttcatggcctttaagtaacatttgcgaagtcaattcgctagaacaacaaatcgagctattcgaacagctcatatttatatgagagtttgatcctggctcaggatgaacgctggcggcgtgcctaatacatgcaagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgccggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcacacacgaaactttgtttagttttgagaaagggcctatacgttcagtgttgattatttctcaacaccagaaagtgtagaccccaaaattagtattctctgtttgatcagcctgaaccggcttagcagcatcgttgattggctcgggttaataaaaactctaaaatctgtcgacaaactatttataatttttattataataaattgattcaaactcattatgaacgttagaaatattattaatatgcattgaaggttaattttctttttcatatgactatcttattaagagatacactataaaaattatataaaaagcccattttttaacatcaaatgacaaatgttatcaaaaaggtgagtttttttctaccgattatgttcaattaaatcatgtaactgtttaaaatcagggataagatcataggcgtgagttttagcttccatgaccgcgtttatttgttgtttaatcctttcggtatcttcctcatcggtataactaacccagttgatatgccctagccaatcatagtaagcgtgcttacctttcccataactgtttcccattagtaaacaaggtgttccagttaaaactgagaataccattgcatgccatcgatcagtaataattaatttttggcctgaaaataggcttaattcttttctgaagaatttttcacgggtattaggtgtaatagttttaaccgtatctaaaacagtatctgtaaattcaataggtcggtaggccctaagcaaagccttcatattttggataaccttatctttgacaactttttcactgtcccgtctgagaacaaataatgacccttgacgcttcgattttgggtctttcttagattgcatatataaaaccatatcaggtgtaaaaatgagtttattattgaaggtagtctgcattctatggtagctctgtgcatctcgggctactaaaactaaattggggtttttttggtaagcctcttgacttaactttcgttcataaagcccagcttcattgtcctcaaaatgaatagactgtgggaatgagatagttaggttatcagtaaaagttgaaaatacttttctacgtgctttttcatggtctaaatagagatttcccatattgccaccacccgtaaaggcaataatatctgcactacttagatttttctttacaacaggaatagcctcatcatcatcttcctccactatttcaatatattggtattctggaaactcagcttcgacatattttcgttcggctaatgatattgcctggtcaccaagattggtgtagctaggaacaccaaacataaaaaatttgggctgattgtttttaggcaattcgtgtacaacgttattaggattgatataaaagttggccatattattttcctcattttaatttggattgaagtcaatatttgagacagattttaagagacattcagaaccgcgtttagaaaaaggagctggtaggcaagctgcctatcaactccaaatatcgtagcgccccaaaaagacgcactgatactaaccgcaaaaaacgagttgcccgacaacaggcaactcgttttttaataatcaactgccactatgcgtaacgcaccatggcaccgacttcgactggcaagtaggcttctgtcagcagttcaacttgtccgccatgactaaggacgatgtcagctaagtcatttaaaagattagcgtgctgtgcattgatcgaatcgcgttcaatttgagtgccttcaagacgcgcatgaatccgtgcgccggcttggacaaaaagaatggcgattcgtccggcaacggctgcttgaacgacttcttccaagtgatccgtgtagctgtcatttccgcgagcattttcgatgatctcggcaaagttctggcgccggcgatcgcgcaaggtgtcgcgtactggcgtcaacaagtcgtctaattcaacaaaatcaaggtttgctgggctcttaacaacagccagcttcggtaacagatgatggttcttggaaatttcgcggaacaccgtcacgttttccgctaagcccatgagtactagcggcattttatgtggattggagtgattggccagcacatactgatccaccgcttgataaaaacggcgctgatcgctggctttttccgctgacttctcattatgcccgtgatgggtcacacgtccgccaccttgggatacgctgttcatttcgccaccgcgaatttcggtgcctagcgttcctttcaaggtctgcggtgcatcgtctggcaacgatattggccgcacctgatgcccgtggttatgatacaactgaatgctgtcggcatttaacgctaagatatcaaagtcggttgccgttgcctcatccagcatcagtggcagaatctgcggcatgtcagtaaccattgccacttcatcaaccgcttcatacatcggtgtcacataagtctgtgcgccatttgtcaacatgccaaacccatttgtttcgcaggtttgccagaatgttggatcttgctcatatggctcaagttcagccgcgtatgccgaaaagtccgtttcaggataagtctcggtcatgacgctcttggtatgcttcaccatgtttttgaaccgcaacctcagggcctcaaccgaggtgttctctggccaagacatataaagcgaaacatacggtccatgtttcgtgtcagataaaaagtgctgcagtgtcggtctagtcgtcatatccatcatgatgtaactcccttccggcctttagcctaccttaagcgtatcaatgaaaacgatgaaaggcaaagtaatccgctttaattatactatttataattaggcgcttctgttgatccgagtatcaatagccttacctctctaccagcgtcaacctaagcgtcattctgtatgatggtcgacaaggtggcgaattgcatcgccggaggttaaaaactgtgccagtgatcgcggctgcaacatcctagctgcctttgcaaacggcagccactcaccctccaaaccttcctgccaaaccaagccagccttttgtgcatcagtcaacgtcacgcgatgtaccatgatgagttgttggtaagttcgttcaggttgttgccaaaacgattccacgatccccaccagttgcggcaccacgttcagctttagctcttcatgaatttcccgagcagccgcttctgccgccgtttcaccaaatttaaccgcaccgcctgggacaagggcgataccgcttgccgagttaactgtcgctaaaagttggcctgcatgcgccaacaacaccgccgcccggacatcaaatttagcctgtggattcacttgaaagcgtaaatcattcggttcttgcaccaacatcatcaacctcttttcagttaaacacagctcacataacatgctcttgccttattttctcgatgattcaaatggcacgatctgaaccagattctgcgagtttagcgcttgtggcaaggtcgtgatcacaacccgattgtcggtcgcccgactatagtacgcatccatcattgtgatcactttctgatcttgactcaagtcggcttgtggttcgtttggtacttcccgcccctcccgctgttgggccagttgaaatttcatatgtttcatattctgtttagtgatcgattgtctaaaatgaagccggacacgccactgaccgtgtacgacggtgctgccatgttccaagcaatcggtaaatttaaggaaatatcgactggtagccagttcatatatggtgagaaaaagaagtatcctgccacttgcttaccaccattaacttcataaccaagattgcccaagagatgccctaagagaaacagcaacgccaataagaaggcagcaatcgtagatctagtcttccaatactgcttactgaacaccaatgttagcctccttacaagcctacactttttccatgtttctaatcggcagcgataaagcccttgatgtaacgccattgcattggatatggttaaaagtacatttcattcactaaaacgtcaatcatttatcgttttttatttttagagattcttcacaaccttcgattattatttccttttcatcattggatttataaacggatctcactatcattgtcaatgatacataaatatgattttgttattttaaagtgactggcgatacctacccacctcggtaccaacccaagacatgttttgtctgtctgcacagcattattcagaacaaaagaaacatccccatcgccagtcaacttaccttgaactgaacaaaatggagatgttttttgattttgataatattacttagccatataagccccaacaaagttatacatgttggctgggctgaaagtagcacctttcagcttaggattgcgcaaatggccttgaacagtttgataaagcgttgcaacaggtgattccttagaaagcagttcctgtgccttcagaagatcatcatatcgcttggtttcgctgttagcatccgttcccctagaagccttaatcagatcatcatattgtttattggaccagtgactaaagttgtaagtgttgccagtcgtgtaaaggtccaagaaggaaattggatctgggaagtcaccttgccagccggagagaatgaactgagcactgccatctaatgaccgttggatccgggtcttgaatggaacagaagagatggaaaccttcatgcctggcaattgttccaaagcagattgcagatattcagcagacttcttagcaacgtctgtgtcatcggtcgtcagggtcacatcttcaccagatttaccgacttccttcaggccttcagcccaaagttgcttagctttcttaagatcgtatgtctgaactgtcttagattccttagcggcttccttagagaagtcttcgccagtctttggattactgccagagttttctggtgtaatcgttgagattccgaaagaaccatcgccaataaccttattcgcaaactcatcacgattaatagccatcgcaacagcttgacgcaacttcagattcttgaagtcaggtaccttttcttcgttcatatccaagtaagtggtccgaccttgcttgtcgccaacgtaatccttgtccttggcatgctgcttagcaatttcaccggtcagaaccgcatcgtcaagtttcttcgtagcgaataaattagcggcagtgttggaatccttaaccacttgaacgtgaatcttatcgagcttaacttgcttggcgttccagtaagaagtgttcttcacttcatcccatgaattgccagtgccgttccagttagtcaacttgaacgggccattgaagaccaagtacttgctttgcgtaccgaacttcttgccatacttatcaaccgtcttctggttcaatgggaagaagaccggattgaccatcatcgtgctaaagtacggtactggccgatccatcgtcacaaccagcttataatcgccttctgctttaacaccaagggttgaagcagccttcttaccagcagtgatgtcatccgcgttcttaatgccagagaaaagataagcatattctgacttagttttcggatctgctgctcgcttccacgcgaagacgaaatctttggcagtaacaggatcgccgttactccacttcgtcttccgcaagttgaatgtataagtaaggccgttattcgttggcttaacgactttagtggcaacagcaggttccaatttcttgcctttataccgatacaacccatcaccagtatcaacggcggcttgcccactaataacgtccgtaatgtgggcattatccattgtggaaataacatctttttccattcgattaaaagtttctgagctactgctgctactcttgctgccacatgcggccaagagtgcagctgaggcaaataccattgcccctgctaccaatcgtttaactttcatttactcaccctcaaaatgatattacgttgagaatacattagagtatgaagaaagtaaagagaaaatttgcagatattacttgttttcgtggcctttttagcagcagaagttactcatcaaagtctcacgtcccactttttaaatatgtgaatttcgtgaatcgccgcgccatcgccaacttgctagtccggcacacaaaaaaacacccctgcgcaagcagaagtgtttgaaagacaactgaagttacttgattggtttccaggtccattcctgaacttctggaatatcatcgccgtttgcgcggatgaagtcatgatgatattgcaaggtatcatccatcttctgaacaaacgcggcagccttttcagcgtaggctggcacatgctgaataacatccttggccaagtggtaacggtcaagttcgttgagtacccgcatgtcaaatggtgtggtaatgtcaccttcttcacgatagccgtgaatcagcacattgcgattcgggcgagtgaagaagatgtcgcgaatcaacccttcaaagccatgataagcgaagaggatcggtttgtcggtggtgaagtagctgttgaattcagcatcactcaaaccgcgcggatcgatttccggactgcgcagcttcagcaggtcaaccacgttaatgaagcgaatcttcaaatctgggaaggcgtcgtgcagcaagttaatggcagcaagactttccatgtttggttcggttccggcagcggcaatgacaacatctggttcgacgccatcatcattggaagcccaatcaatccgcttcaagccggaattagccaaaacagtggcttcatcaatgctatagaactgtggccgcggctgcttggatgtgatgagcacgttcacggtattttgtgagctgaacaacttcggagaaatggccagcaagctgttggcatcagctggtagatactcgcgaatgtattcagccttcttttcagccatgtgtgtcaaaatacctgggtcctgatgggtgtaaccattgtgatcctgctggaaggaagtcgatgttgagaccacgttcagacttggataagccttatgccatggttcttcatgtgccttccgaatccacttgaagtgctgagtgagcatggaatcgacgacccggaggaaagcctcgtaactggtgaataagccatgacggccggtcagcgtgtagccttcgttaaagccttccgcctgatgttcggacaactgcgagtcaataatccggccagccggtgccaaatattggtcagccggttccttgattggttccagccattgacggttggtcacttcaaacaagctatacaaccggttactcatggtttcgtcagggccaaagatccggaaattatgcggattcagcttgatcaaatcacgcagataatcagaccacacgatcatgtcttgcttaatcagcttgccgtgttccttgttgtccagcgcatacttgcgataatctggcaataccaacggcttcggatcaatcccaccgttcgtaattgggttagcagccatccgctgctcaccctttggcggcaatgcagccaattcagggatcaacttgccgttttcatcgaacagttcctctggatggtaggacttcagccagcctgccaaggaatcagcgtgttccatatcttcagcgtcgacaggaatcggaatctggtgcgcacggaaggaaccttcgattggttcgccattccaactcttcgggcctgtccagccctttggtgaccggaaaataatcactggccagtgtggcatcgtggtgtcgccagtctcacgtgcatgtttctgaatggccttaatgtcttcaattgcttcatccaaaactttagccatttccggattcagcttctctggatcatcgccttcaacgaagaatggcttccaacccataccactgaagtatttgtctagatcttcatctgacttacgtgacaagatagttgggttggaaatcttaaacccgttcatatgcacaatcggtaaaatcgcgccatccgtgattgggttaatgaacgtattgctgaaccatgatgcagccaatgggccggtttcagtttcaccatcacccgtgacaaccgccgcgatgacctcaggattatcaagaatcgcgccggttgcgtgactcaaagcataacctaattcgccaccttcatggatggaacctggcgtttgtgcactcgcatgtgaagcaacgccacctggccatgagaactgcgtaaataggttcttcatgccttctttatcatgcgacacacgcggataaatctccgaatacgaaccgtctagataggaattggaaaccatcacttggccgccatgacccgggccttcaatataaaacatgttcaagtcatacttattgatcacccggttcaagtgggtataaatgaagttctgcccagcaatcgtgccccaatggccgatcggatgcggcttgacgtcttcgctcttcagcggccgttccagcagcgggttgtccttcaaataaagttgaccaactgaaatatagttggctgcccgccaataagcggtcatcttgtcaaagtattccttggatgagtaatcaacagtctttacttttgtatccatgctcatacctactttcgattttaatgacctcagtataacacagattccgaaaaaatcacttactttgacttaaattcacttaaaatgccttaaatattttaaaaaatcggtttgtaccagattttagcgtgcacaacacctactgagaaactattctgaaaacgctcgctgctaaactggactcattctgaactttaccgtgctagaataaaggtaatgatgcatggttcctaatcaaggcaaactaaggaggtcacttatgggcaaacatcttttaaaaacggtcatggccgtgacgctgattggcgccgccgcttactgtctcaaacgatttagtgatgaactcgccgtgtatgtttcacctgatgatgcaccggccaacaaagattcttggactgacttttagtttgaacattcggagatgttttgtcattgtcacagtttgattggtgattgcgactcttcgctttgatcggaagtgttggacttgtaatcattggccaattgacagctgctggtattattgttttcctgatggaagtgccatcggtattgaccgcagctgcctgctatgtcactagaacgtcgacgcgtctggttagttaccgggcgtttttttgtgctgcagccttgaccctgactggtaaaatggatttatcaaggagatgtcaagatgtccacatcagtaaagcctcaaaaccgcgggcttgtcatggcgccggtttttatcgccacattcatgacttccgttgaagttaccattgtcacaactgctttgccagcgattattagtgacctgcatggattggcatatcaaagttggatcatgagtgcctacttgctcacaaccgctattaccacaccgatttatggtaaattagctgacacaattggcaggcgcggtatttttcagtggggcgtggtactgttcacgcttggtaccctgttaagcgggttggcaccgcatatcttcttgctcattttggcgcgggcactccaaggtatcggtgcaggcgccgtgatgccgctgacatttaccattattgctgattattatgattttgctcatcgggcgaatgtcttagcccttaataacacagcttggggactttccgccttggtcggaccgctaattggcggttttctggttgatcaattgtcttggcattgggtctttttcgttaatgtgccgcttggtattcacgtttttttgcttattcaaatcggttatcgggaacctagtcgtgaacacggcgttctcacgatcgattggttagggattctttggttggcggtgacgctgattgcacttctacttggcattcaggcgcttgatcggcaaccagtgctcgctggcgttttgttagtgctggcacttgcggctggcttgctattgtagcatcaagaacagaaagcccccgatccgctcatcgcgccgaaaatgtttcataacttcacgttcacagtgcaaattttaactgccctgttacttagcggtgtcttgattggctatcaagtttacttcccgatctggcttcagtcgttgtatcatctcggcgcgacaacagctggtttagttgtgacatcgagttctgtcctttggctcgcctcttcatttttggtcggtccattaatcaaacgctttgtgccgcgaaccatgacactttggctcgtcgccattctgaccttagcttacttattgctcaccattgcttccccgcattttccggtttgggctttttatgtcattgccatgattaacggaacggtgatgggcattgtgatcagtatgaataccgttttgagccagcatcttgttggcaaggaatacgttggttccgccaccagcatcctaacccttggccgttcgctcgggcaaactgtgatgaccggtatctatggtgccactttgacgctcgtgattcgcgctaatttgcacggtaccacttttaaagctgtcaatgccgcgattagtgctaatgctgccgccaaaagccacgatcctcaggtagctgccaccattctcactggcttacacggtgttttcgtgatggtggtcatcgtgatggtgcttgtgtttatcctcaatttgcgcgatcctaatcgccacgtcattcaataaaccgccgttaaatgatcagccgcatccaacatttgggtgcggttttttcgtgcacgcagatcaaccagctagtctccagactgcgcatgatgacaaaaaaacatcggtgatcggccactgaacagccacgcacatgcaacaccacacgtctggttactcctatttttttgacaatctacaatctgtaggttgcattcttcaaatcatcggcgtatattcgtctaacgtaatatagataactcaaggaggtcgcatggctatcaagcatcgtattttggatcgtaaaaaagtgctcgccgctgcccgggtgatggtgacccgtgatggtattcgtgagctcaccttccagacactggctaaggaattgaatattcgttcccagtcgctatacaactattttagtaacttggatgccgtgattgaggcgctggggactgagttcatgcacaacttacatcaagaactcattgaacaagtcagtggcattgctggcaaagacgccattcgcacttttgcgcaaaccacgcatcgctatttcgaacagcaacaatcattggatgaaattatttactttgtgcatcattttccagaaagcagtccatttgttcaggcaaccggcgatgtgatcggcttattaaaacgcttgatcacccataccgagttcaaacacatggcaaaagaaagtttcgtccaaaattttatcagcagcgtgctcggttttaccgttctggaagtcatgggctttttgccagatggccaacctagccgcgatacgacttttgaatccctgctggatctctatctcagtgaagtaaaggaggggaagtcaacactttttcggacagtttgctaagcgactttttgtgaagcttgggacaggtcttttttcacattttctgggtggtaactttaattatgcaatctagggattaaagacaactcgattgctaatggtgatcgagttttttattttcagcgatgagaatgtgaattctttgttagaattcaggatttccaatacttttcgcaagcggtttctagtatagtatagtaggtagtcaaattagtaagagaagggacttgtgtacacgtgaaagttcgtaaagcagtcattccggcagccgggcttgggacccgctttctgccagcaactaaagctttagccaaagagatgttaccaatcgttgataaaccaaccattcagttcatcgttgaagaggctaaggccagcgggattgaagacattctgatcgttgagggtaaacaaaagcgttctattgaggaccatttcgattctgctcctgaattggaacagaatttgaaagaaaaacataaagatgccttgttggagttggttcactccaccactgacatcggcgttaatctcttcttcgttcgccagccatatccgcgcggtcttggggatgccgttcgtttggcgaagtcatttgttggcgacgaaccatttgttgtcatgctcggcgatgacctgatgcatgacaaggtaccattgaccaagcagctgattaacgaatacgataagacccacgcatccatccttgccgttaaaaaagtgccacatgacgaagtttcagcttatggcgttattgaccctgaaagagaagtttcaaagggactcttcaacgtcaagaaatttgttgaaaagccagcggttgccgatgcaccaagtgacttggccatcattggtcgttacttgttgacaccagagatctttgatattctcgaaaatcaaaaacctggcaagggtaacgaaattcaactcaccgatgccatcgacaccttgaaccaaacccagcgtgtcttcgcccatgaattcaccggcgatcgttatgacgttgggaataagtttggctatgtgaagaccaacatcgaatacggcttgacccacccagaagtgaaggatgagctgcgtgcttatattcttgacttggcgtcaaaactgcaggcaaataagcctgtggggaagccggcaaataagaagtaaattcataacataaaagttcaactgtcaataacagagctgtttgacgatacacagatgagtgttcgatcagacagctctgtttgtttgcgcttaggacacaggaataatgctataaaatggtttcaagtatttagtaaagcaatgacaattaaatcgatattataaacagttcaatattggaaaccgttttctatagcgttaaaataacatataggaggcgaggatcatgaaaaagttctggaagactttgttatcagcactgattatcgcaataagttttggtgcatttagtacagccaatcaagtggatgcaagggttaagttcacaagaaacgccgatttttacaagaatgagccagaaaatgctaaaccaagtgttctatcgactattacgacaatcaataaaaatggcaccatgatttatgatgcagatgctgtgaagcaaaaagatgtgatcgcggctgctgctgcgcattggaataaggcagtcgggattaacttgattatgagttatcaagaggcgcatgttgctaaagccgatgcggatgtcgtcattgaacctacagatttaccggcgggtattggtggggtaacaggctacgacggctatgtatatgaaacttggcagaatatcatcaaaatcgctaacaccacgttagatgctgctagttcacaaaaaggttttgttcaagctgtttcaacgaccagtcacgaaatgggacatgcattaggtctcaatcatgatccgggcgcactgatgggaacgagtggtgcggctgaactggcaaatggcattttaccggccattcctgactataatgtgaatgccgttggcgcgatcttgaaagacttggatcagttatacccaggatcgaagccgatcacgattccgaacatgaccgatggcagtgcttatcgcgatgctggcacaactgaggaaatattgcccactgaccgagttgcacaactagtactaggtgttgatcacttggcgacacgtaactttaatggtggcaccgtagaaattctcagcaacgaaaatgtctatcaagtcgggcgaggccaagttggcaccacgaactcattcaatttgactaaaacgaagcagccaattgtaactggctacatgagtgctggttcccaaaggtattatcagatcaaagttggcagtcaatattacattattggcggcggtagtcgcgtcatcattactggagatgcgtatcgcgataacggcaccacgacggatgtcctagataccgacttaatcagtaaactattcaaggatgattctcgtttagtatcacgggatcttactcataaaacaattgaaattacaggtaatgaagatgtttaccaagtgggtgttggacgtatcagtacaacgaacgcacttttgttgacaggcactcaacaagaagtcttaaccacttatgtgaaggtaaatggctttcatgtttatcaaatacatgtaggtgacagatacttgattatttcaagtgattttaccaaagtagtaaattaagccgggctgttgctttttattgacgaggtattattagatcaaagtggataatcagtactacattattgaggcgatagtcgcgtcattattactggtgatgtgtatcgcgataatgtcaacactccggacgtcctaagtacagatttgattgttccaaagcagcaagctctgacaactatcacaaatgctggtgagggacatgcttatcaaattcatgttggtgacagatactttatcatttggagtgactttactaaggttgctagttaacaaaaaatctgcctactatccttaaattaaaaagaggagtctcgttctttgtcagtcagcgagagtcctctttttgatggtgagaattgtaaaggaaaacacaatcttatgaatcactacgttttaaaactgatactgtatagattattaaatctgtatctagttcttgttcagttcactttggattgaagtcaatatttgagacagattttaagagacattcagaaccgcgttaagctttgggcttatcatcgcggtagctcatcagcgcttcgatcatttgctgtcggttcatttgactgcctcctctcgctgggcagaattatgtttacttaaagttgactggtattccaaaaaaataagatccggcttcgtttttaatgcagtggcaattttaaatgccaattcatagctgacacggcgttctccgcgttcgatcaatgaataatatcctttgctaatgccaatcatatttgaaatatcttgcattgtaagatgaaattccttgcggcgttctttcagcttttcgttcaaatgatcacctcctaatcaactttatgtaaacactataatctacaattagtaaactgtcaactaaaaaagtgaactttttttaaactttgttgagtttacaatttgtatacactattctattcctatggggtgatatgatgagcttcggagaaagactaagagaacttagaaacgaaaagaagatgacacaatctgatgtcgggaaaattataaatgtaagcaaagcgtctgtctctttatatgaaaagaacgaaagaacacctgaccaagattctattaagaaactggctcgttactttaacgtttctactgattttttgcttggagttactgacgttcgctcaaaaccggagaaaatagacatatcagatccaaaaaatgataccatcatgacttttgaaggtcgccccattccgcctgaagatcttgagataatcaagagacttcttcgaggtggcaaacatgatgactgactttactagtgacatgctgagagaggttttaaactacggctttgaccgtggagtcggagctgagctgacatataaactgaaaccgtacactccatcggtttctaatcctgaaacacgttggattgcggttaatatgaactggcataagccgaaacaattgccttatcaggctgcacacgaaataatgcacgttctacatcaagacccagcttgcttgtacttttattcggcttcaaagaacagcattgagggtgaagctaacataggcggaatccagattctcgttcccttatactttgctgacattgataaggaagacgccaacctgaatcaattcatggaagcctttggcattccatcatcaatggaagatgctgcttcagaagcgataaaagatttttatatataattagttgttagtccagatacggaagacggtaaaagctgaaaactatttatggaggaaaacgaaatggcaaaaaaggtaatgggtgctgacggtaagcaatataaggtgaagaagcctttttacaaacgtgtttggttttggatattagttattgttgtggtagcagcaattggcggtggcctcaacaataagggcaaatcaagcagcgaatccacggaaaaagccgcagttagcaagacggataaatcatcttcaaatacagcctcatcttcggaaccggaagataaagtgtataaagttggtgaagttgcaagctataaaggctatgaaattaaggtaaataatgtcaaattcgaccaaggcgatgacattaacactccggattcaggtaagcaatatgtaatcgcaaatatcacaatcacaaacaacaccgacaagtcacaagattataaccccttctttttcaaattaaatgccgatggtaacaaaaccgatttcggcgagattaccacaaatgttgaagatactcttcattcaggctctttagataaaggtgctacagttacgggtaatcttgtaggacaagcaaaaacagatgctaagtcattacagcttcaatatcagccatcattttggaatgacaagtcaatcaagatagatctgaaatagtgtttatttccccgagcaattggtagaagccaaacggcttggggcttttgttgggaacaaaaatagccccggtggcgagggctgaaggaggaaaatatgtcagctaaagaagatagcctaaatttcaatgagtatggagaactggtgcttgagggcatcatagcatcaataccttctgtcggggcagccttacaaacagcttattttggaaggaaaaacgagaaacgattcaaacgaatcgagagtttctataatgagttgtcgaaagatattaataagcttcatgcgcagatggccacaagcgagcaaatagacagcatctcaaacgaactatcagatttcatggaagcaacgaatgacattattgaatcacaatctagccttgcaaaacaatccatgctccacaatgcatttctgaatatactgaatagtccacagagcgtaaattggtcagaaaaccgcttttttatgtcaactgttcgccagattgatgagatagatttaaaaataatgtcagcaatcaaggacattccagctaacgattgggtaactccttctaatgtagagcaatttgcctctattgatcactttttcgctattggcttgctagagcgattgaccaattttgggtacttggaaaaacggcttggtagtatcacaatgaatgacacccaaggaaccactattgatacttattacagaattacaaatcttgggaaaagatttttagatttcatgacgcaaccaccgttctccgcaaatacacaaaacggcgataattagccaaacataccagtattttataaaaagttgaccctggagaaccgcctcaaatgataaatttattcttcaacaccagttgacgcagagccttttttgttgccgcgacggctttatttgtcgtggtcttcatcttcagttgagaactgataatcatcatcttgcatcgcttcaacttgacccagccggtaaccattaccaacttgtgagaagaagtcatggttggcggtagacgttgaaatcccattcattacgattgggttgacgtcatcagccgtgtcaggaaaagccgtttcctgacctaaattcatcaaggctttgttggcgttataacgcaagaaagtcaaaacttcatccgtccagttggtcttcgcgtaaagatcgttagtgtacttttcctcgttttcatacaaatcgaacaacaagtcgtacatccaatccttcaatgtttgttgttcagcttccggtaactcgttgaatccgagctggaatttatagccgatataagtgccatgaacactttcatcacgaataatcagcttaatgatttctgccacgttagtcagcttattgttgcccaagtaatacaacggggtaaagaaacctgaataaaacaagaaggtttccaagaaaacactggcaatcttcttctgcagcgctgaaccgttatgataaatatcattaattttgttggctttgtattgcagatgctcgttatgattggtccaatcgaagatctcatcgatttccgctggtgtgtttagcgttgaaaaaatcgaagagtaactctttgcatgcacactttccataaactgaatgttgttcaacacagccgtttcttgctgggtgcgaatattctgccgcaaacttgccatgccgtcctgactctgcagggtatctaacaaggtcaagccaccgaacacgtggccgacaacccattgctcgtcatgattgagagatcgccagtcgtccaagtcgttggacagcggaatccgggtgtctaaccaaaattgttccgtcaatttttcccaagttgctttatcaacttcgtcttcgatcgcgttccaattgatcgcaatgtactgttttgccatgtttacgctcccttatgtaaaaacaggggaaagtccccctgttaaaagattatcagattgagcagctttcacaagcgttgctgccgatttcttcttgatcatccgtgtaagtccggatgtagtaaatcgacttgatgcccttatgatgtgcgtaattacgcaaaatatttaaatcacgggtggtcattttatcggttcggccatctttccaaggataaaggccagccggaatggtactgcgcatgaacaacgtcatggccattccttgatcgacatgctgctgggcggcagcgtaaacgtcaatcactttacgcatatcaatatcataggcactttgatagtaaggcatcgtgtcattagaaaggtctggagcagggtagtaaatcgtgccgatcttcttttcttgccgatcttcaatgcggttaacgatcggctgtaatgatgcactggtgtcgttgatgtaactgatcgacccatttggcgcaacagccatgcggttctgatggtagagaccatctttcatgacactggtcttcagcgcttcccaatcagcctgcgtcggaatgtgaataccatcaaacagcgcgcgaaccttgtcatacttcggtgcccatacttgctcggtgtacttatcgaagtagctaccgtccgcatacttgctgttttcgaagttgtggaagctttcgccgcgttcttgggcaattttattggatgccttcaaggtgtagtaattcagcaaaaggaagtaaatattggtgaagtccaagctttcaggcgaaccgtagaacatatgattcttcgcaaaataagtgtgcaagcccatcgcaccaaggccaatgctgtgagcctggtgattaccgtgctggacggaaggtacaacatcgatgttgctgtggtccgtgacataagtcaaagcacgaaccattgcttcgacactgcggccaaagtcgcggctatgcatcaggttgggaatattcgtgctacctaagttgcaagatacatcagtacccagcacttcatattcctgtttattgttcaacttggaaggcacctgaacctgcatgatttccgagcacagattactcatgatgattttgccttcgattgggttggcgcgatttgccgtatcaatgttgataatataaggataaccagattcctgctgaagtttggagatttcgttttctagatcacgggccttaatcttgtacttcttaatggccggattggcaaccatgttgtcatattccttggtgatatcaacataagagaacggcttcccgtaaacccgttcaaccgagtaaggggagaagaggtacatatcggcattagccttaatgaggtcgtaatacttatccggaacgacaacgccaagactgagtgttttaacccggtacttttcgtccgcgttttccttcttggcacctaagaaactgatgatgtcaggatggaaaacgttcagatacacaacaccggcaccttgtcgctggcccaattggttgctataggaaaaagagtcttccaacagcttcatgactggcaagacgccgctagcggcaccttcaatgcccttaatcggggcaccggcttcacgtaggttggacaaggtgaggccaacgccgccaccaattcgggataattccaaggccgaattgatcgcccggccaattgaattcatgtcatcagtaatttgcaacaaaaaacatgaaaccagttcgccacggcgggcccggccagcattcaagaaggaaggggtggccggttgataacgttgatgaatcatttcatcagcaaggtcaactgccaagtcctcgttaccgtctgcaaagaaaagtgcgttggcaaaaacccgatctttaaaatcttctaaatactgggtaccgtcatcggttttcaaggcatactgtgcatagtatttgtaggcggccatgaaggatttgaactgaaaatgctgcgctgaaagaaattgatccagtttttccaaaaaagctggctgatacttgttcaaaaagtcggcttcataatagtggttatcgactaaatacttcagtcgatcagccagcgaatcaaattgcatcgtatttggcgctacattttcggtcaaaaatgcctgcaacgcttccttgtctttgttcaacggaatctggtcattcacaggaatgttgatctcgttgttgagcgcgtaataggtgacttgatccggactaattgtttttaatgacatgctaaaccctgctttcgctgcgttttataatagctggttgcgttgtgatgcgataaaaaaactggctgatcaaacagccagttgcttcaaggcgtccggtcggaacccggagaatgaatcgagcccatccgcttcgagaacaggaacctgctggaaccccttttgttttaagtaatcaatgtattgtggttcttcgttgatgttgtgctccgtgaatggaattttatgggtgtcaaggtagcgcttggtcatccggcattgcgggcagccattgcgtgtgaataaggtgatgttacgcataggtaccatcctttctcgttatcttatgttgcttaggatactcaatattggggtgtctgtcaattaaaaataccatatcttggggctatttttttgaataccccaagtgtatggtattggctgacacttttgcttacttttagtataccaagttcgtatggcgaaaaccagtcgcaaccgtcaactatttgttgaagctgaagagcaactttgtatcaacgtcacggtattgacgaaaaaacccgaccaaaaatatttgcgataaaaatcagttgagaccgtgaaaaaaagcttaaaaaaccatgagcatatcttatcgggttttttgctacctttgctatactgtagcaaacgctttcgaggaggccttctttatggtctttgatgaattatttctcgatcgggaagagcgagatcgcatcaatatctacagcacgttgtgggaggccccggggcaccggctggatattgctgccaccgccataacccgtggtgagagttaccgccaactccgacgccggatggaaaaaattgccgcagacttggtcacgatgcagtcagacgctgcaccattactgcgacgcggcgatggtaatatgattgcaccaccatcaatcagtctagatcgttatcgtatctttctatataggcggtccttgccgggacaactattgattcagacgctgaagcggcctcaattgacactgcagatgcttttggatgaaaccgggttttcacgagccgcctttttccgccgaatctcggctttgcgcctttatttgcggaaagccggcgttaccatcagcctaaatcctttagcgcttatgggaccggaagcccgcgttagacaagtttaccggcaattattgtggcagtttgtcgactttgcccatcccttgttttcggaaattttgccgcagtcgcgtcaattaatgcgcgaactcgacaaagctggtctgatccaatcagatttttcgcgggcgcagcttctattcgcagctaatgttcatctacaccgattgttagcgaatcactccatcgttggtacccttgattttgacgaattggcacctcggccaacactaacggcagcactaccgagtgcgtttgataatctgccgagaaaggctgctgaggatgaaacatggcatctttttttaactcagtggcgcgtacctcggtttcactcggaacaacaatttgatgccgctactctcgttggctatcacgcagcgcgtaatacacctgcatggcagttagtcgagaaaatccgcaacgagttcagtcgaacagttgtcgggattgccccgacagtaacaacagatctagcgttggcagggaatctcttgaagattttaatcagcgagcgcattttccccggtggcgcctatattgatctcacgcgaacagcgagtccaatgcgtgctttttatccgcgattagaagctgccttggaggcttttttcgctcgcgaagcgccattggaaaatgcatcaaaagagatcattgacgggttctatcaactgctgtggccatttatgacggacagtgcgattgctgataagctcaaggtagcacttgatcctttaatgccgcagccgttatatgaaaccgttcgtctcaacttgactcagcctgcgtatattcggctagtgacgactgagcaacagcctgatcttgttatctcggcgcaaaatcttgcgcctggagaagaacctattgtaccagatacaccagtcttttatcttgccagtgatcggtttgaaagctggtcacaactttatcaggaattgttcgcgcgttcccgtaaattaatagcccactgaaataattaatttttgaaatgttcaagtttgctttgatgcctagcaccagcctgactacttttgatagctagtagcacatagcaaaggcactacgatcagctttaaaaaatggattagcaggcgcatacttgttttattgggagatgacaaaatgaaacgagacaagcaagccgatgaagccgccgttgtggatatgaatgacacgctcatggactatgcgcataaacgtcagccgcatgtcgacgatttggccgaagaattggctaaacgggcgaaagataatatcaacgcgattgacgattatttaaaagatgatggtgaggcgcgtaaagagtatcaggcgattgccaccggctatttgcgtgataaatatgaccttgaaggtgacgatctcaccgctgcccgtgacgaacttgttcatgccgcgattcattacttagtcggccacaccaaagtcttggacgactggcaacgttaatgaagctttatatagtaaaaactggcgctttattctgacatcattcagaataaagcgccagtttttacttaaagaataggtgataataaccgtgagaagtcttgtttaaaccgaagccaactgctttgtttggcgattagctcaggcgtcagtaagtaactgcgcgccatatcagcctcgaaaatctggcccaagctactggccactttacgatcataaataaacgcattaatttcaaaattcagcttaaaacttcggatatcgaaatttgccgagccaacgctggcgatggcattgtcgacaaccaccgttttcgcatgcataaagccgtgttcgtaatggtagattttcacgccagcgcgagtcagataattcgcatagtattgtgttgcgcggaaaatgaacgggtgatcaggcatgtcaggaatcatgatgcgaacatcaatccctgacatggcagcggatactaaagcgtcgatcacagtatcatctggcaccaaataagggctttgaatccaaacagatttggtggcactggtgattaacttggtgtatcccaacttaatttgttgcgttgggtggtcaggtccggaagcaacgatctggataggcgttgcaccggctgtcaaactgtcggcagtgacactatcggcactatcttgttcaacactataagcaatttcgtcttttttgctgactgttgcattccaatccatggtgaagcgaatttttaaagcgtaaatcgtattgccgataatgcgcaaatgtgtgtcgcgccaataaccgaacttaggtttgcgggagacgtattggtcaccaacattaaacccgccgatatacccgacgtggtcgtcaatgacaacgatcttgcgatgatcacgatagttcaaacgaaagtcagtgatgggatgcttggaactaaagtaactttcggcttgcccgccaacgtcggtcagccggcgccaccactttgctgtagcgcccatggaaccccaagcgtcatataggacctttacaacaacgccttccttagctttcttgatcagcagttgctggaattgattgcctaattcatcattgtaaatggtgtaatactcaacatagatataatctttagcggcctcaatatcgcggaataacgccgcaaactttttctcgccatccgtgtaaagctgcacttggttatgggcaaggaccggtgcttgcgcggtattcagaaaaaaggcggttaaagccttggccgctggcgtgtaatcagttggtggcaataacttattccgggcgttttcgtgcttttgtagtgagacaaatgcttttacgccagactcatattcgtgttgaatccgttgcaattttttcgttgataagccgcggccagcaaataaataaaaaccaaacccgacgatcggtaaaaaaataagcactagcaaccacgcccaagtcgttgagatatctcggacctcgcgtagaaccgtgaagattgccccgaaggtgtttaaaaccaaaataataagaataagccaggtaatcagcgacataccgcacctccaagaagaataagttcattgtactcaagcgaagcgaggctgtcacgttggaggggcaaataggaggatttgcgaaatatttgggtaggaggaaagaaaatgttgatatttggggtttacttacttttagtcagttggtagaatgatacttgttctgaaatgcgtctgcaggcgcagaaatctgcgtgtaagcagtcttggcggcaatgaccaaaacctggccatcaccgccaagactgcttacacgccggtttctaactgcgccagcgcacgctttaatttataaaaaggtggttttctcgtgaatcaagacttactgaatcttttaaaacaacgccggtcaatttatgcacttggcaaagatgttaaacagaatccggatgacttagtggatttgattgaaaccgtcattcaagagacaccgactgcgtttaattcacaaacgacgcgcgctgtttttctgtttggcgagcagcatgacaagctgtgggatattgtcgtgaagcggctggagagtgaagtgccgactgagcaggcttacgaagcaaccaagcagaaaattgccagctttaaagcagcttacggtaccattatgtatttcactgatactgacgttgtaaagcaattggagaatgattttccattatatgcggcaaactttgcgacttgggcagaacaggcgcaaggttccgcacagctcaacacatgggtcaccttggcgaataatggcatcggcgcgaatctgcagcactataatccaatcattgacgatttagtgcgtgaagcctttgatatcccgaccaactggaacttacgggcacaaatgccatttggttccattgaaggttcagcaaaagataaagattacatggatcgaaaagatcagtttaaagttttgaaataagcacccatcagcttaatttaaaattgtcgtgatgagaagacaaggttgggatattattcacaaccattaataaaggcaaccgttttcgtctacaaggaaatggttgccttttcttttctcagaaacaagcttttgttgaacttaatgatcacggcgccagtaccgacgagagtggcgtctggcaagaaaaattgctttttgcctcgattgttctagtcatgacgcaattttgccgaaaatttatattttagtttcagattggcgcaacccttgctgagctaacatatgggcgccgcgattggcccggtcaggcagccagtttggcaatactaaaggaaattgaccgattaaggtcagcaaacggcctgctaggtcgggatagtgcttagcgtattgcttttcaatcgcctgaatcacaagcttggaatcactgtagaaggcgaccggtgttgtatttaagccggcttggatcagcagttcaaaaccagcgattgcggctgcaaactcggcttcatgattactcattgctggcagtgcagcatgtttttgaatttgatggggcaagccactgaccaagatgccgatcccagcgggtcctgggttgtcttttgtcgcgccatctgtgtatagtttaagcataatttctcctaaggaagtgtcaaagtgccagaataccgaactcattatcaacctgcttggatcgattttagcatgttttggagtatgatcgtgatcgggatcagccttgccacgattgttcagttagaaagtaccaagccatcgctgctagccactggcattgccatagtgacagttcttgttgcgatcatccaagtgctgcttcatcgtcttgttgtccatgaacaaggcctaaaactggttagtctttttaagagtaacaccttggaaatgacttggccggaaattgaggggtttacgtttggccatttgacagttattcttaaaaccaaacgatatggtcaagtgacttttgttttgttcggtaaaaaaagaaaacaaaaagtagtgtcgttgatccaaaaagggctgaaagagtccgccaaataaggagtgtgttgtatgtctgatattgaaattgcacaagccaatgaagcgacggcaatgtggccgattacgaaagttgcggctggtttaggtttatcagaagatgatcttgaactttatggcaaagccaaagccaagcttagttttagtgcacttaacgccttaaaggataaaccttttggcaaacttgtgctggtaacgtccatcaacccaacaccagctggcgaaggtaagtcgaccatcaccgttggcttaggggatgcgctgcaacaacgtggtaagcatcctgtgattgctttacgcgaaccgtctttaggcccggtaatgggcatgaaaggcggtgcgacaggcggcggttatgcgcaagtagttccaatggaagacattaacctgcattttacaggagatatgcatgcacttaccacggcggtggataccctagccgccttgattgacaatcatttgcaacaaggcaatacgctcaatattgatccacggcggattttatggaagcgtgctttagatatcaacgatcgcgctttgcgtcatgttacgatcggtttgggcggtcccacaagcggtgtgccgcgcgaagatggctttgatattacagttgctagcgaattaatggcagtgttgtgtctggcggaaaacattgccgatctgaaggcacgtatcggccgaattgtcattggatacacttatgaccggcaaccggtgaccgtggccgatttgaaagtcaccggtgcgattgcgatgctattgcgagatgccttgaaacctaacttggttcagacattagaacataccccggcattcatccacggtggtccatttgccaacattgcgcacggctgtaactcggttttggccacgcgtacggctttgcagctcggggacatcgcaatcaccgaagccggcttcggtgcggatctcggcggtgaaaagtttatggacatcaaaacacctgtactcggcaagacgcctgatgcagtcgtcattgtcgcaaccgtgcgtgccttgaagtataacggcggggtcgcgttaaaggacctgcaaacggaaaatgtcgaagccttggcccaaggcttcgacaatctcaaacgccacatccacagtatgcaaagttacggtgtgccggttgtagttgcgattaaccgattcactagtgataccgatgccgaaattcagcttttaattgatgcttgtgcgaaactaaacgttaaagccgtcaccgccaccgtttgggctgacggcggacgcggcggattggcggttgcggatgctgttttggcggcacttgatcaaccggcgcattttactcgcttatatgatccgcaaagcgatgtcaaaaccaaaatcaagacgattgtgcaaaagatttatggcggagctgatgtcgattatgaaggcaaagcaaacagtgccttgcgcacgatcgttaaaaacggctggcaggatttgccagtctgcatggctaaaacgcaatattcgttaacggataacgccaaaacgttgggtgcaccggaagggttcacgattcacgttcgcgacatcatccccaagttaggcgctggcttccttgttgtcatgactggctcggtgcttaccatgcccggcttgccaaaagtgcccgcagccttgaacatggatgttaccgacgatggcaagatttccggcctgttctaattttgtgtggtttttaatcagctcatgcgtaaccgccatttttaagatggcggtttttctttgaccgcggtacactaggaaacaaacgcttttactcagggggaacttctgtgcttatttatctcatcatcgccgctgcgctcgtattaattgattttctgattaaggcgtgggttactgctcacattccattaggcgaaagccaacaactgattccaggcgtgattgatctcacgcacattcgcaatactggcgcagctttctccatgtttgaaggcaaacaatggtttttctatatcacaaccttactcgcattcggggttgttgccatgctgtggcgcgacagtttgcacaaaccgatctatcgcctaggactaaccttgattactgccggggctattggtaatttcattgaccgattgcggtttcaatatgtgacagacatgtttcaccttgagtttttggatcagtggcgcttcaatgccattttcaactttgcagacatgtgcatcacatttggggttattttagtgctaatttttatcctgttcgatcatgataaggcggtggcgtgatgactagcacctttacgatcacgaccgagcaggggcgcatcgataaggttatcacggcgcatgaaaccactcacacgcgcagtcaggtgcaaaaatggttgcaagatggcttggtgacggtcaatgggcagccaaccaaggccaattacaaagttgctagcggcgatgtgattgctatctcaattcctgaagccaagccgctggaagctattccggagccgatcccgctcgatattgtgtatgaagacgaccaagtcattgtcgtcgacaaaccgcagggcatggtggtacatcctgcacctggtcatccagatggcacactggtcaacggtttgttatatcatactgatttgccgggcatcaacggtgtcattcgtcctggcatcgtgcatcgcatcgacaaggacaccagcggactactgatggttgctaaaaccgaaaaagcgcaactaagtctctccgcgcaattaaaagccaaaacgtcggttcgtgagtatttagcacttgtccatggcacgttcaaagaagatgaaggcacaattgatgcaccattgggtcgtgatccccgcgatcgtaaacgtcaagctgtcgtggcagacggtcgccatgctgttacccatttccaagtattagagcgttttgaacattacacgttcattaaatgcattttagagaccggccgcacgcatcaaattcgcgtgcacatggcatacattcatcaccctgtggccggggatccactttacggcccaaaacgcaccctgcccggcaaaggccaatttttgcacgcggctgaactgggattcgttcatccgacaaccggtcaattgctcgtcttcgaagcaccagtaccgccaatttttgaaaaaaccttagccgatctacgtgcaggcattgacaagacccgcaacgttcggtaatcttaatgcaattaaacaagcacctttaactaagtccagtgaggcttagaaggtccattccgctgcggcggattattcaggctacggtcgccttctatcccaaattggattgaaggcgactttttttgtagagcgcgagcaggagcgcttagaaaccggagcataagtggcctcagatctaaatggccggtctttggccatttagatctgaggtccttatgtgcaggtttctgcgactgcgagcgcgtttaggaaatgccagcatcggagcgtaacacccgcatcactgttcacttccaaagcaccaaaaccgcaatacatataagaaagggtggcacatcaatggcacagtcaaaacaagttgtagacgaggtaaccatgaaacgtgcattaacacgcattagctacgagatcatcgagcaaaacaagggactcaacgatctcgttttagtcggcatcaaaacccgcgggatttatttagcccatcgaatcgccaagcgtctcgaacaacttgaagggttacaggttccggttggcgaattggacattcagttttaccgcgatgacgtccataagattgatcatgatcatcagccagatgttgaaggcgcacagttaccggttaatatcaccggcaaacatgtcattctggtcgatgacgtcatcttcaccggccgcaccattcgcgctgctttagatgccttgatggacgaaggccggcctcgcaagatcagcttggctgtattggttgatcgcggacatcgcgaattaccaattcgtccagattttgtcggtaaaaacattccgacctcattggacgaacaaattcaggttcaagtttctgagcttgacggtaaagacgggatcagcatcgaaaggatggagggctaagatggcatttcacaacgacgaagccgttttagatatcggcgacaagccaaaattcggtcaatgggttggcctttctattcaacatctgtttgcgatgttcggctcgacagttcttgtgccgatcttagttggactcgatcctagcattgcccttttttcaagtggggttgggacgttaatgtatatcctaatcacgcgcggcaaaataccggcttatatgggatcaagcttttcttttatcacgatcatgcaggccttgatgaaaggtgctggctatccggccatcgctcaaggcaccatcgcggttggggttgtgtatctcattgtggccttgatcgtagcgcgcagcgggtcagcatggattgaccgggctttgccgccagttgtggttggcccgattgtgatggttatcggcctatcccttgccggcactgctgccactgatgcaacgatgcggaccatcagcgccaccaagagcgtttatgacttgcgttacttcgcagtcgcaatgatcactttagcctctgtcattatttataatatgtacctcaaaaaattcattagtctgttgccaattctactaggcattatcactggctatcttgttgccttgctctttggcattgttgatttgacaccagttcagcaggctgcttggttcgacctgcctaagtttgaaattccttttatcagttatcagccgcaagtttattggggcgcgattctctccatggcaccaattgcttttgtcactatgaccgagcatatggggcacatcatggtgctcaacaagctgactaaacgtgacttcttcaaggatcctggtttaaaccacaccctagccggtgacggtaccgcatccattatcgccggtctggttggcggcccacctgtcaccagttatggtgaaaacatcggagttttggcgatgaccaatgtccatagtatctatgtgctgggcggtgccgggttcttcgccatcttgtttgccttcatcggtaagcttagcgccttaatccgtagcattcctagtccagttattggcgggatcagctttctgttgtttggggtgatcgcttccaacggcctgcgcgtcttaattgacaacaaagttaactttgatcagaagcgcaacttgatgattgcttcaaccattcttgtgatcggcatcggcaatgccagcctacagttctccgggtatcaattctcaggactcgccctggcaactgtgatcgggatcttcctgaactttgtcttacctgaacacgccgctaatgaagaagaggcagaaaaaaatgaccttatctaatttcacagatacatcctttcaagattttgtttccgctgaacaagttgatgacaaaagcgccatgactttgatcaatcgcgccgaagattttaaagctggtcaaaccgtccattttccagaaccgatatacgcagctaacttattttttgaaaacagcacgcgcacccacactagtttcgagatggctgaacgcaaattaggtctgactgtcatcccatttgatccgtcacatagttcggtttcaaaaggggaaacccttgaagacaccattaaaacgattggagcgatcggagtcaacattgcggtgatgcgacatgcacaagatggctactataacgatcttttaggtgcatggccaacgacagcgattgtcaatgctggtgacggtgccggccagcatccttcccagatgatgctggatctgatgacgattcacgaagaattcggtcattttgacggcttgagtgtcggaattgttggcgatttgagtcacagccgagttgcgcgcagtgatatgcagatgctgcataaactcggagccacgttgcactttgccggtccagagcaatggtacgattccagtttcgatcaatatggtgatttcatcaccgtgcctgaattggtcaagcaggtggatgttttgatgctgctgcgcgttcagttggaacgcttcaacgccgaccaccgtcaggctttctcaaaagaaacctaccatgcaaagtacggcatcaccgatgatcttgctaagacaatgaaacctggcgcgattttcatgcatccggcgccagtcaatcgcgatgttgagttagccagtgatctggttgatggcccgcagtcacgcattttcactcagatgcaaaacggcgtcttcatgcggatggccatgcttgagaccgtcattaatgcccgtcattttggagaggagtaacccatgctcatcaaacacgcccatattgtcagcgatactgaatacacggctgacatccaaattaccgatcacattatctcggcgattggtcaatcgctggcgccgcgcgatcacgaacaggtgattgatgcaactggtgccatcgtcatgccgggattaattgatgtccatgtgcattttcgcgaacccggcttcactgctaaagagacgatcaaaactggcgctgcggcggcggctcacggcggtttcacaactgttgtcgccatgagcaatctcaagccggtgccagacactgtcgaaaccttaaaaccactgcttaagaaaaatcaagctgatgcgaagatcacggttttgcagttcgcaccgattacgcatgacctgcattctgatcaggttgttgacatggcagccttacaagctgctggagcgctgggcttttccaatgacggagtcggggttcaggatgccgacaccatgtatcaagccatgcaacaggctgctaagttgcatgcgcccatcgttgcccacattgaagatgcgagcctgatgcatggcggggtgatcaatgccggcccagttgccaagaaacttaatttaccggggatcatcaatcaaaccgaaagcagtcagttagcgcgcgaccttgaacttgccgctgcaaccggcgtgcattaccatgcttgccatgtgtcgactcggcaaagcgttgacctaatccgcgaagctaaaaaacgcggggtaaacgtcaccgctgaagtctcaccgcatcacctgctattggatgagaataatattccgggcgacaatccaatgtttaaaatgaatccgccgttgcgctcacgtgccgaccacttagccttacttgaaggcttgcaagacggtacgcttgatatgattgcgactgaccatgcaccacatacggctgctgaaaaaaccggttccttcaaaacagcggcatttggcattgttgggtcagaaacggccttttcaacgctctataccaagctggttaaatcaaagatgttcacgctaaaacagctgatcgcacgcatgagcacgattccggctgagaaatttgatctgccaggcggccatatcacagtcggtggacctgccgatttaaccattatggatctcgatacgccttacatcattgacccagccgactggttctccaaaggcaaaaattcaccttttattggcgataaagtcaacggtcaaacactgtacacaatcagtcaggggcaaattgcttacgcaagagcgtgaaccagcttgggcttctagctggcaagcacgtttaaaaaagcgtcagccagcccttaagaaagcatgaacaaacgcgattagcatcaggcaaacgggtttaagcaaagcgctcaccagatcggcttctgatctagtgaacgcctttagaggaggacaagcatgaagcgctatttaattcttgaagacggcagcgttttccctggcgtcggtttcggtgcggaaactgtcacaacgggcgaaatcgtttttaacaccgggatgagtggttatcaggaaacgatcaccgatcaaagttacaacggccaaatcattaccttcacccagccactgataggcaacgtcgggatcaatcgtgacgattatgaaagtatcgatccaaccgcaaaggggattgtggtacgcgatgttgcccgagtgaccggcaattggcgcagtcaaatgaccttagatgaatttctgaaacgcaaacacattcctggcatcagtggcgttgatacccgcgccttaactaagaagattcgtgaagttggggcaatgaaggctagtattgtcgatgcagccgatgagcacgcattcgatcaattgaaagccctcgtgttacctaaaaatcaagtccagcaagtttctacccaacaggcttacccagctcctggcacaggccgcaacgtggtcgtcattgatttcggactcaaacatagtatcttacgcgaacttgccaaacggcagtgcaatgttaccgtgctgcctgccaccaccaccgcctcaacaatcctcgaattagcgccagacggggtgatgctcaccaatggccctggcgatccaaaagacgttcctgaagcactggacatgattcgtggcgtggaaggcaaaattccgctgttcggtatctgcttagggcatcaactattcgcactcgccaatggcgccaacacttttaaaatgaagtatggccatcgcggtttcaatcatccggttcgtgaaattgccaccggccgaattgattttaccagtcaaaaccacggctatgcggttgatcctgacagcattgatccagatactttgttgatcacccacgtggaaatcaacgacggtacagtagaaggtttgcggcaccgattgtatccggcctttactgtccagttccatccagatgccgctcctggtccacacgatgccgatcatctttttgatgagttcatggaaatgatggatgcattctcaaatcgcacgcagaaaggataatcatgccaaaacgtcaagatattcataaaatcttagtgatcggctccggtccaattattatcggtcaggccgcggaatttgattactctggtacgcaagcctgccttgctttacgcgaagaaggttatgaagtggttttggtcaattccaatccagcaaccatcatgaccgatacggaaattgccgatcgcgtctatattgaacccttaacagtcgaatttgtgagccagattctacgtaaagagttacctgatgcgattttaccaaccatcggcggccaaatcggcttgaatttagcgatgaaacttagcaatactggcattttggatgaattgggcattgaattgctaggcactaagctgacggccattgatcaagccgaagatcgtgaattgttcaaaaacctgatgcaaaagttgcatgaaccggtgccagaatcagccatcgctaataacattgaagaagcacaacaatttgccgataaaatcgggtttccggttatcattcgaccggccttcaccatgggcggcaccggcggcgggattgcgaacaacgaaaaggaattggcagaaattgcggaaaacggcctcaacctaagccccgtgacgcaggtgttggttgaacgctccattgccggctacaaagaagtcgagtttgaagttatgcgcgatgcagcggattctgcaattgtcgtctgcaacatggaaaactttgatcctgtcggtgtccacactggagattcgatggtctttgcgccaacccaaacgttgaccgataaagaagtccagatgttgcgcgatgctgctttgaaaatcattcgcgcgttgaagatcgaaggcggctgcaacgtccaatttgccttggatcgtaacagcttcaagtactacgtcatcgaagtcaatccgcgggtgtcgcgctccagtgcactggcttccaaagctactggttatccaattgcaaaaatggctgccaagatcgcagttggcctgcacttagacgaaatcaaaaatccggtcacgaaaaaaacttgggccgaattcgaaccggctttagactatgttgtcaccaaattgccacgctttccgtttgataagtttgaaaacggtgaccgcacattaggcacccaaatgaaggccactggcgaagtcatggcaattggccgaacgcttgaagaaagtctgctaaaagcggtgcgctcattagaagttggactaattcatccagaacggccagcttttgccaagttgagcgacgatgaactgagcaaacagatcattcaagccaacgatgaacgacttttctatctcgctgaagctttccgtcgcgactacaccattgaagaagtcgccgagttatcgaaaatgaacccattcttcctcgacaagatcaaacatattgtggaattagagcgggaactggcggcacataaagctgatctggggttgctcgccgaagtaaagcggtacggttttgccgacgaagagattgccaaactctggggcctgcacgctgaccaagtgcgacagatgcgcaaggaacaaaagatactaccagtttacaaaatggtcgatacctgcgccggtgaatttgccagcgacacgccgtattactacagcacctatgaaagtagcaccgaaagcgttaaaagcgacaagccgagtgtgctcgtgattggctcaggtccgattcggattggtcaaggggtggagttcgattacgccactgtgcacagtgttaaggccattcaaaaagccggctatgaagcgattatcatgaatagtaatccggaaacggtgtcgactgacttttcgattgctgacaagctgtactttgaaccattaacccttgaagatgtcctcaacgtcattgatctggaacagccagaaggggtcatcgtccaatttggcgggcagaccgccatcaacttggctgaaccgttggcaaaccgtggcattaagattcttggcacttcagttgaagaccttaatcgggccgaggatcgtgacttgttcgatcaggtgattaaatcacttaagttaccacaaccagaaggcggtaccgccacggataaggccggtgcgttagcggtcgctgataagattggttatccggttttggctcggcctagctacgtgttaggcggccgggcgatggaaattgttcacgacgcaactgaacttgacaattatattgatcgggcggtgtccgtttcacatgatcatcctgtgctgattgaccactatctagtcggtaaggaatgcgaagtggattgcatctctgatggtgacaccgttgttttgccagggatcatggagcatatcgaacgcgctggcattcatagcggcgattcgatggctgtttatccgccgcagacctttagtcaagacattatcgatcaaatcaccgatgccacgattaaattgtcgcggacactaaactgcattggcttgatgaacgttcaattcatcattcacgatggtaaagcctacgtcatcgaagtgaatccgcgcgccagtcgaactctgccgtttttgagtaaagtgaccaacatcaaactggcacaagtcgcaacattggcaattcttggtttaagtttgaaggaacaaggttttgaaacaggcttgttgccgaatcagccaggtattcacgtcaaatcaccggtgtttagtttttcgaagttgaatcacgttgatagtctgcttgggccggaaatgaaatcgaccggtgaagtcatgggcagcgacaccacccttgcgaaggcgttgtacaaagcttttgaagcggctggcatgcacttgccacaatttggccgggcattgatcacggttaaagacgctgacaaggctgaagcaacggcactagcaaaacgattccgcgaagttggttatcaactagtggcaacaagcggcactgctaaggcctttgagaaagccggtatcacagtgtcaacgattgaaaaacttgatagtggccaggagacgattcttgaagacattgccaatcggaaaattcaattagtgattaacactatgagtgcagataagaaggtttcaagtgacggtttccgaattagagaagctgccatcgaacatggcgtgccattgatgaccagtctagacacagctggagccattttgaaagttctagaattacaagcattttcaatatcgccgattaaaagttgagcgccttgccatacaaagtgatttttacaacactatctaggtatgatcaccatcaaaatgctcgttgcgttattaacgctgttatttcagcttttatagcatgacgggcacgctttaacgcacttgcagtcgcagcagcctacacataaggaggtaccacatggccattcaattgccgggtttcacgatgaaaaatccgttaatgcccgcgagtgggacgtttggctttggcgaaggttacgccaaagagtatgatctcaatttgctagggacgttagtcacaaaatcgacgacactcgcaccgcgcatcggcaatcaagggactatttttgccgacggccctgacagtactttgaatgcagtaggtctaaaaaatcccggttctgatgtcgtgctgcacgaaaagctgccgtggttggccacgcagtatcctgacttgccgattatcgctagtattgctggggtggatgttgccgaatacgcagcagtggcgaaaaaattgagtgctgctcctaatgttaaggcactagaagtcaacatctcctgtccgaatgtcaagcaaggcgggatggcgtttggaacagacccagaagtcgctgcggccgtgacgcgtgcggttaaagccgcgagctcggtgccgattttcgttaagctgacgccgaatgtgactgatatcactgccattgctgaagcagtcgaacaagcgggggccgatggtctttcactgatcaatacgtttgtcggcatgcggctggatattgccactggcaaaccacttctcgacaatgtgactggcggcgtttcaggtccggctttgctgccaatggcactccacatggtttatcaagtggctcatgccgttcgcgtcccgttgattggaatgggtgggatcagctctggccatgatgcagcagaaatgttggcggccggcgccacggcacttgcagttggttcagccaattattatcaaaagcgagccattccgaagatcgtggctgaattggcagccatacaggaaggacagacagtttaatgacgcctattatcgcactggattttaaagataagaccacaactcttgattttttaagcaaatttccaaaagaagaacatttgttcgttaaagttggcatggaacttttctatgctgaaggcccagcgattatcaccgagattcaacaagcccgaccggtgtcgatttttctcgatttaaaacttcacgacatccctaacaccgtggaaaaagcggcgtggcagttgggtaaactaggtgtggcgatgaccactgtccacgcagcaggcgggaaagacatgatgatcgcagccaaacgcgggctattggctggcgcaaaggcagctggtcatccagcaccaaaaatgcttgcgatcacgcagctaacttcgacagatcagacgatgctgacaaatcagctttcgattgagatcccgatcagtcaagcggttcagcatcttgcagccatcgcgcaggcaagtaatgccgatggtgtggtggcaagtgctttggaaacaccactcattcgaagtgtgacgcgacctgattttctggtagtcaccccgggaattcgaccgcatggtgcggcagtcggcgaccaaaaacgagtcgtgaccccgggcagagccaagcgtttaggcagttcagcgattgttgttggccggccgattacgcaggctgatgatccggtggcggcttatcaatcaattaaggaagcgtgggaaacagcacatgactaaattagaaacacaaattgccagcgacttactccgtattcaggccgtcaccttgcgtcctgatgcaccgttcacttgggccagcggcctgaaaagtccaatttataccgataatcgcttgaccattggctacccagacgttcgcagtaaaattgcagctggtttggcgcagcaaattgtggctcactatcctgatgttactgcgattggcggcgtggctactgctgggattccacatgcggctttggtagcaaacttgttgaacctaccgctggtttacattcgcagtaagcctaaggatcacggtcaagggcggcaagttgaagggcatctgccagccgatgctaagctggttgtcatcgatgatttgctctcaactggcggatcagtcttaggggcggttgcagccgctcaaaaagatggtgctacagttttaggcgtcgctgcgatctttagttatcaactagccgcggtcaaaactaattttgccgatgctggcttaccgttcttcacattgacaaactatacggctttgatccaaacagccgaggcacaaggcgccatcactagtacgcaactcgcttcactgcatcaatggcgggaagatccggtcaaatggggcgcacagtttcaataagccgcaccaattgagtaccatgttcaaatcgaaaaagccaagcacggttacttcaaaaaatattttgaagtaaccgtgcttttttgtccttgccgatgacgtgaagctgcattcgttaatttatgggaaccaagtcgcattggtgagcaatctaagcaagccatgaggaaatgagaatttcagaatatgatcgttgattcacatagtggcaaataaaaaaattattttgactgatattggattaattaagcagtaaaatccattttaaactgatttattagaaaatgatttgattgcatttatatgcacaatgcgttgaattcaggtttcatcaaaatagcttcatgagaattcaggaaaatcgagcagcgttttcttgctgtatcgataacaactgttatactacagatggggacaatcaaagtttatatacttagtttcattaatttatgagtaaaatttatggaaaatagacgtcatccggttaattgttatacaacagttgttcacaatttaaatggctactggcaagataccgtttatcaactttggaggtgaaaggatgatcacagttgctattccaatgggttcgcaaccagacatactaacccttgtaactcgtgctcgcagtgagctcgcttcgaccttggcggacaaactgcaatttgttgtgtttgatagcggttcgaacgttgaccaagcagacacttggacgtttcatcaggcgcgcgatgaagcggacgcggtgacgcaagcggttggtttagtcgctcaaggtaaggccgatattttactaaagggcattgtgcaaacgcatacattactgaaagaactgcttcgtcctgactatcaactgcggcttcagaaagttttgtctcatgttgcgattattcatctgccacaactaaaccggccgcttcttttgagcgatgctggtatgaatattgaccccgacgaagacaggctggccgccattgtcgaaaatgcagtaggcgttgcgcatcaaattggtttgccaaagccaaaagttgcgctactcagtgcagccgagaactttaatccgaaaatgccttcctcagttttggcgcaggcggtcgcaaaacagtttgaaacgcgctcagatgccgtgattgccggcccaatctcgctagatttggcattatcaccagcatctgtggcgcataagcattatgaaggcgtgattcaaggtgatgccgatgtgttaattgtcccaaccattgatgttggcaatgttttatataaggcgttgatgctattcacggatgctcgctcatgcggcacgattgtgggggccaaagtgccgatagttttaacttcgcgcagtgattccgttgatagtaaactaacggcgctggcattcgcgattgcacaactgaaaggcggtgcctcatgaccatgcatccaaaacgcgatgttgtcatcgtgatcaatcctggctcaacttcgtccaaaatcgccttatttaaggctggtaaaatggtcgccgaacgcacacttaaccactccttagccgagctaagtcaatttgatgccgttattgcacaaaaagattttcggatgcaagccattcaagaatttttagccgatcaggacttttcagcaagcgaagtgctggcagtcgctagacgcggaggattgttaaaaccaattccgggcggtacgtatgctgtcaatgaggcgatgctggatgatttaaccgcagccaaacgcaacgaacatgcaagtaacctcggtgcaggactagcacagcaagtcgctgatcaatatggcgtcaaggcatatgtggtggatccacccgtggtagatgaattgcagccgctcgctcgtatcagtggtttaaaaggaatcgagcgacacagtgcggcccatgttttaaatcaaaaagccatggcccgccaagttttggctactatgggcaagacctatgccacaagccgtgtgatcgtcgcgcacatcggcgggggtctcagcattcatgcacatgaaaacggccgcatgattgacggcaataacggcattgatggtgaaggaccgtactcacccgaaagagctggctcactgccactagttgattttgttgccaaagtgttagctgagcggctgacgctagaccaagtcaaaaaattattggctagtcaaagtggtttgcgctcgtacctaaacgatatcagtatcaaaaacattgtcgctcggattgctgagggtgacgaaaccgctaagttctacttagatggcatgatctatcagattaaaaaacagatcgccgaaatggcgggcgttttaaatggtcaggttgatgtgattattttgactggcggcgctgcttatgccactgctgtgacagccccgctgcaacatgatttagcctggatcgcaccggtggtagtgcgaccaggagaaatggaaatgcaggcactctatgagggggtgatgcgcgttttgaatcatgaagaacccgtccgcgtttatcaatcagacgcgtcaacaatcaaagggggaactggcagatgacaatgaacacagatctggtggtcctgggtggcggacccggcggttatgttgccgccattcgggccgcacagttaggcatgcaggtcgttttggtagagaaggcaaaagtcggcggcatttgtttgcacaaaggctgcatccccaccaagtcactgttgcatagcggtgaaacactgcgactgatgcaatcagccgcgacatttggcgggatcatcgaaggcaaagtcggcattgattttgctaagattcaagcgcgtaaggcaactgttgtggaccagctttaccgcggggttcaaggattgatgaagaaaaataagatcaccgttcttaacggaactggcgcggttttaggcccatcgattttctcaccggtatctggaactgtctcggtaaccttcgatgacaaaagcaaagaagacgtgatgatcgtacctaaacacgtcatcatcgcaactggctctagtccaaagactttgccgagtctgccaattgacgaaaagatgattttgacctccaacggcatgctcgaactcacggctttaccgaagaaagtcgcaatcatcggaggcggtgtcatcggcgtcgaatgggcgtctctgcttaatgactttggggtggatgtcaccatcgttgaatttttggaccaattggtgatcaacgaaagtcaaacgattgcccgtgaattacagaaacaactcgaaaaccgcggcattcacatccaactcggcgccaaagtggaacaggcaacgatcaaaaataagcaggtggcactgaccatcgctgaacaaagcaatcccttaatcgttgacaaagtcatggttgcgattggccgccagccaaatgttgaaggcattggactacaaaatacctcaattaagtattcggcaaagggcatcacccacaatgcgttttatcaaacaacggaagatcacatttatgcgattggcgatgtcatcgataccctccagttggcgcatgtggcgatgaaagaaggcatcatcgcggtggaacacatggccggtctaccagttgcatcgcttaattacaatgatgtaccgcgttgtacgtacaccgatccagaaattgctagtgtcggctatacctcatccaattatccgcaagatcgcgacgtgaaaattggccggttcaactttaatgccaatgctaaagcgatcattttgggcgatacagctggttttgtcgaagtgctgcgagatgtggtaaccgatgacattatcggcgtcagcatcattggtgcccacgccaccgacatgattgccgaaatgagtgacgcgatgtacctcgatgcctctgctacagagattggtgatgccgttcatccgcatccatcactatcggaagccattcaagaagcaactttagatacccacaagatagccattcacaaataagaaagcgagtgagtctgatgcaaaaaatgaaaacgacagggaaactgaaaacgacaggattaagtcgcgagaccattcttgacgtctataaggccgttatgcgtggccgccgcgtcgatgaacgtttatggcaactgacccgaattggtaaattctcgtttaacatttccggacaaggtgctgaagtcgggcaagctgctatggcgttggcgtttgattatgacaaagattattttctgccttactaccggcatctcaccgcagtgctcatgtgggggatgacgacaaaagatattatgctggccggttttgggaaagaagccgatccggcttcacatggtcgtcaaatgccaagtcattacggcagcaaggcgcataacattgtgagtcactcctcgccagtcagcacccagtatccaatttccgctgggattgcctatggtgctcagatgcgtggtgaagactatgtcaccgtggttaccactggggatggctcctttagtcaaggtgaatgtgcagaagccatgaacatcgcaggcgtgcacaagatgccagtagtcttcgtcgttgaaaataatggatacgctatttcggtgccagacaaagaacaatatgccgttgaaaagttagctgaccgcggcccagcgtttggttttaaaggcgttcgagtagacggccgcgactttgcggaaacctatctggcgttcaaacaggcggtcacagacgctcgtgaaggcaacggtccgactttgatcgaaattatggttgaacgactcaccagtcattcttccgacgatgaccagcgggtataccgtagtgccgaagaacttgccgaaatcaaagaaaacgatccggtgaaacttttccaacaacaattaatcgacgaagggtacctgaacgaagccgacattgatcgcattgaaaaggaacttgaaaccgagattaaccaagcaaccgatgaggcagaagccatgcctgatccagatccagccaagatcaccgaccagttgtacgcagaataggagagcgcgaactgccacgggtagaaaccggagtacaagtgtccttggacgtggatggtcgcactttgaccattgcgaccaagatacttacacgcaggtttctgggctggtgaacgcgtttaaaggaggatgaagaaccatggctgaattaacttatttagaggcgatccaacaaggtattgacgaagaaatggcgaaagatgaaaacgtccttattttcggggaagatgtcggcggtgacaaaggcggggtctttggcgtcacgaaaggcttggcggccaagtatggcgataagcgcgttttcaacacacctttaacggaaattgctattggtgatatgggtgttggccttggactagttggcttccggccaatcgccgaattccaatttgctgattatattttaccagctgtcaaccagctcaattccgaagcggcccgcatgcggtaccgcagcaaaggcgactggaccgtgccggcagttttccgcgctccatatggcggcggcgtgcgcggcggcttttatcactcacaatcaacagaaaagatctttgctgggcaaccaggtttgcgggtcgtcaccccgtcaaatccatacgacgcaaaaggcatgattaaaaccgcgattcgtagtgacgatccagtgattttctatgaacacaagcgtctatatcgcttgctaaaagcggaagtgccggaaacggattacaccgtgccaactgacaaggctaatgtgattcgcgaaggtgacgacttgaccgtgattgcatatggggcggtgctccaacatgccttaactgctgcggagaagctggccggtgaaggcgtcagtgcagaaatcgttgatgtccgctcactttatccacttgatcgggaaaccttagtcgcagcagcaaagaaaaccggtaaagtcttattaatcaccgaggataacaaggaaagcaccatcatgagtgaagttgcagccatgattgccgaggatgcccttttcgatctcgatgcaccaatcagacggttagcaggacctgatgtgccggcaatgccatatgctgttgggctggaacgagcattcttagttaacgaagaacaagtttataacgaaatgaaagcgctcgcagcatattgatgaagggggaaaatagcatggcgatcgaacaaatcttactgcccggtttaggcgagagtgttcacgaagcgtccatcattaattagctggtcaaaccaggcgatcatgtcaaaaaatacgatcccttagctgaaaccgtatcagataaagtgacgaccgaaactccatcgaattttgctggcgtcattaaagcctatctcgttgaccttgataaagaggttccaatcggtacaccgatcatgagcatcgaagttgaaggcgcagcaagtgcacctgaaccagctgccgtcaccagttcaccggctgcacaaccggcagcgccaccagcaccagtaccaattccggcagcgccaagcaaacttagtgccactggcggcaagcgtttttcaccagcagtgttggctttagctgaagaaaaaggcatcgatcttaatgatgtcatcggcaccggtaacaatggccgaatcacccgcaaggatgtgctcaattacacgcctagcgccagcgcgccaacctcagcgcctgagccacaacccgtttcggatgcggctcaagcaaccacccaagcgccaaccgcaccgcccgcatcagcaataccggaagcaccaaagccagcacctgaaacgatcaactttgaacctgggatccatgatcaaattgtcccggctgatggtattcgtaaaacaattgctcgtcacatggtgcaaagtgccaccgaaattccgcatgcttggatgttagtggaagcagatgtgacgaacatggttaaactgcgtaaccgcatgaaggacaactttaaacagcaggaaggcatttccttatcttacttcccattcttcattaaagccgtcgttcaagccttgaagaaacatccgaagatcaacactagctggcaagacgggaatattgtttatcatcaggatttcaatatctcaattgccgttgcaaccgatgattatctttatgtacccgtgataaaacatgccgaccagctgtccatcaccgggattgccaaagaaatcaaccgtctagcgcaactcacgcgcgctgggaaactgacgtcggctgatatggcagatggcaccttcaccgtgaacaataccggatcgtttggctcagttgcctctatggggattattaattatccgcaggcagcgattatgcaagtcgaaagcatcaacaagaaactggtcgtcaccgatgacggcattaagatcgctgacatggtcaatctgtgtctgtcgctggatcaccgtattctcgacggcctgcaagccggacgatttatgaacgatgtcaaattgaacttaagtcaatacaacatcgagtcggatctttactaaaacacagtacgacatgtttgcgttgagaacattgaatttccacggattttcaaaacagctgtagagatgtgccatgacaggaggaaaaagatcatgaaaattacaattgctggtgtcggagccatgggtggccgctacgcattgatgctcagtcgcgcaggcaacgatgtcgacggtattgacggctgggctgacaatgtgaatgccatcaatgagcatggcctgcaggctaacttcgatggcgaacaagttgttgctaagatcaaagcctatgaacaaaccaaaattgatccaagtgcagtggctgatctcgtcatcctcttcccgaaatccatgcaactagacggtatgatgcagtcattaaagccggtgatcactgaccatactaaaattctgtgtttaatgaatggtatcggtcatgaagaaatcatcgaaaaatatgtcacacgcgacaatatttttattggtaatacgatgtggaccgccggaatggaaggatcaggcaaattaaagctattcggcagcggttcagtcgccttgcgcaacgtcgaagacggcgaagcagcgaccgcggctgcaaaaaagatcgtgaaattgttatcagacgctggactaaatgctgaatactctgataatatcctgtatacgatctacaagaaagcaacggtcaatggcacaatgaacggcttatgcacgattctggactgcaatatgagtgaatttggcagcacctcaaccgctgaggacatggttgtcgcaatcgtcaaagaattctcggcagttgccgcaaaagagggcattgatttgaatgtgcctgacacggtggactacatcaaaacaacctgggatccaaacacgatcggccatcattacccgtccatgcatcaagacctgattaccaatcaccgcttgactgagatcgattatattaacggtgtgattgatcggcgcggtaagaagtacggtattccgaccccatactgtaccttcttaacccaactagtccacgccaaggaacagttgctgcacgcaaaataatgaaggggtgacacatgatggctgattcgatgaacaaggagatgacccatgcggctgcagatgcacttgtagacgaacaaaaggggaaagcaggcgggcttgttgaagacaacaaaacacctgaaaagtcccagaaaatgacgccacgcgtttttcttaataaggttttatcaggaacggccttgggcgttattatcggcctcatccccaatgctgttctatccggcattctgaaatacttcggcaccaacacatttgcggtcacgttgacgcaaattgccgtgatttttcaacttgcgacaccgttgattattggcggtttgatcgctttgcaatttgaattcaatccaatgcagatgatggtaacggctggtgcttcctttgttgggtcgggggttgtgaaatttaatcctgccatgaaagcctatgtcggtgccggcactggtgatttgatcaacaccatgatcaccgcctcgattgctgtgctggttctgatgtgggtcaaagataaattcggctctacagcagtggttgccatgccgatcttggttgggtgcggggtcgcctatatcggggtcttactgttgccgtttattgcagcatttaccgcagcgattggcgatgtgattaacagttttacgacgttacaaccgattttcatggcaatcttaatttgctgctcctttgccacgattatcattagtccaatttcgactgttgccattggcctagccatccaactgaacggggtttcggctggtgcagcggcgatgggggttgcagcaacagcacttgcgcttgtcgtttattcatggagcgtgaacaaatctggcgtgaccttggcaattgctttaggtgccatgaaactcatgatgccgaacttgttcaaatatccgattatcttagtaccgtgcttgttcaccgcgatcatttcggcaatcccagttgcactgctttctatcagcggtacgccgcaatcttctgggttcgggattgtcggcttggtcggaccgctggcatccatggaggctggcctagcgatcccgctggttgtcctttgctggatcgtgattccagttgcagcagccttgctaagtaagctgttgtttgaaaaaatgctcaagctattcgatagcaatgttgtgtttaagttccaaggttaaacagcatcaaaaaagctcacgttttgcgacgtgagctttttttggtgccgtcagaacaagttattcaagatgtttatggccttgcgcatcatacacgcggtggtcgttaatggcgactttcttgtggacggcttgggctaaatcaatatctgtcatctcggcaatgccaagtagataaatggtgacatcagccaattcttccgcgatgttggcgtgatcgtcctttaataatgccgtcgttaattcagccatttcatggtaggccaataacatttcgaaatttgtatcagtggtgttccagccatgtttgatcttgttagctaatatatgcgcctgaacggttttggatgaaggaatgtctgatgctttcatcgttctgattgccccctagacactgacatcaattgaacgtgacgattacttggtaggcgggttgcgtaacttgtcgaccagctcgacgtcaggcgtgacagcgaccgtcttttgcccttcataaaccacaaaacctggcttggcgccattgggtttacgaatctttttgacttcgatccagtccaccggtacattagcactgtcacgggctttcgaaaaataggcggccaacttagccgcttcgagcaacgttttctcgcttggctgatgactatcgatgataacatgggagcctggtatatctttcacgtgcagccagatatcgattttcttagcggtgtgcaaggtcaattgatcattctgcaagttattcttgcccacccaaattttggtgccatcgctggcataaaattgatcaggttttgcgaccttttggcgtttagccccttttttgttggtcttttgcttgcgtaaatagccttgctgctgcagttcgagccgaatatcggccaaatctttcgggctagcgacgtcgatctgggccatgataccttcaagataagcaatttcttcctgattttcctgcatttgttgatggacatgggcaacggcattacgcagttttgtatatttagcgaagtacttctgagcatttctagacggcgtcagttggttggatagtgtgattttgattggccgattatcatcatagaaattaggcagctcgatgctggtcatgccgcgttcgacctgacttaaataagtcgtcaacacttcgccccgaattcggtaatcatcggccttttccgtttcctctaaggtccgctgcaacttacgctgttttttgcgatctttatcaaggacgttcttgatgacgtggatcaggttcccaccttgctgcaagacgcgatcgtgctcggccttttgttcataataagcatccaacatcgtgctgagggtcggatattggctttgctcaccagtcaatgacaggtaggggattgccgtgaaaacggcctttttgccttgtgccgtgatggtcggcacgggtgtcgccagtgcggcaaagaaaccatcccagcctgcatcgccttggttgagtcgtaacgcaagctcagtagccgaatctttagctaagccttgataatgctgttgcaacaacgctgcgcgacttaaggcgggcgtgacctcgcgttctaatgcgtggtaacgccggtctggatcgtgaaaaggatcggttttgtcttgcttaggcggttcaacgtaaggggcacctggcatcaggggacgataacgattttgatcggccgacacatggcgaatgagatcaataattttaccagtacgttcactgacaaggaaaatattgctgtggcgacccatcatttcgatgatcaaccgcaagccgagttcatcgccgagttcgtcacgggttgagaactcaaagtggagcacccggtcattttgcacctgatgcacggcagttaaggtggccgcattaaaatacttccgcaaagtcatggtgaatgttgcgggaacatcagggttcgtgaatggaatatgcgtgatctgaacccgcgcatattgagggttggctgacagaaggaggggatgattctttcgtcccgctcgaatagtgatcacaacttcattttcataaggttgttgaattttagcaacacggccgccgcttaaagttgcatttagctcgttggccatggcatgggtaaagattccgtcaaatgacatgttgatccgctcgctttccaattgtaccaatcattttaccggtttttgggtgtcatagcaaaaagcgattggcgggggactgcgcacccgctacatttttgttttttatggtatgatgtagacaatcatttttgaaaaagtgggtgtctgtacatgaaaattgctatcgtgacggatagtacctgttatctgccgcaagccgaaatcgacaaacatcacatcactgtggtgccgattccggttattcttgacggcgcggtttacgacgaaggcaaggatatcaccaccgaagaattctatgccaaattaaagactgccaaaacgttccccagcaccacgcagccgccgctgggcgagatgctgaagctttacgagaatcttgctaatgaaggctatgacactatcatcagtattcatctggccagcacaatttccggttttgtgaatacattgaaaggtgccgtagatgaggttcaaggcgcaaaggtttatgtttatgattcacaaattaccgttattttgatgggttggctggttttggcagcagcacaaatggccgaagccggtgatgatcctgaggcgatcttggctcgattagataacttacgcacaaccatgggtgagtattttatcgttaatgatctgcaaaaccttgttcgcggcggccgactcagcaatgcctcggcttttatcggtggcatgttaaagatcaagccattgttaacgtttgacgatcaaagtcacaagatcgtggcaatcgaaaaaattcgctccatcaaaaaggcttactctcgcgttgagactttgtttcaagaagaacttgatcgagttgattatccggttcgcgcggttgttatccacgctaatgatccagacgaggccaatcgttggttagcagatttacagcagaagtttccaacagttccattcgaactatcttactttggcccagttgtcggcacccacttaggtgaaaaggcaatcgccttagcttggatgaaagattttacgaaagcataatcagaagtcgcgtttaggcgcggctttttcaattgaaggagatgcctatatgttttttgatcaaccgctagcaaaaggaaaaattctgagcgaaaccccgcattatcatgggccgattttcgatgttgtgacgcaacatattaaaacgcctgatggcctcacagttgagcgtgacttgattcgccacgccaatgcagtggccatgttggctatgaccgatgatgggcgcgtgctagtcaatcgcgagtatcgagttgcggtaaacagtgaagtctttggcttaccagccggtttgatggacccgggtgaagactggcaaaccgccgcaagccgggaattgcgcgaggaaaccggctacgtgacgcacgattttcagtggatgaccgctatccgttcaagtgaagggatgacggatgaaaccgtcaatctggtgttggcacatcttgacttggctgataaaacaaaacaagacttcgatcaagacgaatttgtaactagccgattagtcccattttctgaattagttgcgggtgtcaaagctggcaaaatccgttcggcgcaaacggtatcggctgtgacttattatttggcttttatcgccaaagattaaaatattgattagaggttggggctgagccatagttcctcatagaacttgtgaattattagatttcgaataattcaggaaaatctcagtgcaaaaatttctttgccgtgccaaactccgcaatctccggccagatggagctggaacgcgtgacggcgacttcgagcccgccaaacccacggtctcgaagtcgcctaacgacatcagcgacaaagcccggtcgctgtgttgtttgcacagctgagccccatctggcctgtgattgctccgccttggcactgatttcttcaaattttcaataaaaattatctatgtgaaaaaggtcaacgtttttcctttgtatggaaattgttgcctttttttgatgacttcgcgttatggtttaagctgattatttgcttaagaaaaactactcagcttaattaaaataactagatttctccgtgcttggtcagcaatagaaagcgaacgctttgattcggcgcttaccctatgaatgtttatgcataatatatttacttttcaagcaattgcgcgtacactcgaaagcaattaagaaagcaggtggcgtgatgttacgcaaaagtgttgccaagctgccggactatgtttcggacagcacaccggagcgactcgcgaaagcagcgggacttgccaagctgacgcgtttgtcattcaatgaaaatccggttggcacatcgcccaaagtgaaagaagcgctcgcaaattgggcgttttcgcaaggacgcaattatcctgatccagatgcactgccattacgaacagccgtggccgaacgactacacgtaaaccccgaccagctccttttttccagtggtttggatgaaatgattgccttgatttgccggacatttttggaagtcggggacgaaagccttcaaccgtggccgacttatccggaatatcaactacaggcagctatcgcgggtgccataacggtgaatgctgccgtaacgccggcaaccggacttattgatcttgatgatttagccgcgcacattacggccaaaacaaaagtgatttggttgtgcaatccgaataacccgaccggtacttatttaccaatttctcagatcgcccagtttatgaagcgggtgcctgctgatgtgctagtagtggttgatgaagcctatattgattttgtcgccgacgtttcgaatccgtctgcgctgtcactggttacgcaatttaacaatttactagtcatgcggacattttcaaaattgtacggtctagctaattttcgcgtcgggtttagcatcgtgccgcagcgagtaattgctaaaatgcagaatgtgcgcttgccttacaacattagcggtattagtcagacggcggcattagcagcttggcaggatcaagccttcactcaaaccgtgaaacagcaactattgacagcacggcagcaatggtcagctttttttgaggccaaccacattcagcactatgccagtcagaccaactttatgttgtatcaagtcgccgatccccaagcgcttggcgcctttttaaaacagcatggctacttggttcgcgacagtatggtacccggctggattcgccaaagttttggaacacctgcgcaagatgcagagatgcgacaattactactgacgtttcttaaaacggatactgaggtccctaattagtggactgattatgcaaaaaaagatgtttactttcaaaataataatttgaccaaatattcataaaaaaacatcattgatgctggctgccgcacctttttatgccacaacttgtggtggcattatccgcgccgaattaaaaaaaggttgacaatggcaaaatgatggctattatgaaagtcacattaacaaacatgaagttgtgattagaacaagtaagctgatcctgatcaacagagagcgtctattgctgaaaagacgcgattagccagctgaacacacatctatgaacttgacggctgaactaagtaagctgtcacgcatccgttgcgttatcactgctgccaactgctgttcgcaattgctgacagttacttggcaggtgaggtttaggtcgcaagagctaaacaaaattgaggtggtaccgcggtcaaaaatcgccctcggaaacgttttttcgttttcgagggcgattttttttaggcgcgaccaggagcgcataggtttctgcgactgcgagcgcgttatcgcgagcaccaagccaaacttcatgtcaacgaaaggagctaactcatgtcaaatcggcatctgcctattggcacacgcgacgaattcgggccgcgggccattcgcaaagagaatctcattcaaaccattagtcaacaattcattcaagccgggttcgagcgggtcaaaaccccattgttggaatatcgagatgtgtttaaaccgttagttgtcagtggcgaacaaccttatcaaatgctcgatgatgctggcgaatcagtggttatgcggcctgatctgactttaccgcttgcgagattgcttagtaccacgagtatcgtgccgccagtgcaatggtggtatgtcggcgacatttttcgagttaagaaaagtctaagcggtacttataaccagatcacccaagcaggcattgagcttattgggtatcgctccctcaaagccgagtgggcatgtctcagcgaagcaggaaaaatttgtcgcacgctaggattgacacatctcacgttagagttatctgatgcccagttcgttccgcaaatcttacgaacacttcaactgaatgatgccgcggctgatgcatttcaaaccgctttctttgctaaagagctaagcacctatcaagacctgattgcgccgcttgctacaaacccgctttatccatttcttcaacagtggccatggctttttggcgatagcgaaacgatctttgccgaattgaaacggttattgccgtcgaatgtgattacggatcgcttagccccacttcaacaaacggtggcctttctcaaagaccaatttccggaattgcgcgtgacgatcgatctcaccagccggccaccacaatcttattacaccggcatcttcttccatgcttacgttgatggcggtcaccaatatctttttagcggcggtcgctatgacaaattgctggcaagttttcaacaagaattgttgccagcggttggcttagcttttgacattgatgccgtgactgatcaattgccgaatgcgcctgaccagcccctcacatttgtctatggcctgccatcgcaatggcaagccgcagcagcgatggttgccaccaccccgaatgcaagactgtgtctggtcgatactttggcagaggctcaagctgcagcgacaaaacagcatgctaacttgattgatctttccccaaaggaggcgatcctatgacactcaccattgcgctcactaaggggcgaactgaaacgcaaatcttacccttactcgcggctgccgggatccactgtgaggccattcaagccaaaagcagacggttgatttttgccgatgatccgaattttcactttattttggttaaagccccggatgtgctgacctatctcaatcatggcaccgtcgatattgggattgtcggttcggatattctggctgagcaagggcatcgccagtttgacatgttggatctcaacactggtcgttgccgcttcattcttgcttcaaccgcagactttgatccaaagcagacgaaacgtaaactcatcgcgtccaagtacccgcacattgcgcaacagtattttcaaaagcaaggcgaggacgttgaaatcatcaaaattgaagggtctgtcgaattagcaccactcactggtatggccgatgccatcgttgatatcaccgaaactggcacgaccttacgggaaaaccacctcaaagtgttcgccgaactcgcgcctgtctcgacacatctcgttgtcaatcgcttggccctgaaacaaaaacgcacagagatttatcagcttattcaatctttacaaaaagttcgccctcaggaggcatcgttatgaaaattttaaccggcacgttaagccagcttaagcaacaagtcgacattcggcgcaccgccgttgcccaaaatacagatgtacaaacgattgttcaggcgatcatcgcgaaagtcagagcagaaggcgactcagctttgcgtacttatagcaataagctcgatcacgttaccgttaatgactttcaggttgaccaagcgctcatcgatgtcgcgcccgcacaactgccggcaaaactattgaaagctttgcagttagcgaaggccaatatcacaagttatcatcaaaatgaaatcgaacgcggtttcgtcgatacgccaaaccctggcatcattcgtggacaaaaaatcaccccgttggctgcagtcggcctctatgttcccggtggcacagctgcttatccgtccaccattttgatgaccgctatccccgctaaattggccggtgtcaaaaagattgtaatggtgacaccgccgcagccagatggccttaatccagttgtactagcagcggctaacctcgccggcgtagacgctatatatcaagtcggtggcgcccaggcaattgctgctttagcttatggcaccgaaagcatcccccgcgttgataaaatcatgggcccaggcaatcgctatgttgcggaagctaaaaagcaggtttttggcaacgtcgctattgatatgatcgctggtccttcagaaatcggcatcattgccgacgagtccgccgatccgattcgattagctgccgatcttttatcacaagccgaacatgaccccaatgcgcgcgcgatgatggtaaccccaagtgaaaaactggcttcggcagtcagcgaacagatcgatattcaattgccaaccttacctcgagaatcgatcgcgcgagcagcaattgaaaatcaaggattcattgcgattgtagcaaccataaacgatgccttttcattgatgaatacaattgcacccgagcacttagaagttcagttgcctgatccgatcacgtatctagctcagattcaaaatgccggatccgtttttcttggtcaaaatgctgctgagccggtcggtgattatgtcgcggggcccaatcacgttttgcctaccgctggatcagcacggtttttctcaccactgggggtctatgacttcgttaagcgtacccagttcattcagtacagctcagaagcactagcaagtcaggcagacgcgatcgtcaccttggcacaagcagaagggctagatggccacgctgaagccatcatcaaacgtgtccctgccgcaaaggaggtttaacttatgcgtacatctaccattacccgaactaccaaggaaacaacgattacgatcagtctcaaccttgatcagcaaagtggcattcaaattgccactggcatcggtttttttaatcacatgctggatgcattcgctaaacatggtcggtttggtttaactgtcgatgcgcaaggtgatttggatgttgatccgcaccacaccattgaggataccggcatcgtgttaggtgaatgttttaagcaggcgcttggcgataaagccgggattgagcgtttcggcagtgcttttgtgccaatggatgaaagtctggcccgagcggttgtcgatctttctggacgcgcgtacctcgtttttgatgccgaattgactaatcagcgattaggcggctttgatacggaagtcacagaagatttcttccaggcggttgcctttgctggtgaattcaacctgcatgccagcgttctgtatggccgcaatacccatcataaaattgaggccttattcaaagcactgggtcgtagtttacgggctgcagtcgccattaatcctgaagtgcaaggcattccctcaacaaagggtgtgatttgaatgattgtgattgttgattacgatacaggcaacacccgcaatgttaaaaaagcacttgattatctgggggtcaacaatcaactctcagctgaccccgcgattatcatggctgcttccggtttgattttgccgggtgtcggcgcttttaaagaggcgatgaaagccttaaatcaacgacaactggtgcctgtcattcaagcgtttgctgctactggcaagcctttgttgggtatctgtttagggatgcagttgctatttgatcgcagcttcgagttcggcgaaactgccggtcttggcctcattcccggcgaagtcgttgccatcccgactgactcgggattagccgtcccgcacatgggttggaacaccaacagcctcacgcaacccgatttatttgctgcggtgtttgccgatcaagcaacttattttgtccattccttctatgcaacaacgctgccacaatttacgctggcaaccattgattatggacaacctctgactagcattgttcgtcgcaataatgtacttgggacccagtttcacccagaaaaaagtggagcgattggcctagccggcttgaaaaagttcaaggagatgaccgaagatgaagctctatcccgcgattgatttgctcaatggcaaaagcgttcgcctcacgcaaggtgattacgatcaagtgagtttaactgaagacccgctctatcaggcacagcggctgacagatgccggatttgcccatttgcatctcgttgatcttgacggcgcacgggcacaacgtccgatcaatcgaacggttattactcgcattcgtgaacaaacctcggcttttattgaacttggtggcggcattcgaacactggctgccatggaaatttatcttacgataggcattgaccggcttattttaggatcggcagctgtttccgatcctgatttggtcgaacaagcgattgcgagattcgggtctaatcgaattgcggttggcattgatacccgcgccgggaaagtggcgacaaacggttggttaaccaccagccagcagacggccaacgcccttctaaccgccatgcaacaacgcggcgtcaccacatttatcgtgaccgatattgccaaagatgggatgatgcaaggcccgaatgcccagttacttgcggacttgcaacaggcgatgccccaagccacgatcatcgccagtggcggcgtcagttcattagctgacttacgccgcttgcaaaccgctggcattcaagcagccatcatcggcaaagcatggcaaacaggcgctattgaattagcaatgctcaaacaaatggagggttaagatgctgacaaaacgcattatcccatgtctagatgtagatcacggtcgggtcaaaaaaggcatcaattttgtgcagttaaaagatgtcggtgatcctgtcgctattgctaaggcttatcaggagcaaggcgcagatgaactggtcttcctagatattaccgcgaccaacgaagcgcgcggcaccttggttcaaacggtcgaagcagtggccaatcaagtctttatgccgctgacagttggcggcggtattcaatcggtcgcggatatgcacgctttgttgcgagcaggtgcggacaaagtctcattaaactcagccgcagtcgccgatccaagtttgctcacagccggtgccgaaaaatttggtcgccaagcgattgttgccgcgattgatacacgttggcaagctgatcaaaatcgctatcaggtcacggttaacggtggccgaacgccagtcgatctcgatgcgatcacttgggcgaaacaagcggttgccgcaggagcaggcgaattactcgtcacttcgatggatgcggatggcactgaaagtggctttgatttgcgactgtatcaacaactcactgccgccgttcaagttccgatcattgcgagtggcggcgccggttcgacagcagactttgtccagttgtttacgcaaaccacggtgtcggctggcttggcagcatctatttttcacttcggcgaattaactgtcccgcaagtgaaaaccgctttaaaacaagcaaaggtggcggttcgatgatcacacttgactgggaaaaagccaatggcctgatcaccacagtcgttcaggatgcaaccaccaaacaggtgttgatggtcgcttatatgaatcaagaaagtttggcaaaaacgatggcaactggtgaaacttggttctggtcgcgtagtcgcaaaacattgtggcataaaggcgccaccagtggcaacattcaaacggttaaaacaattgcagttgactgcgatgcggacaccttgctcgtcaccgttgatcccgccggcccagcatgccataccggccacatcagctgtttttatcgtcattatccggaagggaaggatcttacatgacccaagcaaagcaaagtattccagctctatatgatttcatcaaagaacgtcaagcaaatccagttgccggttcgtacacggattatcttttcaccaaaggactcgataaaattttaaaaaaagtcggtgaagaaagcacagaagtgattgtcgccgccaaaaatccagatgatccggcgtttatccttgaagtggccgacctcacttatcacgtcctggttcttatggttgaacgtggtatcacggttgatcaaattgccaccgaattggctagtcgcgaaggaaagaagagccgactgcaagaacggtcaaaaatcgagaaatattaatgccttgaagagggcatcgttaatagacaaagcgtgaacaggctagttccgagccagcaaacgcttttaaggaggacgccaacatgctaaaacataccgtcactcatttacaaccttacatccccgaaaaacccctggcagatttggcgcaagaacgcgcattgccgcatattgttagaatgtcagcaaacgaaaatccttttggcactagtgacaaggtacaaacagcgatcaaaaactgggacttcacccaaagccgtgactatcctgatggcaatgctagccgtttacgatcagcggtctcagctgaactgggcgtcactgaaagccaacttgtatttggtaatggtttggatgaaatcattgagctcattgcccgtacttttttagaggctggggatgaagtggttgagccgtggccaactttctccgaatatcagttgcatgcccagattgaaggcgccaaggttgttaacgtaccggtacaagcgacgaccggagcatttgatcttgaggcgctggctcaggcaattacccccaaaaccaaactgctttggctttgcaatcctaataatccgacaggcaccctgctgtcactgactgagctagaacagttcttacagcaagtgccaccaagtgttttggttctgattgatgaagcctacattgaatttacagacgattatccggctaccagcgcacttaaattgttaccaagctttgctaatctggttgtcttgagaactttctcaaaaatatacggcttagccaattttcgagtcggcttcgccgttgtgcctgagcaactggcagcgaccatgcaaaccgtccgcctgccatataatctgagcagtgtggcccaactagcagcattcactgcccttggcgaccaaacatttgtccagacaacccgtggacaggttcggcaggcacgggaggactgggaacggtttttaacgaaggctggtctgccacattatcaaagtcaaacgaacttccaattttttcaggcaccgcagaagcaagcggccgctttgaaggaacagctcttgaatcacggctttttggttcgtgatggcttaaagccaggatggttacggatcacttttggtaccacagcgcaaaatatagccgtacaacaaatcatgactgcgtttcagcaagcaaaaaaatagcgacaacgaaccaggtccgacccttttaagcatgtgcatcaccaccaagggatcgaatgcttattgacctaccaattttttcaacgctgctattaagctcatcgttgcggtcacgagatgacattagcgaaaactaatcatggactaagcagataatgtcaccgcttctattttccgcataaaacctataccattttgaaaaacagctaggaaagcgcccacatttggcgtattctgaagatgtccaaaaaatctaagaggtgaatttgatgttggaaaacaataattttgatgaagttgtccttaaacgccacaccgcccgtgaatttgatccggaaatcaccattagtaaaggcgagttgttacaaatgattacttatgcgacaaaagcgcccagtgccttgaatatgcagccaacgcggtttgtcgtcgcacaaagcaatgcggccaaggaaaaaatcgccgaagttgctggcaccaatgcaccggaaattttatccgcgtccgctgtggtacttattggtggcgaaaccgacttgggaccatttgaggaggatctgttcaaacgggcggaagcggctggtttattgactgatcgtgcgattgagcatcaaaaaccaatgattgaaaatcttgttgccacctttaaagaaaaccaacaagcattacgcgaatttattattcaaaacagtagtcttgcggcaatgtcgttcatggtggctgcccgcgcctatggctatgaaacaggtgccatgacaggtttcgatcacgaaaaaattattccggcacttgatttggatccgaatcatttcttgccgacattgctgattgctgttggtaaaccaaagagtgcaccggactcactgtatcggatcccagcaagcaaaatcactgttttcaaataaagtgctacaacattgcacaactcaaagatgatcgccgtcaatgatttcagcatcaagtgggtgcgggcgtcatcacaaactattttgctggacgttgccatgattaccaaaaaggccgcttgtttacgcggcctttttggtatcgtcaccgctagtcattgctttttagtttgagaaatgccacagcaaaacaagttttcacaaaaaggagttgggttgattgccctataccattaaaattaatgcaccgttaagtgttcaacaggtccatgatttgtatcagcaaacacatttcaataaaccgatcaacgatccgacccgcttgcagacgatgattgacgaaacacccctggttttgagcatgtgggatggcgcaaagttgattggctttgcacggtgtctgacggattttgaatattgctgttacctaagtgatcttttaattttgcctgcctatgaaggtcatcaccttgggcgtcagctcatgacaactttgcaagcttatatcggtccgcgggtcacgctgtcattgaaggcagcagattcggcgatcggcttctatgaacgcatcggattgctaaaagccgataacatgtttcgaattggcaggagggataaccatgattaaaattgcaactaatcaggccattaccgctgaccaattcattcatgtcctaacagcatcgggcatcaaccgaccgactgaggatcgcggccgcatgcaacgcatgctcaacaatgccaacgttttattaacagcgtgggacgatgaacagttaatcggcgttttacgcggcgtgtcagatcgctcctattgtacatttgtgtcagaattagctgtaacgaaggattatcaacatcaaggcattgccaccaagttgcttctccaattacggacaatgcaggggccaaatgtctcgatcatgctgttatcagcgcctagtgccatgactttttatccaaaagtcggctttgaatcggtgccaactgggtttaaggttcaacgccggtattaatcggccgactgaggatgtgccatcacggacagcgaccatataaaaaagaatgattggccgtctttaggaaaatcattctttttttcttgtctataatctaataggacttaaggatcgtcatggcaaggcagagccgtcgtaggccagatatagctaaaaatgtcgacgtttgggaccgatgttgttttgaattttggcccattagcgctgctcgcgtcaactaaagaacagaatggctcaccacgaaagcttgcgcagccggtgccagaaccagtaagcaacaccaatgagcaacaaaccagtgaccacaaaaatgcggccaattggcacctgatctgccagtggtccgtagaccaacatcgctaatggataaattcctgtcgataggatggcccaaagcgaaaatacacgacctaacttatcagcagggacattttcctgaagataaatggtttgaccggcttgaatcagtgggtaaaaaattccggaaacaaacataaacagtaaatagaagctaaaggattacggcagtcccatctcggcaaaggcaagaccactgccggcaaagccgatggcaatcaagccaagttgatcgcgaaaatgtttgtgacgggcgatataaaggccgccaagtcccgcgccaatggtccaaaaccactcattaaacgtcaaatgccaaacttctgatccaaatgtccgattaacatacaatgttgataattgtgatgaaggggcaacgaggataaacgccaacccagtaaatagcatgaaggccagcaaaatcggtgtccgtctgacatattgcaacccggcgagaatcccatcggcgcgtttggctgctcgatcatgactggcactcggcgttggtacgtgcaccacactcaaaaacaggatggccaacgcggcagataaggcgtctaccacaaaaatccaaaaaatcccaaggtcacttaaaatataaccagccaacagcggcgacatcacgagcatggccgccatcaggatttgattgtaaccatttacccgcgtgagatgcttggcagggaccagttgtggcaacaaggcattcgctgcgggattttctaaaccgttgccaaaactacgaatcacagcaattacgagcagcagccaaagatcttgcgtcataaaagcaaagatagacgcaactaataatgtcagtaaggtgacaacagccgccgagagcacaattaacattttacgattatagcgatcggccaacacgccagccgtgagcgagattaaaatcgctggcaacgcggtcgccagcgagacataggtcatccatgcccctgacgacgtttttagcgcaatatcccacaacacagcatagaacacggtcgaactgccaaaaacaaataaattttgactgagaagaaacgctgctgtttgcgcttgccaacctagatttttatgtgacactctcaacacccgaaatcagttagaatagaaactgtccttagtgtaaatcaaagtgatgtaaaaacctatgatctagcccagacgaactattagcacgtttgaatggtagtttctgactcacaaaacaagttgaagattcccaaggggatgtatacgagatgacacagaaaatttttattgtcgaagatgacgcggtgattgccaaaacgattagtgattacttaaatcgctgggcgtttgccgtcagcacggtcaccaagtttgaccaagttgacgcggaaatctcagcggcggcaccagacctagtcatcatggacatcagtctgccatattttaatggttttcactggctaagcgagttacgcaaacatagtaaggtacctgtcatctttttaacaagttctggggatgatatgaaccttgtcatggcgatgaacttaggagccgatgattttctggctaagccgattgaattgccggtgttgctggcgaaaattcaagggatgctgcggcgcacttatcaatatcagcaaatcgacaccaatttatcgcacggcgcctttacgctcgtgccgaccgataatcagctaaaaacggctaagcaggttgttgctctgacaccgactgagacaaaattgctgagtcttttgttcagcgctgacggtgaggtggtgtcgcgggaagcgatgatcgaaaagctgtgggaaggcgacgatttcattgatcgcaatgctttagccgtgaacatgaaccgtctgcgcaagaaagtcacttcaattggtttggcgcaattaattgaaacggtgaagggcaaagggtaccggttggcaagtgagggaccaaagccatgatgaaagcttattgccgctcgcgttgggtaatttggttgctgctagcgatcttagtggcaacaggctttttggcaagctggttgttggccaactcctttgagattgtcctgaatatgtggttttttgcgacagcgccactggcagtgattgtgagcattgattattggcgctttcgccgtgaatggcagcaactgcaagacgatcacccaattgatcctgtgcagatcacggatccattaagcatggcttattatcaaaaaatccaaacgctgacccaaaagctgcgcacaaccagagatactgcccacgaacaagaacaagaaacgctcgacacgctgcagctatggacacatcaaatcaaaacgccgctgaccgcgttagatcttctattgcaagtcgaacctgttaacgccaaagatgcccgacttgaaatcagcaaaatcgatcggtatcttgcggtcatgttgaactatctgaagctgacaacattaaataccgatcttgttttaactgaactgccactcaaaccgttagtcaatgagaccgttcgtgacttggcgaagctgtttatcgccaaggacctgaccgtgactgtggggccattgccaactgttattagtgacagtcaatggctgcattttatttttgaacaattgctaaccaatgccattaaatataccccgcacggttcaattaagatttatgccaaaggggatgctgtcatggtggccgacactggtatcgggattttggccgaagatttaccgcggatttttgaacaaggttattccggctacaacggccgcgcaaatcagaaagctagcgggttggggctatttttgagcaaacaaatcgctgaaaagcttggcctgacgctaactgtcacctcagaaattgggcaaggcagcacatttgccattcattttccccaaacgcggtggcaagtggagtaagctagcttaccagcttgtaagcaactacgagtcactgtaagtaggcatggggcatcatccccgctaagctaataaatgaaaggggacgatcacatgtcaacattacttaaattaaaaaatatcgaaaaaacttataccagtcgcggggctcagccggtgcgtgccttgacgaacatcagtttcactgttgaagccggtgaatttgtggcaattatgggtgaatcaggttctggcaaaagcaccttactaaatctgattgcaacgctggacgatccaaccggcggcgatattagtctaaacggacaggatctgagcaacgtcaaggaaggcgcccgggctaaatttcgccgagaacatctcggtttcatctttcaggatttcgacttgcttgacaccttcaatgttcaagacaacatctttctcccattagtccttgccaagaagcctctcgaaattatgagaaatcggctaactaagctcgcaccacgactaggcattgatgacttgctgaaaaaatatccttacgagctttccggcggccagcaacagcgcgtggcggcagcgcgcgcgatgatcaacgagccagaaattttgttggctgacgaacccaccggcgccttggattctaaaagttctacagaactgcttgatctgctcacagatgtgaatgccgaaaaccggcaaacgatcctcatggtaacgcacagtgctgtggcggccagtcacagccgacgagtattatttattcgcgacggtcaaatttttcatcaactttatcgtggggatctcgatcaaccagcctttctaacccgtatcagcgagacgatgaccgccatgctgacaaaggcaggcgatggacaatgaaattctactttaagctcgctgcaagtaacttgaaagccgatcgccgcctgtttgttccgtttgtcaccaccactagcttcctgatggccgtcaacctaatcatgctgaatgcttacgccagtagtgatgtcttgtttaaaaagctgggggcagccgctggcaagtcactgttcatgttcggcacagatgtcatcgtgattatctctgtgattctcgccatctacgcaaacaattttctgcgcaaacagcgtattcgtcagttaggactttacaacatcatcgggtttggcaaaggtgaactcggcaaaatgatggcagtggagaagctgctgctgttactaaccactttactgttcggtggtattctcggtaccgtcctttcccgcatcagctaccttacactcgccaaaatgctcaaagttgaccacaatcttgactttgggttaagccagcaagccttcagtatcgccgggatcattaccatcggcttattcgttgttttgctgttagttgatgaactttggctcattcgcaaacggccaatcgaaatcatgcgagcacaacgagcaggtgagcgggagcccaagacaaagtgggtgacgctaattgttagccttatcgccttaattgccggctactatatcgcggtcacgacaacaaatccactacaagcaatgagtatgttttttgttgccgtgatcttagtcatctgcggcacttatggactgttcaccgccggatcggtcttcgtcttaaaatggttgcgaaaacgcaaaaattactattacaaacccaagcattttatcaatgtagctaatttactctatcgtatgcaacaaaacggcgctggccttgcatctattgccattttggtgacgatgaccttgattacgctcgccagcacggccacgttgttcttcggtatcaatgaagtcgtcaatacgaatacgccggttgatttgtcatatgttctcaaggcaaacgacaccactgcacccggcaaggtggcacggatggccagcgcgaatcatgtcatcatcaagtcgcaacacacttttgttggaccgtccagtacgatggctttacttgatggcaatcgtcttgaatcgcaggccaatgtcaatggtccgttcagtatgggcaatgcgcgctcggtgcaattgatgaccattgagagctacaaccgctttaccgggcatcatgcccgcgttaagtcaggggaagtgttgatctatacatccaaaaattttcctagcaagaccattcgcattggtcaaaagacttacaggatcggaaaacgtgcaggtagctttccaaatgcacaggcgacttttatccccaatctttttattgcctttcctgaagagaagcaaatgatcgacgccatgcagcatctgagaaatgcacgctatcaaaacgcggctgatgcgcaagctgatatcaccacaagtcaagatgtgatgttgcaaggaagccatgccaatcagcttaagctctatgaagaggtggtcaagagtcgtatcgctgaatcggcctcagttcaatcgaaagccgtgaattacgatgagaccatgagtatcatgggcagctttctcttcctcggcatcattttcggcgtcaccttcattttggcaaccttattgatcttgtattataaacagttatctgaaggctatgccgatgcccgccgctacacgatcttacaacgcgtcggcttaagcttgcgagaagtgcgcgcaaccatcaacagccagttactaatgctgttttatctgccattactcgtggcaggaattcatgtcggatttgcattgccattcattcaacgcatcatgatattgtttggcttaccgaactggcagttcttcctgactgtctcactcatcacacttggtatcttcgcgatcatctatgtcctcatgtacaagctcaccggtaacgtgtactatcgcatcgtctcgcgtcgccaagctaccagtcgcagctaactaaaaaaagcgtcgaaacgccagtaaaaatactgtcgctcgacgcttttttcgttgatgccagcaattaagccggctgcaatgccttgatttcatcaatgatcttcaacagcgtttgctcagctgtttgatagtccgccattttatcggcaaactgctcgtcaaaaccagccaacccgccagcagcaaaggcatactcataggcatacaccgtttcataggcggccgcaaaccgctttagcaaatcatgatattgttcgccgccaagttgcagcgccatctgaatcacgcgaaagtccgtatacgccatctcaaattgaactgcccatgcccgcataaaatcatgtcgggcctgaatatgcaggaaatgatgctccgttgtccatgctaatcggttcactgaatctttaacatctaacacaatcaatcccaccttcccgtttcgatctgactcaattataggctggtctggcgaaataagctttcaaaagactcgatgatcaacttcagtaaccatctctcgtcaattaagcttgttcatgcccgcgatcggttgcttttgcggccgtttcagaaacctcacgcaaggcttctttaccgcttttatcactgagattgatatacagatctgttgcacttgtggtcgtctgcccgagctgatccgcaacctgctgtacatccttggtgaccgtataaatattggttcccaaagtgtgccgggccttatgtggtgttgatggtcgaccataatcggttgtataacgcttgaaaaaggcttcgattgtattttggcgaatccgattgattttttggccgacaactgtcacaaacaggggagaagtcggcttttgataaccgataatagccgctcgctgcgttaagtaagcctgaacatacggatcaatccagtctgcaaaattgacacgatcctgaaagttgcctttgcgaacaacttggaccgtatgccgatccatgttcaaatcttccagattcatattcaccaattcgctgacacgaacccctgagccaaacagtaaggcaatcatggccaagttgcgcacttttgtcacctcaaaatagcgccgcggcttggctggcagttgttgcgcataactttgatccaaccactgtaaaaacttagcatcttcaccgtccacaaacagcatttcctgtagcttgtggtttcggtaactcgcagtttcagtatgggttttaagttttaccttgttccagacattccgatagaaataaggttcgccatctgcatggggttcactttcctccgtcaaaaatcgataaagcgccttgatcccgactaagcgcaaagcgacactgcgacgcgtcattcgcttgttgtggtgcgtcttggaaggccgttcaagcaaatacgccataaatgcctgggcatcacgcaacgacaaatgttctaacacggtcagcggcacggtttgcggtgaggaagcggccgtcacaccactgttaatcagccagttcagaaactcttgataaaaatgtaaatactgataaagcgtcgaatcggcgatcgggatcgctttttgactctgataatagtcctgaatgtaatccggcagggcaggtagcattgtatgaattaatttcgaataattttgtgtcgacacagatttcaccttgaacgtatgttttcttttagataatgttagtatacgcgaaaacaactgtacttggcgagggctagtgttgatgaaaaatgaacggtggtgctggttcagccattgctctgccatgtgaagcagaattgaataaagttttagctttatccaaaggtgagcaaagatgtcagcaaacgcctgttggtcagacaaattttagctggcataattctggcatgaattcggctattaaatgagttcacttcggtcaatcattcagcaaacttattttggccattggtcaacaaaataagtttgctgaatgttacgtgaccctcaattgttgttgagtcaatttcaaactacacaactcaaaaaatcatcaagcaactcgaagccggctaactgacgagaatctcacaacatcatgaagcttgaattgatatgcatttttctggttttggctggcatgacattttcaatcaaacaaatgcatgcaactcagcgcaaacgcaacgtcccaagtcataattgattgccttggtaaaaaatgcaatcgccaccaccaacattacgtccggaccacaaatttttgacagccatctgaaagaggggacacccagattcgcagatcaagtggcaaagccaattatttatattctagtttacataatatatattatgcgaagtatcgtttgaagagacggcatcgtgtcattctcgcaatatttacgttggcgattatttgattcgcaatttcatacagcacccgatagccgcctcattttttgaaccgctgcttgcagccaagtctttaaaagtttctacaatcattggataaatcattggatattttttgcttgagttttttcgttaagtcacttgtgacgaacaacttatcaagttgaattcccgaactcgtctcagaatgcgtctctcagcatgcctcaaaaccagccaaaatgacccatgacgacttgctgttgattcgacccgcgaattgctacacaaatttcaaattcacgcatcacgagctgcgagccagctttatatttaacagatttcgcaaaagatggctagagactttttgcaaacaaaaaagccgcaactggctagctgcgactttccttagaacaattgtgtgcaattaaagatgaaagttaaccttcaaacgtgctctgcattggcggaacgacctgctttttgcgggaaacaaccccaggcaatgccaaacgcgcgtccttgtcgaactgttcgttaaaagcactggcgattttatcgcggtcagcaccgactgcgaaaccagttgaattgctgtccaagatgtcagtggcaatcagcaggaaatcgtcgtagcctttcgcctgcgcctctttggtcatggcactgaccaattcgtcctgacgtgcgtaaatgtcattcagatcgacggtattgacctgtccgatgcgaatagacttgccgcccatggtgaaactcttagcatcgccttcgataatgtccatatctgacttggcggccaaattagtacctgccttcagcatggcaagaccatatgactgcaaatcaattccggcaatcttcgccatttctggcaaaatcttcttatccttatcggttgcggtcggcgacttcaacaacagcgtgtctgaaatcaaaccagaagccatcaaaccagccaatgttggcgaaatcttgaagccatattcctggaacatctcaaaaatgacagtattggtgctgccaaccggttctgctcggtaaaacagcggcgctgccgtgtggaagttagcgatgcgatgatggtcgacaacagaatcaatcgtcacgtcttcgatatcactgacactttgttgaaattcgttgtgatcaaccaacatgacatgatccgtctcgttggctgccgtcttgataacccgcggtgcctgaaccttgaagtgatcaaagacgaacttagtctcatcgttcggttcgcctaatgctaccgcttcaacatccgtgttgcctgcctgtttctgaaattctgcccagctcatggcactcgtaatcgcgtcggtgtccgggttctgatgcccaaaaatcaaagtcgtcatcttatctgatcgctcctcaactgaatagtttacttatcaagtttaacacggttttcactgacccgcgacaagtaatctttttccttcagataatcgtcaaaggtctggaagaagttcgagatccgcggaatgtcagctttctctttgcgataaacaaaagaaatctcaaaacgaatggccggatcaaacgcaatagcataggccttgatttgatcagcgcgtgcccgaacaaaactggttggcaaggccgtgttgacccctgacaagttaacgaattgggttaactgatatggcgtggtgaaatgtgcgaccacgtgcgggaaatcaaccatttgattcttgtacgcctcacgcagaagctgtccaaggaaatagtcgtcaggataagttgcccaaggttcagctaaagtatctttgaaatggattcgcttacggttagccaatgcgtcatcgtggtgcaagaacagcaattgttcatcaataattttcttgctggcgtatggtttccagttcttaatggtctcatctggcagattcatgatagccaaatcaatctggttgttttccaaggattcccaaatttcgtgacgggtcatcatccgtagcgtcacttcaacttcaggattcagttgatagtaatgagcaatgaacgcaataaaggcgctatcctcgattgagcttaataacccaatattgatttttccgacggttgcactggttgtttgttgaatttcgtcggttgtctggttcaagatctcgtagatctcatgggttgactttaacatggtctgaccagcgtcagataaatgcagtttcttcccgacagaataaaacagcggtgcccccaccgtccgttccaatttcttgatctgctgtgttaaggctggctgggtaatgccaagcaattgggcggcttgggtgtagttcatggtttctgccaattgcagaaaataagttagtgtctttgaggaaaaaatgcgctcttgtttcgttttcatagggcggcttccctttcgtttataatttaataatatcgttcaaccatcatcataagtggcaatgaaaaaaaacgcaacgaatttgccgcgtttttaatcgttacgttaagttctagctaaaaattcagttgctcgcaactggtttcggacgccagctttgccatccggtataatccttaacgtgcagcagattctctgcattcttaacgcgatcggcagacggcggttcgatgccttcaagcgggtacgtaatgccaagctcgtgatactttttaacgcctaatgtgtgatacggcagaatctcaactttttggaccacatttttgtccaatgtcgcaatatagtcccctaaccgtttgagataagggtcaaagtcagtgcgttccgggaccagaacgtggcgaatccacatgtcatcagcatgcgccgacatatactgcaccatatccaaaatattttcattaggaaaaccggtgagctttttatgctcggccgaatcaatgtgtttaatatcaactaatgagatgtcagtaacagccatcagcttttcaaactggccaaaccacggttggtcacgcgtgaaggggccgcctgacgtatcgaggcaagtcgaaattcccagtgccttagccttggtgaagagttcgagaatgaaatcgatttgtaccaaactctcaccgccactgcaggtaatacccccttggtcaccccagaatgctttatagcgctgggcatccgccaaaatttgatcggccgtcatttcttcaccaaccccaatgttccaggtgtcagggttgtgacaatactggcaacgcatgcgacacccttgcataaagacaacgaagcgaataccagggccatcgaccgaaccaaaactttcgaccgagtgaacataccctttgatcgggccatcatgatcctgaccaacttgttctaagatatttaatgggctttgtgactgatcgatgagtttcatcttattgcctccactacaacatcatgtgtcgttttcaattgattttcatttcattctgccaaaaaacggcaacagcatcgttgccgtcttttggcaaaacaggaatggcttcctgtcttgagttaagctgcttacatttcttcgaagaaggtccgagcaatgacatcgtcttgttgttccttggtcaaatctgcgaagtagacgcagtagccagaaacccgaacagtcaatgttgggtattcttctgggtgcttctgagcatcaatcagggtctccttgttgaagacgttgatgttcaaatgcatgccgctgttttccatatagccgtcaaccatgtgaaccaaggtatccttacgagtttcatcatcgtggcccagtgtgttcggagtaaccccaaacgtattactaatgccgtcagttgcgtaatgatacggaatcttggcggtggacatcagggatgccagcgcgccgttcttttctgcgccgtatgccgggttggcacctggtgagaatggttcgcctttttgacgaccgtttggtgttgtccctgtattcttaccataaaccacgttggaggtaatggtcaggacactggtgctcaacttcgcgccgcgatacagatgatgcgtgttcatcttgttatagaaggtcttaaccaaccacttagcgatgtcatcagcgcgatcatcgttgttaccatagcgtggatagtcatcattgtcagcaacgaagtcaactgcaacaccgttttcatcgcgaattgccttgacatgaccatacttgattgcactgatggaatcaactgcgtgtgataggccggaaatcccggttgcgaaggtccggttcagttgggtatccttcaatgccagctgtgcagcttcataataatacttgtcatgcatatagtgaatcacattcaaagcattgacatacgtgtcggccagccagtccatcatcttgtcgaacttattcatgaattctttgtaatcaatgtaatcgctggtgatcggtgcatattcaggccctacttgcgcttcctgaatttcatctttcccaccgttgatcgcatacagaactgtcttagctaagttagcacgggcaccaaagtattgaacgccatcagcaattggttgcgccgagacacagcaagcaataccgtagtaatcggtaccccattcgttgcgcatcaggtcatcattttcatattgaatggttgaactttgaatggatacttcggttgcatagcgtttgaagccttctggcaagcgttcgctccaaagcaaggtgatgtttggttctggtgctgcgcccatgttgtccaaagtcttcaggaaacggaaagccgtcttggtaacgtggtgacggccatcattgcccattcctgccaatgacaaggttgcccagattggatcgcctgagaacagtgagttatattcttcagtccggatgaaacgaaccatccgcaatttcataaccaaatgatcaatcagttcctgtgcctgttcttcgttcaatttgcctaagcgcatatcgcgttggatataagcatcaataaccgtatcgatccggccaacggacattgcggcaccgttttgagtcttaacagcagccagatagccaaagtagatccactgaacagcttcttgcgcattagctgccggacgcgagatgtcatagccatattccttggccatcttcttcatgtcgtttaaggcacgatattgttcattgatttcttcacgcagtttgatcacgtcgtcagtcatttcgccgtcgccggtcaagttataatccttgaacttctcggccatcaaacgatcgatcccgtaaacagcgatccgtgggaaatcagaaacaatccggccacggccgtatgcgtctggcaagccagtcacgatcttgtaatggcgagcctttcgcatatcaggggtataagcatcaaagacaccttggttatgggtcttacgatattcattgaaaatcttgtgttcttgaggatctgtcttgaagccataagattccaatgcatcttcagccattcgaataccgccaaatggcatgaatgctcgtttgaatggcttgtcggtctgaacaccaacaatcttttcaagatctttgttcaaataaccagggccgtgtgaggtgatcgtagatggaatattgttgtcagcatccaaaacaccgccatttgcacgttcttgtttctttaaatttagaacctgattgttcaggactgttgtcgcttcagtggggccagcaaggaaactttcgtccccgtcatattggttcaggttatgctcgataaaatcgcgcacattaatttcttcttgccagtcgccgccgttaaagccttcccaataattaggaactttgatttcgtcaagctgtttcatagttgtttgcctcctaaagtggattacagatgtgacagttcttacaaacacagtataacacgccgccaaatctatgcaagcgttttattgcccatataataggcgttatattgttttttaagtgtgattagtcgcttcttttcgcccatgatttcggcattttgttaaattgtacacaactggtctgtcctataataatcaaaagcgccgccatctgtattagtacagacggcggcgtcaatgatcaccatttattcgacttgatctgctggttcttctttggtttgaacaaaaactggcttgccaaggacatcagtgtcaatgacaaacgaaccattcgaatagcggtcacccgctggatgttgtgccggattaagggtcgttaccttacccgtatcggtcaaaatattcaggcgggtagcgtcatcgactgacatcatcgcgacaatccgatgcggatcacgcttaagctcacgcaagaccagtaaaccacgacgggcacgactcatttccccgacctcgcttaaggccatctttttgaaggcgccacgttgggtcaaaataccgaccttagccgtagttggatccttcactagaatgaaattgacaacctcatcgtctggctttagatccatacttttaacgccggttgcccgggcaccgacagttgacacatcgcttaacgggaatgtcagtccataagcgtggcggctgaccacaaagacatcctgttgctgatcagtcgtgaagtatgcattggtgacaatcgcggctgggtctttcagcttcatcgccatcatcggcttactcttgtacgtccgttgtggctgcaaatcacttaaggcagtttgtttgatgtacccgtcacttgaccctaacacaaaactgccagcgccatcgagttgatcaaaagcaaacactgccaagactttttcgtcagtgccaaggccaactgtttggcttaagtgttcgccggtgtctttccaacgcgcatcactaatttcatgcactggtcgataaatgacatttccggcatttgtcacgatgtaaagatgctgcaacgtactcagttcgccagtgaaaatggcaagatcattggccttcaaaccattgtcggccggatcaaccgcctgataactgcgcagtgaactgcgtttaacgtagccatcacgagaaacctgcaccatgacggtttcatcagccaccgtcaccgttgtcgccacttcaagcgtttcaattttggcttgaatgctgctgcgacgatcatccccgtactccttggcaatccgcttcaactcgccttcaatcacccgatcgcgggcagcggggcgggccaaaatatcttgatactcggcgattgctttcgccaattgtgctgcttctttctgtaaagccgtgatatcggtattggtcaatcgatacagctgcaaggaaacaatcgcttccgcctgagcttccgaaaaatcaaacttcttgactaagttacgcttagcatcacctttatccttggaagcacgaatcgcggcgatgacctgatccaaaatcgatagcattttgatcaagccttcgacaatatgctgtcgagcagcggccttgttgaggtcaaaacgcgttcgccgagtgaccacatcgcgtcgatgttcgacgtatgcttccaacatggccttgagacctagcaacttcggctgcatgtcggcaatagcgaccatgttaaagttgtatgcaatttgtagatcggtatttttaaataaatagtttaagatgccatgtgcatcggcttctttttttaattcgatgacaacgctaagcccaaaacggtcgctttcgtcacggacttcggcgataccgtccacttttttgttgatgcgtaattcatcgatttttttaatcatctgcgctttattgacatcatacgggatctcagtgaccacgatcttctcacgaccgccacgaatggtttcgatgtgtgtccgagaacgaaccacgattttaccgcggccggtttcgtaagcttgcttgataccatcaagcccttgaataatcccacctgttggaaaatcgggacccttgacgtattgcattaaagtatctaaatcagcagtgggatgcttcagcaagtataagaccgcattgatcacttcgcgcaagttatgcggcggaatttcggtcgcgtaacctgcagagatgcccgttgcaccattcaccagcaaattcggaaatcctgcgggcaacacagttggctcctgtgccgtgtcatcaaagttcaacaccatatcgacggtttccttatcgatatcggccagcatttccttgctgattttgcttaaacgcgcttccgtatatcgcattgcagctggcggatcaccatccatggaaccgttattcccgtgcatctgaatcagtggggcccgtaacttccaatcctggcttagccgaaccatcgcttcataaatggagctgtcgccgtggggatgataattacccatgacattcccgacacttttagccgacttgcggaagcccttatcatacgtattgccatcttggttcatcgcaaataaaatgcgacgctgaaccggtttgaggccgtcacgcacatcaggcagcgcccgttcttgaataatgtatttcgagtacctgccaaaccggtcgcccatgacctcttctaaggtcagttcttgaatctgattggccaatggcttttactttcctttcttgtccagttgtttgacgatttgcttggcaccaaactgtaatttttcgtgattagcagtcggggtttccaaaatactgccgtcgtcatccatatcaaacttgacgttatgctcaatccattcacgacgcggctcaacgcgatcacccatcaaagtggtcacgcgtcgttccgccagctgagcatcgtcaatccgaacccggatcaaagtccgcgtctcaggattcatagtcgtttcccaaagctggtcggcattcatttccccaagtcctttaaatcgggtcaatgtgtaacccttgcccatggccttggtctctttggccaactcttcatcggtccaggcataactgatcttggttttagcaccagcgcctttttgcaaccgatacaatggtggcaaagcaatgtaaattcggcctgcgtcaatcagcggccgcatgtagcgataaaagaaggttagtagcaaaatctgaatatgcgcgccatcagtatccgcatcagtcataataatgattttgtcgtagttggcctgctgcagatcaaaatccgcaccgacaccagcgccgatggtgtaaatcatcgtattgatttcttcgtttttaacgatgtcctgtaacttggccttctgggtattcagtacttttcctcgcaatggcaagatcgcctgaaactttcggtctcggccctgtttagctgaaccaccggcagaatccccttcgacgagatacaattcgttacgcttagggttcttggtttgcgccggggtcaatttaccggaaagcaaaccttgatccttcttgcgcttgcgtcccgtccggctatcatcgcgtgcttttcgagccgcttcccgcgcatcacgggctttgacggctttacgaaccagctcttgcgactcttcaccgttttccatcaaaaaagttgacagcttgtcatagacaattccatcgaccacagtgcgggcttgcggcgtaccaagcttaccctttgtctggccctcaaattgcaaaatttcttctggaatgcggacacttaaaatacctgcaaaaccttcacgcacatcactgccttcaaggttcttgtcgcgttccttcagcaagccgacttttcgggcaaattcattgaatgctcgcgtcatgccgctgcgcaagccaatttcatgcgtcccgccatcaccagtgcgaacgttattaacaaacgaaatcaggttttcagaatagccatcgttatattggccggcaaaatcaaccacgataccgtcctttttgccttcaaaattaatcacctgcgacaatgcatctttgccttcgttgaggtatttaacaaagctgaccaaaccatcaggatagtgataactgtcgtgcttaccggtgcgttcatccgtcagattaatcgtgatatttttcagtagaaaggctgattcgcgtaaccgttcggccaaggtatcataactgaaaacagtggtttgaaaaatagtcggatccggcttaaacgtgatggtcgtgccattcggttcgttgacttttcctaacttctgcagcgtgccatcaggatgaccgccattgatgaaatgttcttcaaatgcgcgcttatcccgcacaactcgcacggttaatgattccgataaggcattgacgacgcttgagccaaccccatgcaaaccaccagaagttttgtaactattttggttaaattttccgccggcatgtagcacggttaaaatgacttcaatcgtcggtttgccactcgggtgcatccccgttggcatcccgcgaccatgatcctgcacggtcacagagttatcggcgtgaatcgtcacattgatctcatccccaaaccccgcgagcgcttcatcgacagagttgtccacgatttcatagaccaagtgatgcaaaccgcggccatcggtggaaccaatatacatccccggacgcttccgcacagcttccaagccatgcagcacctgaatggatgaatcattatatgcttgcgttgctttatccatagtaaactcccttttttgaacaactaagttatagaatacaccacgcgttgagatttcagaaataaaaaataagagcgcgagcaggatcggttagcaaccggagtgtaagcggccttggacgtgatggttgggttttgaccattgcgaccaaggtccttacacgcaggttgctgcgactgtgagcctgcttaagcatcaagaccatcaacagcagacctcaccgtattgctctcaggactcctgttttctcctcaaaatcgacccagttggctaataccatcattgttcatttaaattttattagccgtgtcaatggcccaaagctcagcagaaaaccgcacttccctaagcatggcacataactatgacttcttgacgtgaaattcatcgcccgctggcaccatatctacgctgtgccccgccatgatccttgcacaagacggcaccaaatcgcgccacaacccgcttcacaggttttattcgaatgtacgttcgttttattctactgacgtatcactcaaaagtcaaaaatgctaaaatagtttctagtttgagaggaggggcacatttgatacttgtgctttgttttatactcgcgtatttcataggcgccatcccgtttggtgtggtcattggtaaactcttttatcacacggatatccgcaaaggcgggagtcacaatattggcaccacaaatgcttatcgcatgttagggccagtcggcggctcaattgtcttggtgctggatatcttaaaaggcacgttggctgccagcttacccattctctttggcatcgagcatcattggctggtgctgatcgtgggtttagcggccgtattcggccatacattttcgatctacattcgctttaaaggcggtaaggcggtggcaactagcgctggcattttacttgcatataatccgccattttttgtcattgcatttgccatctggttcagtttgatcttgctgacgtccatggtcagcgttgccagcacactgggtatggtgttgatcacagcttggtcgctggtttaccatgattggttgctgacaactgttgcctgcgggttgctggttgtctttttgatcaaacatcgggcaaacttcaaacgcatcaaggccggagatgaaaatatggtgccctttggcttaggccaatatcttcgtcaacaccggggccgctcttagtcaccttttaatggcaaccaaaaagacatccgaaactggatgtctttttttcatgtacctaatcgacaaactgatgacaccttagaaaatgctgatcatgtaacccttctcaaatgccgtgccaggttcaagtcgattgatcccgagtttgcgcgtcaggtcgccagtgctgccaatcgtgtcggcgatgccccaccaaggttcgatgcagacaaagtcgccagtggttggatacggactccaaacgcccagatatggggtatcggtcatggtaacgctgacaccatgtttcgtcttgtcagaaaccaagttgaaggttgtcttaccaagcaacgcgaaaattaaagcatcatgatcaaatgtttcgtgcgttaaggccaaattggcatcagttgcagccaaggtccggtgcgtgtaatcaatgccttcaccagcaaccaacggaatctgaacaagcgacttacgcggtttgaagttcaaataataatcggagaattgagtatccggcgtcattgggaccttgaagcccggatggccgccgatgctaaagaacagtggctcacttttgtccggattgtcaacgtgatacgtgacatgtagattgttattttctagtgcaaacgtgatgattaaacgaaaagcgaacgggtacatcgcccgcgttttgtcatcatccttcagaacgaagctcgctttaaacggtgtcgcagagagcaccgtgaaatcacgatcacgggcaaaaccgtgctggcccatgtggtaagtcttgcctgcgtaatgatattgattgtcagccagcgccccaacaatcgggaacaagaccggggcgtggcgaccccacaccgcaggatctgcttgccacagacgctccctgcctgtcaggttatctttgatactggtcagttcagcaccatgccgactgattttaactgtcaaaaagtcatttgcaatcgttaccatacatcctcatcctttacctacaacattattgttaactacaaaatataccgcgtcatgtttgaatcagccgcaatatggccaatcttgtcatccacatattgctgggtgacggtcacactgcccatcgccatatctggaccttcataaagtacgtcttcaagcagtttttcaagaatggtcgccagtcgccgcgctccaatattatcagtgtcgtggttgacctgagtcgcaatctctgcaattcgatcaaccgcttccttcgtgaaggtaatcttcacgccatctgcaccaatcaaggcgatatactgcttgatcaaagcattgtctggctcggtcaagatccgcacaaagtctttttcggttaagtccttcaattcaacccgaattggaaaacgcccttgaagttcagcaatcaaatcactaggcttagcctcggcaaacgcacctgagccaatgaacaagatgtgatccgtattgataggaccatacttagtgttaatctgcgatccttctacaatcggtaaaatatctcgctgcacaccttcacgcgaaacttcgccgctattatgcttgtttcctgcagcaattttatcgatttcgtcgatgaaaatgatcccgttattctcggcactttgaatggcgtcgtgatagatgtcggcatgattgaccagtttgtcagattcctctttgatgaagatttcgcgagcttctttgacggtcatggtccgctcaacctttttcttaggcattaaagcgccaatggtgtcgcttagatcaatgcccatctgaccgtacatgtcacccatgccaccgccttttttctcatcattgacagcaacggtgatttcatgatcttcaagtaatcctttttccagttgctctgccacgctcaaacgcttattgcgaatatcatcggtcacttcgccgcctgcgtctgcatcatcgccagctggcattttgccattttgcatcccttgcaacatgctcatcatctcggccatcggattggtattcttttccttacgaatggccggcactaaaattttaaccaaacgcttattggcttctttttcggcacgtatgcgaacctttgaaaattgcttctcttcttccatggcaacggcagtttcggcaagatctcggaccatggattcgacgtcacggccaacgtagccaacttccgtaaacttagtcgcttccaccttcacaaatggcgcctcaactattttcgccagtcgtcgtgcaatttcggttttcccgacaccggttggtccgatcatcagtaagtttttcggggtaatctcttcttgcatttttggcgataattgcattcgccgataacggttatacaaggcaaccgcgacggcccgttttgcatcatcttgtccaatgacatattgatcgagtttttcaacgatctgttttggggtttgtacttctgccatcataagcctcctgtaggtcaatgtaattgccgacggttacaaactaaaagctttcgacaataacattgtggtttgtgaaaatatcgatattccctgcgatattcactgcttctttggcaatgtcagctggtgtcatatctggggcatgccgcagcatcgcgattgccgcggcttgcgcaaagttgccgccggagccgatcgctaccacgtcttcatctggatctatcacttcgccagacccggatacaagtaacaggtcatgctcatccatcacgatcatcatggcctcaagtttctgcaaggtcgaatccttgcgccaatcttgagccagcgcaactgcggaacgtcgcaagttgcccgcataatgctccagcttcttttcaaaccagtcttgcagggtgaaagcatctgccaccccgccggcaaatccgatgacgacttgatcatgatagatccggcgaactttctgcgcgttgcctttcatgatgaccttttcgccaagggttacctgaccgtcaccggccaaagcggtcacaccatcttttctcactgctgcaattgttgtcatagtcatgctcctttttaagtgagcgcgagcagaagcgcttagaaaccggagcataagtgggctgcaagcctaaatagccaaaattcagccatttaggcttgcaggtcattatgtgtaggtttctgcgactgcgagcgcgttatctgcgtatctcgtcggataaaaacagctaaagtaccgattaatctgttatcgccaatgttcttagcttaaaaaactcagaccgcttttgcatcatgctttagtcttaattatgcttcggataatatttcatatactcattttttaaatgtgccatggtgacatgcgtgtagatttgtgtggttgataaacttgcatgacccagtagctcttgaacagttcgcaggtcagcaccatgatccagcatatgggttgcaaaactatgccgcagcatgtggggatgaatgttagctgttagcgtcgtctgcttgatgagctgatccaaaatatattcaatgccgcgcgaggtaatcgggcgcccatactggttcacgaatacatatcgatgctgtgcctgacttttagccatcaaaacttgtcgaccatcttttaaataagttcgtagtgcttgctgagcgtactgtccaaagggcacatacctatctttgttgcctttaccatgaatcaacagtaatgccgtattgaaatcgacctgattcaatgtcagcttggcacactcggaaactcgaataccggtgccatacaaaacttccaacaaagcgcgattacgttgatccagcggggttttgccagcaactgtcttgaacagttcctgaatctcggcttcatagaaaaattgaggtaaatgatgatgctgcttttttaattcaaccagctcaaatgggttgcgtttgacgacatcaattcgtgtcaaataacggtaaaagcttcgcaaactactgatttttcgggcaatcgatgtccgtgccaaatcctgtttgttaagatcagtcaaataagtttgaacgtctaaatcatccacatgccgaaagtcagtaaacccgccgttggccttgagaaacgcctgaaattcttgaagatcactcaaataagccgtcactgtttccggtgaatactgccgttcaacttcaagatactcttgaaacgctgcaattggcttcattgaatccctccgataatacattaacataaaatgcagccattgttgacgctttcagtgcatcaacaccatcaagccgccgaaataccaatgaaaaaatcccggtaacccgagattttttgcgtccttaaacttgttcaacccgattcatacctgcttggaaagtagctaaatcttttaatgcacgatcggctaactgctgattgcgttcttttttattgcgtactttgactgttaacgctggcatgatgccaaagttcgcattcatcggctggaagtgatgggcggatgtgtgagtaatgtaatgcgccattgaccccatcgctgtagtttcgggaaaaatcagcggggtttctccaagcgccatacgggccgcattggtaccagcaatcagaccgctagcggcgctttcaacataaccttccaccccagtcatctggcctgcaaagaacagatcaggccggcgtttggatgcatatgttggttccaaaaccactggggatttcatgaaagtgttgcgatgcatgacgccgtaccggacaatttgcacgttttcaagtccagggattagtcggaaaacccgtttttgctcgccccatttaagatgagtttggaacccgaccatgttatataaactcgctgcagcgttatcttgacgcaactggacaaccgcgtaaggttccttacctgtccgtggatcttcaaggccaactggctttagcgggccaaacaacatagttttaataccgcgtttggccatgacttcaatcggcatgcagccttcaaaaaccgtcatcttttcaaaatcatggccttcagctacttcggccgaaacaagcgcttgatagaacgtcaagaattcatccttcgtcatcggacaattcaaataggcggcttcgccacgatcatagcgcgactttttataaacaatgtcctcgttgatcgtattcgcatcaagaatcggtgcggctgcgtcaaagaatgacaaaccggcctcgccgttcagatcaacaattgcctgtgctaacccgggcgctgttagcggaccggtagccaccactgtgatcccatcaggaaatgctgacaattcctcattcaccacatgaatatgcgaattgctcgtcaacttttgggtcactagctcactaaattgttcgcgatccaccgccaaggcaccgccagcagggactgcggtggcgtcagcactttgaataatgattgaatgtaactgacgcatttcttcctttaatagacccaccgcattggtgatctggttggcgcgcagtgaattcgtgcagacaagctcagcaaaattgctcgtgtgatgagcaggcgtcattttaacgggacgcatctcgtataagttgacatctacaccggcctgagcgatttgccaggctgcttctgatccggctagtccggcaccaatgacattaactgttggcatgagtgattcctccttgtggtggcgtggcgcaattagttcgttcagagaaaatgtgagttttgcggcacgtgtatttttgtggcttgctgatgtggtagcgactcagcttgctattgtggtgtgggcagactgaatctttgagcaagctttctaaaggcgcgaacaggcgcagaaaccttcgtgtaaggaccttgaagtctaaatggccaaagttcagccatttagacttcaaggctggtgatgctccagttccgaaacgcgcaaacaggcgcagaaacctgcacataaggacctcaagcttaaatggccaaagcccagccatttaggcttgaggccacttaggctccggtttctatggagaaccgcctcaaatgataaatttattcttcaacaccagttgacgcagagccacaaaaaagccttgtaatttgcgggaattcccgcagactgcaaggctttttactgaagttaacgccgtaatgcgcgagtaaccgtttgttcattaacaaacgtgaataacccgagatcgccaagttcacgtccatagccggagttcttcacaccgccgaatggcaattcagcattatagttttggctttgattggcaccaaccatgccggtttcaatccgagctgcgacttctgctgcgtgattagtgtcacccgcaaagactgcgccccccaagccataaggcacatcattggccagttcaaccgcttcatcttcactgtgaaccttgtaaacgcaggcaactggtccaaacaattcggtacgataagccggattgtcctgatcaatgtcagtcaaaatagtcggctggaagaaagcgcctggcaaatcaaccggggtattgccataaaccactttagcaccgtgagcaatagcttcgtcaacttgcttctgcaacttgtccttcgccttttggctggtcatcgggccaacattaactgtgggatcactcggatcgccaattttaagattctcaaagcctttcttcaaaccggccacaaaatcatcgtaatatttatctaaaacaatgaaccgtttcgaactggtgcagacttggccgcaattcattaaccgcgtcttgatagcttcaggaatcacagtatcaagatcggccccgtcaagtaccaagaaggcatccattccgccaagttccagcaacgacttcttcagatatttgccagcaagtgctgccacttgcgaacctgctcgctctgaaccagtcaggcagaccccagcaacccgcggatctttaatgaatgtttcactatccgcatggccaatcaaggcaatttggaaggcgcccttatcagcaccgccacccagtacagccttttcaaattcaagcccactagctggcacattgctcgatggtttgatgatgactgcattaccaaccataaagttcggtgcaaacacgcgcatcaattgataataagggaaattccatggttcaaccccaaaaacaatcccgcttgcaagatggttaatcacaacagcaccagcagtactattgatcggttgcggctgcaacaaagccggcgcccgatcagcatacatgtccgcaatctcagcacagagttccacttcaaaaagtgcttcttccgtgcgcttacccatttctcgcgtaataatcgctgccatttcgtcagcgttattgcggaaataggcagcaactgcatgtaatgttgctgcacgcgttgctggattgacgttccgctcctgcttgtaaaaagcgtgcccagttgccaacatctcgctaatttgcgtcggtgtggtatttgagtatgttttttctaaggtattcgtgttcggatcaatggtctgataagccataattgaaagcgctcccttcatatacttacttaatcatagcttattcacgcctcatatgccaactttagcaaattaatttactggcttttaataacgtccacgcagcaattggtctatatcttttgatacatcggatcaaaaaaagacccgcagcgagtgcggatcttcatgtcgtgctagattcagattagaagtctgaagggttaaccttgatgccgggtgccatggtagcagtcagcgccaagctcttgatgtaaatccccttcgtgcttgctggacgagctttcaagacaatatcattcattgctttgaagttctcaagcagcttgtcagcatcgaagctcttcttaccgattggggcatggatgataccagccttgtcaacacggtaagcaacctgcccagccttgatgtccttaactgctttagcagtgtccatcgtaactgtgccagtcttagggtttggcattaagccttttggtccaaggacacggcctaaacgaccaacttgagccatcattggcggtgttgcaacggcaacgtcaaagtccaaccagccgtcttggatcttctgaactaagtcttcagcaccaacgatgtcagcgcctgcgtcttcagcagccttggcttggtcgccttgtgcaaaaacgatcaccttagcagttttaccagttccgtttggcagcacaacggcgccacgaatctgctgatcagcctgctttggatcaacgttcaagcgataagcaacttcaacggtttcatcgaacttagcaaagtcgattttcttaagcaagtccaccgcttcttcaggggtgtactgcttggtcgggtcaacggccttagcagcctctaaatactttttaccttttttagccattctgggttttcctccttgcaaatgtggtcactgggagataagtttttctcccttccacctgattcgctcagctttcactgagaatccgaacagtgcgtcttagccttcgacttcgaagcccatggaacgagctgttccttcaaccatgcgcatagccgcttcaacatcggcagcgttaaggtcttgcatctttgtttcggcgatttccttgacctgatccttggttaccttagcaacctttttggtgtttggttcgccggaaccgtgttcaacaccagcagccttcttcaaaagaacagcagccggtggggtcttggtgacgaaatcgaatgaacgatcttcgtacacagtgatcacaactgggataatcatgccggcctggtcagccgtacgtgcattgaaatccttagtgaaccccataatattgataccggcttgcccaagagcagggccaaccggaggagctggggttgctttcccagcaggaatttggagtttgacaatgtttgctacttttttagccacgagacatacctccttaagtccgtgatgtggttatgatggccagaagttttggcctcccacgcgtatgctgaaaacatacttgaatagattatcattttacggggtaaaacacaagttaaactcgtaaaagcacgtgaaccagtaggactcacattccaacgataacaaacacattcttgttaatgattctattttgtgcggtttgtttccgacattccgagcggtcacatagcgtcgggggctggcgaccgcgaagctagagctgtaggcacagttttgaactcgcgtacgttcacagccatggccgtccacgtttgaggtaacccgcttttgcccattcgaccatccccagatagactaagacaatgatgacggcgcctggccagtaagctgctgggaggatgccgaagtcgaaggctttgtggagcggggaaagaatcaggaagaggccgactaatagcgccatcatagtggagagaatcacgatagctgaagctgggacgcgccagaatggtactttacgggtacgcaggacatgaatgaccaatgattgtgtgcagagtccaaccacaaaccaacctgcctgaaacatgtgttctgcaggtaaactcgcggcatgtgcgccaacgcccagtccgaaccataagaacaggaaggtggtaatatcgaaaatcgagcttagtggtccaaacgtcagggcatagcgcagtagaccatcggcccgccatggtgtcggcttcgcgagcgtgtcatcatcgacattgtcccaaggaatggtcatttgcgaggtgtcataaatcaggttttgaagcaacagttggatggacagcataggcaaaaatggcaagaaaatgctggcaataagtacggaaaacgcgttcccaaagttagaggcgatcgtcattttaatgtacttcatggcattagcataaacgcgacgaccctcaacaataccgtcttccaacaccagcagactcttttcaagcaaaataatgccactgacatccttggtaatatccgccgcggtatcgacgctgataccgacatcggcttcacgcaaagcggcggtgtcattgatgccgtcaaccatataccctaccgtatgcccagccccttgagttgtcttgatgatgcgggctttctgcatcggactcagtttcacgaaaagatcagtggtttcaacagcttcgagcaaatcattatcggtcatggcgtccacttcattgccgctgatcactgcttgctcaggaatcccgacttcttcggctacgtgttgggtgatgatcgcattgtcacctgtcagcactttcacacgaacgccatgagcatgcagcaagctgaccgcttctttggcgtctggcttggcgggatcgagaaagcccaaaaagcctgccatgaccatatgttgctcatcatcagtcgtgtaaatgcgttgttcatggacatccgtgcgataggcaaccacaatcatgcgcatgccttgcccactcatcatggcattggtttgctcaagctgacgtttgcgttcgtcagtcaacggtaggatctcaccatgaagctgaacctgatcacagaccgccaacatttcttcaaaggcaccttttgtgatcatccattggtggtcgtgattggctaccaccactgtcagtcgccggcgttcaaaatcaaacggaatttcatcaattttttctaatcccgctggcaagtccacaatttcgtcgtgatgttctttcacataatcaaccacggctgtatccatgagattgtgccaaccggtttgataattagcattcatataagccaaccgcagcactgctggatcggttttgccggtggcatccacataccgcatcaccacaacccggtcctcagtgatcgtgccagttttatcggtaaaaagcgtatcaatggcgcccaaattttgaatggcatgtagtcgtttaacgattactttccgcttcgacatcgccaaggcgccttttgctaagttgctgttgacaatcattggcaacatttccggcgtgagtccaacggccactgctattgcgaagtagaaagcttgtgaccaatcctgcttcgtcacgccattgatgacaaatacgactggtacgagcacgagcatcatcccgatcaacaaccgactgatggctcgcataccgcgctcaaaactggtcggatccgttttgccgctaatctgactagccatatcgccaaagtacgtcgcatccccagtcttcaaaataaccgcagtcccagaaccggaaataacgtctgtgcccataaaaactaaattaggatagtcaaagacactaatatcagcatcctgttcgtagacttcagcgcgcttttccactggcatcgcttcgccggtgaacgaagactggttaataaatagatcgtgggtggccactaaataggcatcggccgggatcatatccccagtggcaagctggacgacatcccctggcacgacgtcatccatcgaccgttcctgcgtctgaccatcacgcgtcaccgctgttgtgttcgcaatcaaggcagccaaggcatggctagctttttgagagcggtattcttgccaaaaatgaatcgtcaccgacagcacaatcatcagactcatcatcatcgcgccatcatagtcagctgtcgcagtcgatactgccaccaaaaaggccaacacccagacaaacggttcattaaaagccgaaagtaaaatcaaataccatgggcgcggatgttgggtcacaacagtattcgcgccgactgcttctaagcgatccgcagcttcggtactgctcaaaccatctggattggttttcaatgcttggtagactgcttgatcgctcatttgactgtagcgcgtcaatgctgccgttttttcttgggtcgaggcgccatgccccgacatcgtcttctttagcatgcttattctcctataagatacgctggcaggccaagaaaccgtcaccatgaggacaatagaaaaatgagcttgatacacccattctttccgtgatcatgtatgatgaggttgttgaacgtgctagcatatgcgcttaagtatcccccaaacgtgtaagcgtgcgggcaattaactttaacaaaaggttaccgtgaatgtaagatagttgtcaaagataaccatagtaaggaaagcctaaaaatttttaaaggggaggttcatgatgcaaaaatctgcacttgatcaagccgctgctattcgcgccggggtgctgtctccagcagaattgattgatagtactcgtgagaaaatgacggcattaaacccagcgctcaatgccattacctggacccgttttgaagcagccaagcaggacgccaatcaactggaagatcacggtcaaccgtttttgggcatgccgttgatccttaaaggcttgggtcaagactttgctggcgctccagcaacttttggcagtcgcttcttcgccaaggccaagtccgaacacaccaataactttgttaaggccttgcaacggctaggcttcatcatcgttggtcaaagtaatgtaccggaatttggttttaaaaacatcacagatgcagaactttatggtcccgcccgcaacccgtggaaccacgactattcgccaggtggctcttccggtggcgcagcagcggttgtggcttcaggtattagtccgctggcaaccggttctgatggtggcggttcgattcgcattcccgcttctttttccggcttaatcggtttgaagccaacccgtggccgcgtgccaaccggacctggtgagtggcgtggctggcaaggagcatccatcaacttcgccttgacgaaaaccatggccgatacagcggcgctacttcgtgggcttgccacaacccagctagctgctcccttcatcgcgcccccattacgcttagatcttgttggcgatgcacgaccactgaagattgcttacaccacaacatcgcctgttggcacccctgtcagtgacaccgctgttaaagccgtcgaaaccgcggcggatgcgttgcgagcagcaggacaccaagtcgttgcggctgcccctgatgttgacggtactgctttaatgaaggcgtactacatgatgaacggcggcgaaactgcggccatgtttcaggcatttgccgcccaaactggcaagcaggccaccgccgccgacatggagttgataacttgggtgatctatcaggccggcttgcacacctctgcagcagactacagtctctcacttggtgcttgggatcgcgcagcagaagcatacagccattttcatgagagctacgacttgctgctgagtccaacaacagccaaaacagcgccccgcatcgatgccgttttacaatcgccggccatcgttgctaaaatgcaacacgccgctgagctggcaccgcaggaacaacaagagctgatttgggatctttttgaacccagtcttgaatattcgccattcacgcaacaagccaatctaaccggtgcgcccgcaatcagcttgccgaccgccatctcacctgaaggcttaccactgggcatccaattcaccgccgccaaaggccgcgaagatcagctcctgcgcatcggctactggtttgaacaacaaggcttgttgaaaatgttacctgcatcgctaaaggagaagatctaatgggctcacttgctgaatggtaccaacgcattcccacgcctgatgatttaacccgagtcgaatcactttttgctaacattcaggcgcaattcccgcaactcaagctcgaattcaagtggaatcagcccatgttcactgaccatggtacgtttattatgggctttaatccgtccaaaaagcaccttgctgtggccatcgagccgcaaaccatgacgcatttcatcccgcaaatcgacaaagccggttacgaccatagccaaatcattcgcttcccatggcacaagccactagacgagcagttgatccacgacctcatcgcctacacgattgaccaaaagaaagatgcgactactttctggcagcgatagacgtggcatttttcggaaaacaaaaagccttgaatccgatagtatctaacgtttgctatcctcgaatcaaggctttttattttgcacctcacttgctttttacctcatccactccggccctatagttcacgtaccgcgccagtgcgaacagatagtcggacaagcgattgctgtattgtaagatcacggaatcaagcggttgactctcagcatccaactgatccaatgatcgctcggcgcggcgggctactgctcggccatattgtaaggctgccgccagcggatggccgccaggtagcacaaaggccgtgattttcggaaccgccgccatcatgttatcaatcgctaattccaatccctgtacgtgatctacggtaatcgtctgatgctgcggcaccgcaacatctgccaataattcgtacaactcgcgctgccgagcttcgaggtcctcagccaaccaatcaaagtctggcgtggctttagcctgcgaggcaacatagcccagccatgaatcaagctcgtctaaatcacctaatgcgacaatctggggagaaaactttggcacctttttcccgttaatctgtttagtggcaccatggtcaccgacttttgtgtaaagtttcaaaatgtgcgcctcctcgatcaaaacgttgcaagccctgccgtaaaatggcgagtacgatcgggtaaaaaactagattaccgatggcatgatacgtgtcaaacggtaacccactcacatagtacgcccaaaagccgagaccattcaaactgccaatcaccgccatgcctaaactgacaatgaagccgtatagataccctagcaagccggcaagaccgatttgcagccaaattcggcgacgaataactggcaaaatggttaccataacaatcacaatcaccatgcagcacgcatacgcaacaatctgcgggagtgtccagagtccgaaaccgagaaataaattggacacgatcaaggtgctcatggtcaaactgaagccccagcgaaagccgagcaacagcgtgacaatcattaaaatatcagtgacaggctgcacattcggaatagggactttaacaatccgcaaaaccgtacataaagcggtcaatagaccaagcaaagccaccgcccgaacaggcgatggctttgttgctgatggctgcggcttcatttggtgacactcaggtcaaacaccactttatcgtgattcttgaccggttgttctgtcgctcctttttgggccatcttgccattaatcgtgtagagccagtaagtctttttggcaacattctgctttttgccagcaatttcggtaataaaacctttagaagccttcactgtccagccttttttcaagccagtcatgacaaccgactttttaggctgatcaatcgttttcttggcaaaagccttgccattttgtttcaactgataagtcactacaatctggttagacttgctgctgcttttggccgcatttccagaactgctgcacccagccagcacaaacatcgcaacgaaaaagaccactaatgaacgtaaaacttttttcaaaataaactcctccacacttttttatttaattgggcaagcgccaccggcacaatcggtttgatcaacgagctcaaggtccttttgatcatgatccgcgttttgaaccgcaaagacagctgcaacggaaccatgaattgcggcacacttttgcttgtaagttttgacatcaatgggttccttaggtgcctgtttgaaaccagcacctacgtagggcaacatcgacgtcgacttaatgacatggcgatactgggaaagcaaaccagcaatttgatcggcttcttttggttggaaggtgaccgtgcaactgaccgcgttgtcagaccagtacgtctgcaaaaatgcttgcgtggcaatctgttcagcaattgacaccgttccggctgaggcaaaggcaggatcatcagcgtgggcggcgcgaattgggaattcaaccaccatcgtgcctttcgtgtaaacatctggttcaatgtgataaccgcatgcctgcagagctggtaacaatgggtcgttgccttggaaccgaatgcgctgaatcagataaccagcataatggaaatgcatcccttctgaaacgccagcaagtttcgccacagtccctgaaggtttaaccgttgtatgttttcgcgacggttcgcagcccaaagcatctgagtaagcctgatcggcatcgaccacagtgtgatacaaaccatcaacggcttgtttaatttccggatcgtaaatcggtttctggaccattttgccagtttgcggatcaacgactgactcaaacccgctcacaacccgccggccaaagtcattcaggaaccagtcttgaataccagacatggaaacaccgatacgccgattcttcttgatgatatcacgcgaaacctgccagtcataatgactaaaggtcacccgcttggcgaatcgtgctgccaatgtgaaggcctgtttcagcttccatccttgctcaactgcaacaactggaaagacttcaaacagattgcaaggttctccattggccaaggaaatttcaccgcaagggttggtaccctcaacatcaggatcattttccgcattttcgccatcagcaatccgaccaaaccgccgtgacagttcaagattcacaatcccgggttcgccatttttggcaatggcgtgggcaatctgcgagtaagcatcgaattgtgtattgatcgcaacactattgttcgacgcccaacgatgatgataaagctgcttttgatcctgcttcatcgtgataaaatcgtcatcgtctgctgagccgagtgacatttcagcggagcgccgaacattgccagcaacgactgttttaccgatcaaattaccaatatcagtcgcatccaccgccgtcaagtgttggccaacgcgagcattgagcaacttgttgatatccaataacatctcaatcaatggcatcggtccagaggcagtaccgccaaaaccgtgaattcgtgcaccctttggccgaatgttggtgatatctaaaaccagttttgtctgaccgcttggattagtcgcggcaaaatgatggtcgatcactttcgcgttggccaacacccaaccttctcgcgtatctggcaaggcacaatgatcagcctgttcaccggcatgtgctttttcccactcgtcacggtcaaccgcacccattttcaaagaatcagcataactcgcgctattgcggccaatcacaaccgtcaactcaagcttggtcgcaacaggtggcagctttgcaatattatcctttgtcaccgaaaacccaacgccgccgcccttcatcagttcatcaaacataaaggagtatggcatcgacacagccggctgcgagacgggataatcttcaggcacaatgtgtgattggccataaggttgcgggcgaatggcgatgaaccagcaattgttcaaggcatcgccattgcgcttttgataatctgttccggaaatccataaattacggcctgaaggtgtgcccgccaaaccataaatcagtttaaaaagattccgtgcttctttttgcaatgtttcaacgaccttgggatcaggattcgctgtatgtaggcgcggatcaaggttaatgttaccttcaaccacgcgcttgacggtttcgtcccagttttcagtgcgttgagcatctggcagccaccgagcataagtacgtttataagtgacccagccaagttcaccccaatgtggttttatttcttttttaacctcggcaataaaagctggtgccaaggtgattggtttcgtcataacttgcatatccgtacctcccgtatacaagatatggtatatcctcatggatcttatatcaagatatagatttaacaataacaactagttagatgacggtaactggtggccgccagtgcgttcgccttttccaaaaatcctgagcaaattaaaaaatcgtcagagcaaaaacgtctccgacgattcctatgtgttcaagttagaaaaccggaccaacatatggtcgaaccagcacatgtgctaaatctagtgtcttgagctcggcaatttcttgaacgaaacaagtgatcgagccagctaacatcaggttcattggcatcttgccaacttgaacggcgacgatcggcatatgatgcgcataggcgtacccgatttcaaaagccgtgccaggatcaggtgtatcgccaacataatctagaatagccaccatgattgtcgcctgatgcaagccttgaatgtcttcaccaaagacctgacgctgccagcctggtgagttttcttccaatttagctttattagtatcatcgcggggtgagaaaacaccggtcaccgacttgttgacctgcaatgctgccaagacttgatcaagtcgctttgtttgagccgcatcaaagaatggtgcggcgacatagatttgtgccatttagtttcctcccacttttgtgacgtgaccagcagcactaaaaatcacgctgccgctgccataaatattcaacaatgtcgtgatcgacaagccgattttcatgcaacaggctgtgtgcagcccgcgggccgcggatcacgacctcggtataatctttgatgcggtctttgaccaaatagcgaattgcaaaactgctattgatcgccacttcaccatcatggcggccgccaattagtaaatcaccagcgatattcagccaccgcagatttgccggtaaattaccaattgtcttttgaaactgttgataaatcggtgcagcatattccggcccggtgcgggtcaaccgccaatttaagattggtgatcgttgcgccacctctaaatcattcatcggcgcagcaatcgtgactagattggcgacaggcactgtcggcttgctcaaaagatataggacagctgtgacaccacccatcgaatggccgacaatgttcacctctgcaaacgcctgttgcgtttgcaacgctgtgatcaccttttccaagccatgcaactgagctgctggacgcaccgccttatctgtgaacaacacttggactgctgcatgatgatttaggttcagctgcccacgcaaatgcaccttgccatctggcgcaacaatcgctacaacatctttgctgagtccataacggcgctggagccgccagagcatatgcccaaacgaatagcgtgtgccaaggtgcccaggaataaacaaagtaggtaccggatccatcaccagcggaaccggttgataccccggccgtgccagcaacaaataatctgccagaccgcctacaaccacgacaagaccaatggccgcaacgatccagaaccagccgctcatgagctaagcctacagcttgtcgacttgatcgaaatccagttccgcggtaacttcgcggtcgaacatttcggtgacaactttcaacttcatcttttccttatcaactgccgtgactttaccgtgcataccggtgaaggcaccatcaataatcgtcactggttcgccaacatcgaattcaacgtcattgtggcgggtactcatacccatagaatgcaaaacattggcaacttcttcaggcaatagtggtgcaggcttagagccagcgccgtgagaaccgacaaagccggtcacacccggtgtgttacgaacaacgaaccatgattgatcagtcatcaccatttcaaccaacacgtaaccagggaaggtctttttcatttcgatcttctctttaccattcttttgttcatgttcttcttcttcaggcacaaccacacggaaaatataatcgtccatgttcatactgctcgtccgctgttcaaggttggtcttcaccttattctcgtaaccggaataagtatgcaacacgtaccagcgtttttctgccgatgtaactgtttcagccataatgcgtctcctttaagtgttttgagtcaaaataaaaaaccgtcatcgaaggcggtttttgcactgacaagagtataccaaaaaattggcggtttgtcaggcatcagtataggaaagcctgaaagatcatgttaatgacccaatcaactgccgcaaaataaatggcaaagataatggaagtcatgatgacggtgaaggtatcacgccgcgtttgccgagcagtcggccaagtgacggctttcatttctgcgaaaacacttttgataaatttcatcattctgctccttccatgtttactttgtctcttgatggaccgttacccggccacagtgtttacaaaatttttttaaggttaatcgttctgttcgttttgggttttcgggaacaaaataattccgttgcccacaaaccgagcaagcaagtgctactttcttagctgtcatcatgttccctccagtcacgtccaatatcttaccaagattatggggagatggcaagcagtgagggtgagccataatttcttcgtaggacttgggcttcattcaatcccgaataatcgtaggaagatcctaggcgaaaagttttcttgccgtgccaaggcaaagcaatcaataatccatgagaagtcaaaaaagaatacccaaccacagcgtcagcaacaacgtaccaccaacagttaataatgattgaatcgtgaaaataaaggttttatctttacttggcttgcttgtgtaacggcgagtattatttcgtactagcggccaagttgctagcactaacaggctccaaaatggtaacgcgcgggttaggacacctagaatcagcgcagcgaaagtgatgaacgggatgaggcggtaccattgcaaggcgcgtttgcggcctaggaagtatggcaaggtgaagcgctgatttttgatatcttgatccatgtcggcaatgttgtcagcaaacatcacggcggcatttagaatgataactggcaaagccgcgagtaaaagttgcaggagccagcctagatcaaatgaaaaggtgaaggtgcgccgtcccaacatcaaattaagcggacttggggcgggcatgttgatcagcacagcaatgatgaaagtaccataaccttccacaaaaccggctaacaactcacctaggggcagacgggacaaagggaccgggccaaatgtatacagaatcgccacaccaacaccaatcgcgccgatcacgagcagactaaggttggtgcgcatgaccaaaatgatgcctaatatgacactcaccagcaaaatcacgatggtcaaggcgagcatcccccacggtgacaggtgctcacggccaataatattttgccgttgctgatagctttgatctttggctttaaaataatcctgaacattgttaaaaccagtcacaaacaaggcaatcgctaactgcgcaagcccatagatcaggctattgacccatgaaaattgctgaaatgcccagcctgcatagctaatgcccagcacaaatggcaacatgctagccgccttagcgggtaatcgaataaattccagaaaaagtggccaagttaaccgatgatatggttcgctcataggatcgcccccattcccaagcccaagaccagtaaaccattttcaataacgagattgatgaccgcagtatgaaaagtacgctgtttgctggggtcacgaatgaatcggtggacatttttgatcacaagcggccaagcaagttctatcaccaacgtccaagctggcaatgcaccaaaaatgacgccaaaaataatggctaaaaatccaacatacgccagcagcgcatacacgcgtggcgaccaccagctacccaaatacatcggcaaagtgtgccggtgattacgctggtcctcatcaagatccgacatgttattggctaacataatattagcaatggttgccataggcgtcacgcaagccagccctaatgcaatgatggcaataaagtcaccgcgcaagacaacattcggccacccaagatccagtgccagcaatcgacccggtgcaatattgacatacgtggcaatcactggaatgcccagtcccataacgataccagagaagatttcaccaagcggcagccgtgacaacggtaacggtccccatgtatacaaaatgccaatggcaaaacaggccatgcccatcaataatagtagccaatctgtccgccaaaccagcaccaagccgatcaatgaggcgacaatcagcataccgataatcattttttctaccagcttgggcgctaaatttgcccggccaatgacattggtggttgtttgataatgtgcatctttagccttacgataatccatcaaattgttaagtgcagtggtcatcatgtcaaaaagcagcatcgccataaaaaacaggatcgtattcacggcattaaaagtgtgaaaatacgtcaccgcaaataaagtgccaatcgcaaacggcaagatactcgcaagtttcgtgcgaatttcaacgagctcaaaaaataccgacaacggcataaactacccccccttatttttttaacgtcgcaagtgtatagcctgaatccttcaaaagcttaaacttgtccttcaaccctgagctgacataaacctttttatctttcgtaataaaaatagcatcggcatacttcagcttttcaatataggccatcccaccagctaagcccttgtcaaatgttgcggttgacaaggcatcgccatcgacactctttttggtcacaatggaaacgcccattaagttattgtcgaacggatagccggttttaggattcatcaaatgcatatagattttcccatcgaccttgagataccgttcataaataccagaggtcacgaccgtcatgttgctagctggcagtgtgccgatagcggtcccgcgtggcttcttcggatcttgaatgccgacgttccaatcttttttcacgttctttgggctcttgcccatcacataaatattaccgcccaaatcgatgatcgcagtggtcacgttcttggccttgagggttttaacaacttcatccgtaataaacccttttgcaatcccgccgaggtcaatcgccatgccctttttcttgagataaacggtttgcttcttggcattcaaaaccacatccggataatgcaccaaaggcagacgctcatcaatttcactttgtgctggctttcgagcatccgcaaagcctatgtgccagagactggtaatcggaccgattgccaaatcaaaagcaccctcggaattttcgctgtaatgtttggcagcagcgatgacacgataaacactgggggtcacgtgcacaggtttgatgccagcatttttgttaaccgcatccacctctgaccctttttgattgaccgtcaactcatcagccaattgttggacgcgggcaaacgccgcatccaaagcaccttgcttgtccttgtcatagattttcaccgtcaccacggttcccatcagaaactgggtatccgaatacggatcgccttcgactaacgtgcgctttgctgccgttttgccggcacaggccgttgcgactaatgccagtaacatcagcagaacgactacaaatcgtttcttcatcattttcctccaaacgtccgcagactttgaaacctgctcgcgctctgtcattatatagggactttgcggcataagaaaagaacctgttcaaaaaagttctgaacaagttcttacttggttgagcaatcgtactagaccgattgcatcaccgaacgtcacaaaagtgtgacatcacattagttgttataaacaatattgtcgacttcaatcttgttagtgttgccattttgagcagcattgacaagttggtcagcatacaagatgaaggtatcggaactgtgggtcgcaccggaaacaacatcaaccttggctggtgactgtttagcaaccagtgacttattcagttcaggaatgtattccttagggccgactttgttgaccttcttcatatttgcttcgtacttcgtatcaagcgtcttggacttgccatctttgttgatgttgtcgtagttgctctctgtgatcttgccatccttaactgtgatggagaaggtgacacgataaccgttgaagtagttcttttcttcaagtgtgtaggtcccgtcctgcatcttgccggtgttgttaacttcgattgtctttgtatcgccagcttgtgcagcttggatcaattgctgtgcatagttcttaaaggtcatactggaatcagtcgcaccagagataacatcaatagcgccaacgttggttccattcttttggaaggacttgttcaattctgggatgtattccttcgggccaactttaaccttagccttcattgccttttcataagcggcatcctttgtcttggacttgccgtctttgtcgacgtaatcatatttagtagaagtaatcttgccatctttaacggtcatcgccatttgtactttatagccatgatcatagccggtttcatccaacttataggtgccatctttcagtgcaccgccagcaacctgtttctgtgatgatgatttcttaaccactttgctgctagatgctttactgcttgttgaatttttactgctggaactactgctgccacatgcacttaaaactaaagcagacagtgcaacaacggctgtccccgtcacaactttacttaacttcatgacatttaccccttttgcagttagttactgcgatattgtgttttcaatcacataattagtttagctagtcacttagaaaaaatcaacttattacgggtattataagcgctttctcattttctaatatcgcgacgtagaccggatttctgtgtttttttacacaaaaatgttcggatttagaaaaagacgtccggaacgttagacattaagtaaaattaaaggctataatggcttagacacatacttgtgaatagtatggtaaagcaaatggtaaggagtgttatgcatggcgaaaaccaatatcgtcgtggttggcgcggggtttgccggggtatatgcgacaaagcacctggccaagcactacaaacgcaataaagacgtgacgatcacgctgatcgatcgccactcgtacttcacctatgtcactgagctgcatgaaatcgcagcggatcgtgttccggaagatgcgattcaatatgatttgcagcgcctgttcaaccggcgtaagaacgtcaaggttgtgacagacaacgtgacaggcattgatcgtgataagaaagaagttgtcacggaaaatggcagcttcccttatgattacgtgatcttaggcatcggttcgcagccaaatgactttggcacaccgggcgttgccgaacacggtttcactttgggtaagtgggaagacgcgattcggctgaagcggcacattgaagatgtcgttcgccgcggttctgaggaacacgatccagcaaaacgcaaggcattgttgtccattgtgattgttggttccggttttactgggacagaaacaatcggtgaactgcgtgactggcgcgacacactggcaaaacagtacaaacttgatccaaatgaaatccaattcagcttgatggaaatggctccgaccattatgaacatgctggatcgttcagatgccgataaagctgaacgttatatggaaaagcgtggcatcaaggtcatgaagaacactggcgttgtcggtgttcatgaagaccatgttgatttgaaagacggctcaactttcccaacctgcaccttggtatggacggctggggttaaggcaactgaccaagcgaaggacttcggtttgaagcaaggccgggctggccggatcttagtaaagaacaacatggaatcccaagacgatccaagcatttatgttgttggggatgtttccttagttgatcaagacggtactggcaaaggccaaccgcaaattgttcaaggtgctgaagccactgcgctgactgctttgaccaatattgaagctaagcttgaaaacaaagaacaagttgaatacaaagcgaactattctggcttcatggtcagtctcggttctatgtatggcgttgctaacatcatggggtggctccatctttccggcttctttgcgatgttgatgaagcatttggtcaacatgctctacttcatccaagtttattccggttattatttattccagtacttcatgcacgaattcttccggacacgtaacggccgtaacatgttccgcggccatctgtctcggcaaggtaacgttttgtggacacttcctgcccgcctcacgttgggtgccatgtggttgattgattgctggccaaagattcaaggcaaggaatcatggttcattgataaactgcgtctgccgttcacgtggctgcagccagccgcaaccagtggtgcttctgctgctggcgccgacgcaaccagtgcagcaaccggcgctgctgccggtgcagcaaaggcaacgaagactgtcttctcactgtcctatcagtatggaaacgatccaatgatggtctttgaaaagatgccaaactggtactacagtatcaccaaggcattgattccaaatcagcaagtcgccttctttatgcaaaaagccatgaccatcatggaaatcttgattggccttgcattggttgccggcctgttcacatggttgacctctgcagcgactatcgcctttgtcggtgtcttctgcttaagcggtatgttctactgggttaacatctggatgattccaatggcgttcgcctgcatgaatggttctggccgggcatttgggcttgataagtgggttgtcccttatctccagaaagtcttcggtaaatggcgttacggcacaccgcgatccttgtacggtaccgacacgcttaaataactgtctacacaaaaggctctgggtggacttacctagagtcttttttcaagagcgggaagctgttgtgaccatcttttccggccatagctgctccccgtccttcgtgttcaggcgtagcataaactgcatgccatgaacatgaacttatccagcggtttagattggagcaccagcatgaaacagcccagcacattcaaacgttatctcaaaatgattcggcctttcgattggatcatcgttggcggtctgttccttgcggccttcattccttatgtcatctttgcggtacacgagaatcagcagcaacaagctgaaccacaacgtgtgctcacagctgtcgtcacgcatgacggccatgaggtttaccgcaaacgactgactggccataccggcaccagtcgtttcacctaccgcgctaaagacggcgattggaacaaaatcgaagttaaagatgcaggtgtcgcaatcacagaagctaactgtcaagatcaggtctgtgtccggcgcggacgcatcaccaagcctgggcaaaccatcgtctgcttgccgcataaactgctcatcgaaattaaagcaaacaaaggcggcggaagtacagggggtatggtgactgaatgagcacgtataaagctgaccgtacccgacaatatatttatattgccctactctgcgcccaaggggtcattattggcctccttgaacgcatgattccgttcccgttcgcctttgcacctggggccaaactaggcttagcaaacctgattaccatcatttctctgtttacgatgtcgatccccgacagttttatcctaatgtgtctacgtctcttgctcaccaccctacttggcggcacgctttcaacattcctttacagcggcgctggtgccgtcttgtcttggtttggcatgctgttcatcaaacaattaggtgaaaaacgcgtcagcatgatcggcatctcggcagccggcggcattttgcacaatgttggccagcttttagtggcatcgttgatcgcccaaagctggactgtcatgctttatctgccggtacttgcttttatgggcatccttgctggcatcgcagtcggcatcgcagccaactttctttttgaacacatcgatatcttgcggcgactgcgctacgaccgaaccaagcgccgcaaaaaaggagctacacatgaaaattcatcccatgtggcatgaatacccaacgttagcgccggagctggcttcagcgctagccatgatcgaaaaacagatcacgaccaacaacacaccggtcgccaaggcaatcatggagatgatcaatggcggcggcaaactgttgcgtcccgcttactgtctgcttttttcacggtttcaagacgttgatcgcgagaagatgatcgccttggcagcggccattgaaaccctgcacacagcgaccttgattcacgatgacatcattgacaaatcgcccacccgccgcaatcaggtcaccatccagaagcaattcggaccagacacagcggtctatgccggcgactaccttttcgttgtctgcttcaagttactgtcgcattatgcgtcaagcttacgcagcattcagcaagacagcggcagcatggaaaagattcttaaaggtgaactggatcaaatggccactcgctaccaaaccaagattaccatcgacgactatcttaaacaggtttccggtaagactggccaacttttcgccctcagttgcttcatcggtgcctacgaaagcggcagcagtcccacctttgctaaaaacgctgaaaaaatcggcatgaacattgggattgctttccaactactagatgacatcctcgactacaccagtgatgacgacactctcggtaaaccagtgtgcgaagatgttcgcagtggcgtctactctgcaccattgatcctggccatgcaacgcaatcggcaagctttcttgccactgctagcaaaaaaagatcagatcaccgatgcggaaatgaatgaactgcgccagctcgtcatccaccatcaaggcgttgagcaagcttacgccatggcccagaaacgaactgaacagaccatcgccggtttgcaaaaactaccagcaggcgctgcgcaggatgatttgattcgcttgacgcagagcttgttgaatcggaaagcttaattgaactggcgtgatcgtagctgatggatcgtaattcctgtactggactcgtgactcattagaatccgcgtaatctagtaaaggtctaaactatagaatcctttgccgtgccaaactccgcaatctccggccagatggtgctggaacgctgtgacggcgcttcgagcccaaagcccggtctcgaagtcgcctaacaacatcagctccaagcccggtcgctgtgttgtttgcacgaagcttcacaaaaagtcgcttagcaaactgtccgaaaaagtgttgacttcccaaaacacagtctggttggtagtccagacgcggcttaggctgtcagtatccttcctccttggatgtccagattgcgtgaaaatcttaaaggaggtgttagtttgacaattcaaggcaagctaacagtttattttgaacgacctttttatcgcggattgttcgaacaaacaatgggagacacgtatcgtgttgctaaagtcacatttgggacacaagccccgacagcaagtgagttgttacatttaattcaacaacgatgggaagacctacattgggtagccgcacaggatgttattctccccaagttacagatgacaacaagtccaaaaaggcgtagtcgtcaggctcgaaaagaagtccgtaacgctaaaaggacccaagcaacaacttttttgaagctagcacacaagcgaaatttgcaggtgaaaaagcaacgacgcaagcaactgaaagaccagcacatttgtgaggttcgcttgaagaagcaggcgaaacgtttagaaaaacatcagggacattgatgggcaattcagcatcaataaattaggtgaaaaatctacgcggatgaatacgtcgcgtagatttttttgtaaaatggccatagaaagttgctatatgaggaggcggacttattgacaagaaaaatcgtcaatcatctaacggtagcaaatcgccaccaatttcgtagttggttaacagctcactatcaagacgcctcggaatgttgggtagacgttaaacgtggtgtaccaaaacaggatgacacgttttggtatgttgacgccgtggaagaagccatgtgttttggctggatcgacagtacctacaaaaagttggcacctgatcaaccagcatcgcagcgctttgtaccaagaaaagtggggagcgcgtggtcggaattgaataaagaacgatgtcgccgcatgattcacttagggaagatgacggcagctgggtatgctgttttgcctgatatgaacccgcgtcatttcaagtttgatcccagaattattcgagcacttaaacgtcgtccgggtgcgtggcagtattttcagtcgtgtccgcctttgtatcaacgagtccgttgtgacacgattcaaatcaaaagtcaccaacctaaattatttcgtcaacggctgacaaagtttgctaacgcctgtcaagcacagcaaatgatcgggcaatggtgtgacggcggacggttacttgttaaatgaatacgtttaacgcatttaagcttcatcacagtgattttttaaattggtatactttttataggtgttgtcagactacctaacagcaaacgttgacgcgcatttttacctgattatactgataaagtaaatattggtatatgaaaggaagtccacaatgcgtatcgaggaagattgtattggtaagttggcaattgatgaggatgtcttatatggaattcacacgacccgtgcgctaacgaatttcccgatcagtacagagcggactgatccgctacttttcaaaagtctgatcatcataaaaaaagcagctgcacaagtgaatgcagctgcaggtacgttagatgttcgaaaatcgcgggcgattgttgctgcgtgcaacagcttgctgatgggggaacatcaagatgcgttggtcgcgcctgcgattcaaggcagcgctgggacttccgtgaatatgaacgtcaatgaagtcgtcgccaacttggccagcgctgagctcaaaacgattcgcgttcatccaaatgatgatgttaatcagagccagccgaccaatgatacttatccaacagccggaaagatggcagcattacaggcattgccaccgctgaaacaagcattaacgtttttgatcaaaaccttggacgctaaagcacatgagtttgcggatgttgttaaagtgggccgcacgcaactgcaagacgctgttcctacaacatatggacacagttttcacgcgtatgccagcttgttccgtcgagacttagcccgattgacacgggctgcggccgatttacaggcggttaacttaggcggtacggcgattggaactgggttgaatgcgtcgccttattaccgtagtcatattattcgtcaggttaatcaattgattgatctgcaattgaagccagctgaggattttattgatgcaacgcagaactgcgacgttttggtggccttctctggtgctatgaagggacttgccactgacttgtcaaaagtagccaatgatcttcgcttgttaagcagtggtccacaggcgggacttaatgagttacatttaccagcaaaacaggctggttcatcgattatgccaggaaaggtcaatcctgtcattccagaagtcgttaatcaaattgcctttcaggtgattggccaagatgtcacgatcagtatggcagcagaagccggacagcttgaactgaatgcttttgagccgattattttccgtgatttgttgcaaggggagcggtacttggcccgcggcattgcaaccttaacgtcaaactgtgtggctgggctgacggttaatcgtgagcagtgtgaaaccgcggttcaccattcggctatcagtgccagacttttaagcccgtatcttggttatgaggcgacggctagattgattcagcacagcatgaagcagcacgttgctattcctgacttgttgcgctcggaacataagctgtcggctgcgatgatcgcgcgattgttttcgccaatggtcatgacgaatcaagaaacagtgccagacttatcaattgctgaaaagtagggatttgttaagcttagttccacgtgaaacgtccgcgtattcgagtgggtttcacgtggaacacaaaaaagaggccgcatgcatcgcaaaatcgagatgcatgcggcctcctttttagtggcttcttccaacaagggcttcagggttcagataacagatgatgcataaactgcaagacaccttgttcctgattgctcttagtggttgtgtcggcgactgccagtactgctggcgttgcatttgccatcgccacaccaagaccaacttcccgtagcatttctaaatcgttgccgccatcgccaaaagcgcacatgtcatcaagttgaatgtttaaatgccgaccaagtgttgccaatccggcagctttgttcatcccgggttgaatgatatcaatgtcgccgtggccgctgcttgtcggttctcccaagtcaaccaacagttggcgcatttcggcaacaatagccgcggttttttctggaggacaactaatggcaaattttaaaatgcaatcatcgagattgtcgaaagtgtcaactaaacgtaattgcttgtagtattgtcgtgccgttgcgatatgggcagcatcagtagttttcagggcataggcgcttgattgaccacagacaagaattttgagatcaggtatgctagttagtttagtcagaattggttgaatggcaccgttttcaaaagaacttaaagcatacactttgttagcatcgcgaatgtaggcgccgttttcagcaacataaatcgtatcagggaaagcttcaaaaaaggaagtcagctgaaagtattgattaccacttgccaccacccactgaatgccttgcgcttgcattttttcatgtaacgtcgcaaaaaagtcgcgatcataggtcatgtcgtctctcaaaaaggtgccatccatgtctgttgctattaatttgaacattgttctctccgttaatggtcagttaagactgctttgattgttggctttcatcagcctgttgctgccaggttaagaactcatctttttgttgttgccactgggcatgatctttatcagtaatccgccgaatcatgcgagcaggattgccagcaacgatgacatgatcaggaacgtcttttgtgaccaccgatccagaaccgataacaacatcgctgccgatggtcacacctggattaataatgacgccgccgccaatccagacatcatcgccaattttgataggcttaccatattctaaatcttcaccgcggatagcggcatcaattgggtggccggctgtaaataaactcactttaggcgctaaataaacccggttgccaatggtaattggcgcggtatccaagaaaacacaatctgtgttggcataaaaatgatcaccgattgacgtgtgagcaccgtagtcaacgtagaaaggaggctcaatgtagttattgtctccaaatgcatgaaataattgttttaaaaccgcagctcgttctgcttttttatcaggggctaaatgattaaactgccagacgagatcactgcctcgctgactctcaacgctgatctctaaatcatttgctttatacagtttgccaccaagcattctttgcttcattgattccatattggttagagcctccatacttaagataagctcattgtaccgaatcttggctgtcatgaccaaactagagtcgttatgggacgatttgtaattgggattgtgcgtgcatcatcataacgcgctcacaaaaaagccgatgcaacagccgctcgcatcggggcttggttaaccagtaactgaaacacgggttggttgatgttcgataatcggcatccattgactcacaatggtttcggggctaaagtgactggcacgttcgagactttgatgggcataatgatgccgtaatgctggctgtgacatcatctttttgagattatcaacgaaatcagggacgtcttgtgcctttgtgagtaaaccgtagtcattgttgccaagatattcgcgtgagccagtattttccattgctacgataggtaagccagaagccatggcttcaccgataactaacggcataccttcccaacgagaggtcgatacgaagattgaagcattacgataatgatcgcgtaaggcttggtctttcagtgggccttggtagattaacttgtcggccacatggaaatagtcaatcaaatcgtagaaatttttcatatcttcatcagtgcctgagccggcaatcgcaatttgccagtcatctggtaaagatgcggcggcttcgagtaagaagtcgatacctttgtgggcaattgcgattcgtccagtgaaggcgatccggtgcgcgtcgagatttgcctcaccagtggggttaagggtgaggggattgtaaattttaaccgtgttcggattgaaacgcttgtaagaatttaggtcactttcagtgagggtgaccaaggtatcaacagcttgcaagccgccttcaaactcagcttgcatttgaacatagtaatcttccatgtacgttgcgtagttattgtgcatccagccaatcagattgacatctggtaatgcctgcttgatgagcggtgcgaagctggtcgtcaaaccagcaggcaaaatcacagcctgaaaatgctggtcacgaatcgtcataatcaagtcattgatttgatcacgataatgtgtatatgggtcgctcccaaagaagttaagcaacttgggatctgtcggacgcggggcaataagcagcggggcgtccaattcaaaatatgcaggggcatctgctaaactatagaaactgacatcatagtgtttaacgagatcatttcctaaaacagttgatgcgcgtttaacaccgtccatgacgatgttttcaagtacgatcataactttcataagtgttcgccgctaaagtcagcggctcccccctttcttctgagtacgtcacgatctaactgcagagtccagtcgaaaaggcacggctgctaaaagaatagcagcaggggccaaacaatttctaaggtctactcagaaactgtttgtattatcatactcgctttttattagtaagtgcaaggattttctgttaaatgttggtatagcaaggttctcacggggtagacgagccggaaaagaatgaattgtgacatttccatgaataataggtgttatgtttcatgtgaaaccttcaggcggtgcttatgacaatgaatagggatgaataatttaacgagaatttctaggaaagtaaggaaaacttttttggaaatagtaccggcattagtgatatgtaaaaaccgagtatttttgttaaacactcaaaaaacacagcagaaatgctgctgtgtttcatgtggaacgattattgcgtaaagttaattttgtttcacgtggaatttgcgtcctgcgtattgggctagctgcgtgctcaaggattttagggatgttgtgagcagatcaggatgaattgcgacatgtccaaatgtccaagcttcgtaggcatgcgtgagcgtggtgaagtgtcgttgatcgcctaatcgtgtatcaatgcggtgtgcatagactgtcaatggttgacttgactggcgtcgtgtcacgcgccgtaatgaccaaagtaacaaacgataacggcggggaaagtttctctgtgtcaaattgaaactaatggtgaacgccaccagtgctggtagttgccagattaagacaatgcataaagtcaagacgacagtcaaaacaatgatagctgtccaatgaaagctgtcgagagacgatcgagaagacggtttcggttgagtagatgaggcgctcacaatggaacgcgattctgacgaagatactgctgagctgactgctgaactgctggctgattgtgaggctgtattgcttgccgcggaaggcattgcaggatcatcaggggtggcgggattgctgaatcctggtgttggttcgaagggaacccagcctaaattgttgaaataaatttccggccaagagtgtgcattgctattgcgaatgatgtattgtttgttcgcgccacttccgccttcaaaagtgccagtattaaatcctttggcccatcgtgctggcaggttaatgctgcggcataggacaaccatagcactggaaaaattatcacagtaaccaataggtgaatcgaacagaaagtaatcaacgtagtcacgatttgccggtgtttgctgtgcatctgtttttgaataggtgaagcgcggatctgagcgcaagtaagtttgaatggcgatgactttttcataaggcgttttggcatcagccgtgattctttttgccagtgttctaactcgttgcggtagtgaactaggaagccgtaaataactagatgaaattaactgagttgaactcgtagcagtttcgagttgcgcatcggtaaactgtttttgctgcacctgaatatcaaggcgttcgaagcgttgatcatcgctcgcagttatcctttgtgtggctgagttaagcaaaaaatcggtcgtggggtctggtttaccgccagtaaaagttaattgcccatacggtaatggcaaaaaggttttaccgccgttaaaaactagtttcactgacgttgtttaccataatcgacttgagccgatggatcacgcataatagcaccgtctaaaggagcagcttgcgtctgaaatgtagatggtcgccaacccgttcctgtataaaatgagtcaacctcgacgcgataataatgagcttcacgactggtggcggtgaatactggtgtgggatcatcatataccggaccgcctaaaacacgactgttttcggtgaatcctgtgcggcctgagccgttagcgtaagcttcaaggctggcatagaagcctcgctgattgagtcgttcgcgcgcaggaacagagatattagttaaccagtcattcaacggagtgctggtgctgagccacatgagtccaagggttaagccaacaatactaagactgccaattaaaaacgctcgccagcgggtgtgataaaggtgcaaaacagccaacaacccggtaacaacagcgagctggaaaaattgtgtcgtcaggtcgctgccattgaaaacatgtacagcaagtaaataactgagcacaatggccactgcgccaggatagagttggagaacaacggttattaatagtagaaaggcgacaagagctacaatcaacgtcatgctgagggtcgcagggacatccacgccaccaacttgcaaaaaccgcctagtcgcggtattgaaggtttggacataagtgttaaaccaggtaataccaaaatgctctttaagcggcagtattgcccaaaggccaacgatcatgctcaagaaagccgtggttagccaaattggccaagcccgtggccataatgcggcaagataactaattaagctgatgatgacaacatagcctgcgagttcacgaggatgtgctatcggattaatcacagagaaaggctgtacaaaaagtgccaataaccaccatgtcagcaaaatggtaaggagacgttgtagccatttaggcatggtcatcacccccagacaaatcgactagtgttgtagcagccggagccagtgcatgtgtgaaaggcactgcggcctgtgtatcagcagttaaaataagataggcgcgatgctgatgttgtggggtggccaaagcagctaaagaatcaggcgtggcggtaccgtcaggctcaaagttggctagcgatgtgttttgccgtccttgtatgacggaggttaaccgactgtctagcagatagccgttcccgctgaagacgcctgtgtccatgagacttgcgaataagctcaaggcaggctcgagtgacagcgttggtgtgattagcaacagcaatgtccagctggcctgaccttcatgctcatcgtcatgaacaatcagcgtatcggcatgtgcactgactttccaagcgatttgttgaatattatcacccgggaaataatcgcggaaatttttaatgcggtcactgggcaagccagcgtcagcagcagacattttttgcgaaaagtcatctgcaattcgtgcggcagcttctggtctgcgtgcggggccaacagtgatcggtgtggctaaacgcaagggtagtgttttacgaaaccagccgaataagtcagtcacggtgacggtcatcggtaactgctcataaatgccgcgctgtaaggttaaactgattttggctgtccgttgtccgattggcaaatgccatgtatgtgttttggcactgtcaagcagaaaaagattaggtagccatctgccatgagtcagcgtgaaaaggcgcgttaccggtctatcggcgatcatgtcaggattatctgctgtgaaacgcagtgtatttttcaatggccacaatagcggtatcgcaagtagtagtatcaggatagcaaagtcactggcaaaccagctggtagatgagttaaatgccacgccaaaaacgatcagcaggctgagcacaagcaaaatgccagcattgataaaaaagttgcgccagttcatgtgctcacccccgaatcggaacggcggtgttttgcagaatatctgctaagatcgttgccgtcgaaagtgtcggatccttggcaatgagccgatgaccaaaaacaggatcgagtagcgtttgaatatcgcttggatcaacgtaagtacgtccgttaagcgtagcgaaggctttggcggcagtgaccaaggcaatgccaccacgcgggctgatacctagccgaacacggttgtcgtgtcgggttgcctgtactagcgcgagaacgtaactggcgattgcatcgctgaccgtcacgttagccacgagttttttggtttcagctagtaacgatgcgtctagtctaggtgttaattgagcaatcatcgttttacgatcaggcgttagcagcaaacttttttccgcgtcagcatctgggtagtcaagtgagaggcgaagcatgaaccggtccaactgtgcttcagggagcgggtaagtccctgcataatcagtcgggttctcagttgccatgacaaaaaagtcaggggctagctgataggtatgaccatccgttgtaacccgtccttcacccatggcttctaacaaggcggcctgtgttcgtggcgtggcgcgattgatttcatctgctaataaaatactggtaaaaataggtcctttttgaaattcgaattgattagtggcccgattaaagattgatgtgccaagaacatcacttggcagcatatcaggtgtgaattgaatgcgggaaaatggcaccgctaaggttttggccatcgcttgaacgagggtggttttcccaacaccgggaatatcctcgaacaacacatgaccacctgcaagtaaggcggtgaaagtcaatgtgatcggcattgatttgcccaccacaatcgtcgctacttgatcccgtgctgcatcaaaaatggcttgtgcttcattgacttccatcatgacacctccatgccgtcattattcacgaaaaaaagctaaacagcaagcatgcgaactgacggctggcatggcgaaagatgtgaaacgctgtttatagtttataaaggcatttattcagagcgtcatttcaattttagtgctaaggcagaacaagaaaataggcgacgccaaacgtcccagttcgtgccacgatgttggattaagtaacggctagtgagaactgatggacactcagcttggataataggagaaggcctgattagaagaaaaatgatacataccgccaaaccctcaaaatagccaccctttccaccctggagtatacttaccctagcatctgttattaggaaagaggggcaacctatgaagaaacggcttggatacaatttgaatgttattggccattatctattgatcggttggctcattttctttggtgtcaccatttttgttggtctggtgacatatctggtcatgggcgcgaaccccaattttgttcgtggtatttttactggcctctctggcaagtttgctaatactcacgacagtctcagtgcattttgggccattttagtgaataacgaacgcgttgcctttggcctcatgatcattggtatgattccgattccttttctatactggatttcgtattatctcacctgtgcttctgtcggcttggtgctaggcatttatgccgctaagctgggtatcggtggagctttggcagcgtttgtcttaggcattttgccacatggtattctggagatgagtgctttgattatcggcgtcgcgctcgctgctcaagtcaacaaggcccttcgccagtcaatcaagcgtttttttgccgatccatattatcgaaagtcgtcgttagatgtgaaggctattgcactacagtatgtttgcatcatcattccgatgattgccgttgctgccttaatcgaaggctttgtgacgccagcgttgctgcgactgcttgtacattgacctaattagaaatagggcgcaaaaataaaccccgcatgctgattttgcaagcggggttttcatatggcgtggtgagctggaggtgacaattgtttcgcatgaaacaattaagcccactccgaacgcaacagcgaataagtattcacatctaagaaggtgccgtcagctcgttgatcgtcttgacgcaaagtgccatcgagatgaaagccggctttttcggcaacggcattgctcgcgcggtttgccacagcggcattgatggttagcttatttaggtcgtaatcgtggaaggcaatatcggccaatgcttcaatggatttgtgcataatgcctttgccgcgttcgggaatggttagccagtaaccaatgtcggctttatggcgaaccaaggtgtcgatcgtgttcaaactgatcatgccaactggagcatcggcttgataaatggtcagatgcaaggcagtccttgcaccaaaaagcttgagtgttgtatttaaaaagttgatttcgtcgtcggcagtcagtgtcgttgcgacccaaggcaagtaggcagccaacgaatcgcggctagtctcaatttgttcgaataaaaggggaccgtcgatttccggtcgcggtagggaaagtttcaaatcatagtcgattaggtagctaaacataaggtcaccacatttttctttaagtttctcttagtataaagcaatcttgcttctcttgcgcgtagacaacctttagaaaaatcggtacacttgtaagctgtgaatgggagctgggtttacaggtctcaaaacacatgaattgaagtagcatgcgtcattagcaatttttgaaagaaacaggaactaaatgagaaagatggtgttttcatgagacgagtttggaagtggtgcgttgctggggtcatggcgttgatgctggcggtcgtgctaggctcaccggtgtcaacgcaggcggccgagaaaacttatgtgatcggcacagatgtcacgtatgccccgtttgagtttgcggataaaaataatcagtatgtcgggatcgatattgacctgatgcaggcaattgcaaaggccgagggtttcaaggttgatatcaaacctttggggttcaatgcagctgtgcaggccttggaagctaatcagattgatggtgtcattgctggtatgcagattactcctgagcggcagcaaaagtttgccatgagtgagccttattacaaaacggcggttgccatggccgtggggcaaaatagcaaagtcaaaagtttgaaggatttacgcggcaaacgtgtggccttgaaaactgggacggcagctgcagactatgctttaagtttgaaggcaaagtatggctttaccacggtgaccttcgatgattccaacaatatgtatcaggatgtcatcactggcaattcggtcgcttgttttgatgataaaccggttctgcaatatgccatcgccacagggttgaagctcaagctggctggtccagaaagtaaggccagttattacggttttgcaacacaaaaggatcgtagcgatcatcttgatcaacgattcaatgccggactcaaaaaagtcaaagctgacggtacatatgccaaaatcgttgccaagtatttaggcaatggcacacaagccgcccaaaaacaaaccagtgccaagactcaagatagtgatcgcagttttctcggattattgcgtgagaactggggaaccttgatgggtggcttgaaagaaaccatgattgtgacgattgtcgcgatcttcttcgcaaccgttgtcgggattcttgtgggcttgcttggcgttttgccaaatcagtttgctcgcggtgtagccacgacatttatctacattttccgcggattgccgctgctggtattggccttattcatttacacaggcgtgccaagtctaatcggttcaaaaattccggcattcgtggctgggatcatcaccttgaccttaaacgaaggtgcgtacaccgcggccttcgtcaaaggagggattcaggcggttgatgacggtcaaatggaagccgcacgcagtctaggattgccttttggaaaagcgatgcggcgcgtgattttgccacaagggatcaaaattatgattccgagcttcatcaaccaattcattattacccttaaagatacgtccattctctcaatcattggtattcttgaattgacccaaactgggaaaattattattgcgcgcaacatggaaggctttaagatttggaccatggttgctttgatttacttgatcattattacgctattaacttggctcagtaattgggttcaacggcgtatggaggcctagaccgttggcgtaaaataatgtgacaaatgtcaattaatctaacatcaggactggacagcgactgttgctttccgctagcataaaaagtagtttttttaattaaggtcgcttaagtcagcctgatcgtgggcagaaagcgcatttgttgcaagctaaacgagtttgcaatcggatatcatagaaagcgtggtgttagggttgaaacgaaaatggctgctagggctgctaatcgccctgcctttaatgctgggagctttattacccggcaagtcagtggcagcggcacaaaaaacatatacaatcgggacggatgtgacctttgcaccgtttgagtttgcgaaccaggataacaagtacgtcggcattgaccttgatctcattaaggcaattgccaaaacggaaggttttaaagttgagatcaagccgctgggattcaatgcggcggttcaggcacttgaagctaagcaaatcgatggtgtcattgctggcatgtcgattacacctgagcggcaacaaaagtttttgatgagtgatccttactacaaatcaggcgtggtcatggcggtggcaaaaaaagggactatcaagtcgctaaaatatttgcgcggtaagcgagttgcggttaagaccgggactgattctgcggattatgccaacagtattaaagacaaatacggtttttcaacggtgacatttgatgattcgaacaatatgtatcaggacgtcatcagaggtaattcagctgcttgttttgaagatcaaccggtgatgcagtacgggatcaacaatggcatggccttgaaaattatcggtaagccagcccgtgaaggttcatacggcttcgcagcttcgaagaataatcgggcgctcatcacgaagtttaacgctggtttgaagaaacttcgggcaaacggccaatacgataagatcattgaacgttatcttggcaacggcagtgcaaagtcccaaaaaactgccgctggcaatgcgcaaacaactgatcgttctttcttcggtttgttgaaggctaactggggcaccttaatgagcggcctggaagagacaatggttctcacggttgtcgccattttcttcgctaccttggttgggattcttgttgggttgttaggcgtcttgccaaataaatttgcacaaggggtcgcgacgaccttcatttacattttccgcggtcttccactgatggttttggctctgtttatctataccggggtgccaagcctgattggatcaaaagtaccagcattcattgctgggattgtgactttgaccttaaacgaaggcgcgtacaccgcagccttcgtcaagggcggtattcaggcggttgatccgggccagatggaagcggcgcgaagtctaggcctgccatttggtaaagcgatgcggaaggttattttgccgcaaggaatcaaaatcatgattccaagtttcatcaaccaatttattattacattgaaggatacctcaatcctgtcgatcatcggcttgctggaactgacccaaaccgggaagatcatcattgcccgcaacatggaagggttcaagatctggacgatggtcgccttgatttacttgattattattacgttattgacctggctgagtaactgggttcagaagaaggtgaaggcatgagcgattatcgcgttgaaatgaaaaatgtgcacaagagttacggtgacaatgatgtggtcaagggtgtcaatctgaatgtggcgaacaatgaagtggtcgttatgatcggggcatccggtgcggggaaaagtaccgtcttgcgcatgatcaacggtcttgaaaccgtcacaagcggagagatcttgattgatggtgaagatattgcccataaaggcaccaacatcaacaaagttcgtgaaaaaatcgggatggtgttccagcattttaatctgttcccgaacatgtcagtgatgggtaatgtgaccttggcgccaaccgagctgggaatcgccagcaaggaggaagccatcaagcaggcaaaagccatgttggaagttgttggtttgacggacaaggcagatgcgatgccagctcagctttctggtgggcaacagcaacgtgtcgcgattgcgcgggcgttggcgatgcatcctgatatcatgctgtttgatgaaccgaccagtgcgttggatccagaaatggtcggcgatgtgctaggtgttatgcggcggctggccaagcaaggcatgacgatggtcatcgtgactcatgaaatgggcttcgccaaagaagtggctgatcgggttgtcttctttgacaatggcactatccttgaacaaggcacgcctgaagacattttcgagcatccaaaggaagaacggaccaagagcttcctgaacaaggtgctgaacgcttaaatattgatttttagaagatagcaaaacggccaacccactagttgatggattggccgtttgctgttttaatttcctgggaaatagttttcgtttcgaaaatacatagcgaagcgatttattcagctaagccatgatcgagaatttgattcatcactgcggccacactgccagcgtaacccatgccgaacttatcaagatgaaccatcagataatacagccggtaaaagtcaaggcgaaagtgataaccagcatcaagtgggtagacttcttgatagccagtgtaaaagttttgggtgaatccgccaaaaactgtcgttaccccgatatcgagttcgcgatcaccatatactgctgcaggatcaatcagagctggctgaccatcggcagtaaacatgtagttcccaccccataagtcaccgtgcagcagggaagcatcgctgtgatgatgggccagtgttttgctgatgatggtgcgcacctgttggaaggttgcttcatcgtcggcttgccacagcccctttttaagcaggtgtgcggcgagtttgtccaagcgttgatgaatgaatagatctgcccatgaatcggtccaggtgttggtaaatgagacgctggtgcctgcataagggtagtcaaagccgaatcggccatttggttcatgatgttgatgcaaatgcgcgactaatcgccctaaatcgcgttgcgacccattgccgctggtaaggaaactgagtagcagaaaaccatcgccttcaatttgaccattagcaatgacacgcggtgctaagatttgtgcctcgtcaaatgcttttaagccagctatttcgccagcataaaaatcagcaggataacccggttgaaccagcaaaaagtaaggctttgtcgccgtatcgatccggtatgcctgattgacgtcaccgccaccaaccggggtgacttgcgtgatggcggtcagcggtaattgtttgatccaagatgaagtcagcatattattcctcctcattaacgcgatctccagcgtagttacccgcgctggagatcgctcgcccccaccttagaacagccaggtgcgtgattgcaacgggtcagtcgtttaacaggtaataaataaatcgttgcggatcatctaaaaagtgacgcagaaaagcgaaatgttcgatttgattatattgagtgggtgctagtgtgtcacccaacgccagtagttgcgcattcggataggccatgagaatcggcgaatgtgtactaatgataaactgcgagccattttctaccgcatcatgtagtaaggctaatagcctgagctgattttccggcgtgagcggtgattctggttcatctagcaggtaaagtgcatttggacgcagtcgagcacgaaataaagcaaggaacgcctgaccatgggaaagcttgtcgagatcaacttgataaagatggtgaatggcactgagtgtattgagataaggcaagcgttccaaactatcgggtgccagttgctcaagctgtgtctgcgcgtatttgatccggccacgggttgcgcgaatgaatgagataaaatcatctgcccgaaagaaaaagcctgccttcgtccgatattgccaagtcaacttgaggcaacgggctaaggcacggctattttgatattccgggtcctcatcaagggaagccccgctcatgaggattgcattgtaattagcagcaatagcattcagcaaagtagatttgccactaccattgtcgcctgtcaaaatcgtgacgggttgcgacaatgtcaggtcacgaaaggaagcttgccaaggcaagttgaatggatacgcggtttttgattttggtggggtgtactggatacgattaagcagcatgattgtctccttcttgcggcactgatggtaatggctgataccaagtcataatctgcttggccaaatcaacagccatatagcgggagttgactgtctgatcgctgttgcctttgcgaatatgcacctctaaatgggcaacgccacgcgccttcatccagatggattgtttgatcgtcatggcctgaatgtcttttttacggacaaaataacgttgccttgtccacatttcaccgacttgaatgataagttgcttaggtggcgcaatagcaatggcggctgtggttgccgcatattgaccttgcaacgccatgacgactaaccaaatcaagccagccagtaccagccacagccaccaactgacgtgcaaccaaaacacacttgcgagcacaaccggcaacaccagtagtgtcagatgacctaggaccatgttgcgcatgtagtaccagcggttgctaactggaattggctgtagtttcggtgatgtttccggcaaccagctgacgaatgcccgcatgctgctgagtgcttgccgttctgggataaccggcatcaggaccagatcattattctgctggtcatcagcggcgcttgagactaataacgcctgaacggtgctaagatgcagccattgccgcaaaatgctctgcttaaagcgaaccgcctgcaagcgtgacagtcgggcactgaccgtattggtttgaaaaaagccgcggctggttcgtagttcgtcaccggttcggtccaaagtgaagtggtagtatttttgaataatattcaaataggagatcaggaaacctagaatgagaataataagtgtcagaccgataataaggtaaaccgctaagccagtgatggcatgctcagcattcttgtaccagctatctggcaggtattcttgagctttttgtgttaaccaaagaatcccggaaatgatggggatgaagcctagtgaagtgagcgcgtattgattaagatcatggccgttgattttataggccgcatctgccacaggtgcggctggtgcggcggtggtgcttgtttgatcgggtgcagcagggatagcctgattatcagtcgcatcaggtgtcactggctgaacgtttccttgacggtagcggttgatggcatcagctacggctactggcacggccgagagcattccttcggcttttttagattctttgccagctgtttcgatggcaacctgttcgagaccgagtggctttagaaaaaaccattgttgccgttgtaccgtctgaatacggtcataagggatgtgattgactttacgaatcaacacaccactgttgatggtcagaccgttcggggcaacaagataggtaaatcgcaaataatgcaggattgaccagatgagggtgagtaccaaaacgccaacaattaggccgccccacaatagaaattgattgaagctcatgtctgcgcgcagtattgaaagccctccgccaacaaataacggccaccacgaaataaagcctctgatccaaataattagtagcgcgacaggcgcgagtcgttgcggttggtcagtcttcatcgcgcgcctcctgagccaattggaggatttgattgcgcaattggtcggccactggtcgcgtcacaccatcaatcacgtgggcggtgctggcggtttcgatgttgacttgttgcagtgtctgccactgaagtaaaggaccggcttctaacgtgacattttgaatccgcgaaatcggaacggcttcattttttcggaagaaaaagcctttttgcaagaaaaccgcggttggcgtgatgttgtagcgccaaaaacgatagcgatacggcacaagtgctaatcggaacagcagttgaataatcgcaatgccaataagacccaacccaagccaaaaggaccaatgccagaaaaaccaagcggcaatgagtcccaaaccgatgatcatgagcactagcgcccacaacgccgcacttgcccgccaaattcgttgaatggttgctggtagcgcttgtcccgtttgttccatttcctcgcctccgttttcgtcagaatagcagaaaatagacctaagtgaaactgttacaacaagaatcaggcaagatttttcactaaagaagggattccgcaggcacataaaaagcgcgtcatcttcgccgggataagacaccggtaaaaatggccgcgctattatgataaaataaacaaacctaaaccattggtgcgtaaatcaactcgatcaactgctttttcatcgcaatattgacgccggtgatcggctgctcaagaattttttgatattcttcaaggacatcatagggcagcggggtgagcagattgagatcatcaatcacatcgctgacccgatcggttgtgctaaggtcaacgaaaatgtcaattttgttcaagcagtcagccaataagtcggtcatgccggcatcaggcttgccgctttgatcagtgatgacaacttgcaggtgattgactggctcatgatcgatttggataaactttaaagccgaataaatattcatggcacacctcgtcctagctgaataaaatcacatcgggttaaattcagtttaacccaattttaggcatttggtgaaatttttacaagagagttgtatcttgatcggtcgggcgccataatattggtgacaaggattattttacttttgggggcaaaatatggagcttaatgtatctgctttggccgcctcacgattggcgccgatgttacatgccgataaggcgctaatccttgatattaatgacggtattggtccttattcacggccatcaaaaacatcaggacaggcgaaattcaatttattgattctaccgcgtaccaatgtacccgatgtgtatgatgcacaccttgattcgccggtggggccggtattgatcaaaagttatacgagtgggttttttaaagcagaaacagaattaacagtcagcggtgatcactttgctattgttcccggtgaaccgcaacttgatcccaatgtccggttgaagtttgtataactcaaccgtctttttctgttatgataaccccaaggattgtgatgacttgtcacagttagagggggaatatctatggatcgtacttctttaaaagatcaggccaaggctgagctgaatcccaactttagctattatttacggattagtttaccggcattattattgacagcctttgtggcgctggtgccattcccgcttaatgaaaatatgcatcgagctggtatccgtgtcgtagctcatggcagccgacggatgatgacaaatggttattggaacaacatcgcaatgtggcagacagcagtgacatttatcggtttgctgacagcgctgctcatgatcggtgtcagcttcgctatgattgacgggttgcgcggtcggtcggatcaccggtttagctggacgcagatgttcaaaatttttgaacgtggcgaatattttctcggcagcttgctgatcggtttgctgcaagtcgtttgggtcagcctgtggatgttgttattggttgttcccgggattgtcaaaggattggcttattcacaagcccagttgatttatcgtgatgccattgatgctggccagccaattggctataccgaggctgtcacgcgcagccgtcaattgatgtacggccataagtgggagttcttcgttttgctcctcagtttcctaggttggtggttgttggaaatgatcacgtttggcttagcgtcaatttgggtcataccatatcgcacgatgacactggctaatttctatctaaaattgaccgaagaacaagcctgacatcatctcatagcttcatgctaaaaaagaaggcatacgctttcttttttttgcctttagttccccttgatccggtaagtattggtatactattcgtggttgacgacaacgcacttatatccgaatagggataggtcaagttgtctctgttcacgacaaaccgcgataatggagggaaaatgatgaagagacgttggttgcttgggtttgcgacagtgttgatggcagtcctgctggttgcttgcggtagcggcagttcagcgcaaaagagtacaaaggggccagtgacgattacattctggcaccgcatgacaggaaattataacaaggcgcttgaaggttatatcaagacgttcaacagcagtcaaaagcagtacaaagttgttgctacttcgcaagggtcttatgataacctacaaaaaaagtatctggcttcagcgaaatctcgcacgttgccaaccattgggcaggtaactgatacgatcattcctgaatacgtgcatgacgggatgttagttaacattgacagtcaggtgaagtcacaattttccgcaaatgagctcaaagccatttatccgggcattgcgacaaacttgaagtatgaaggtaaatattaccaaattccatttgccactgggacacgattgatgttctataacaaggatattttggataagtaccatctcagcgtgcccaagacttgggaagaactgactaaaatgagtcagcagctcaaagacgacggcattactggggtcgcattcaacaaaagttatgattttgaatttgaaaccttggcctatgatgctggtaatcgcctgatcacgccgaagtatcaggcaaaaattgacacaccggccagcattaaggctatgaccgccatcacgaccatgttaaaagataagacggcggtcactgccggcttggacaattattttaacgtgccatttgttcaaggtaaaatttttgccgggtttggctctagtgcgacaattcagcaaattgcagcaacagcgccgaagtccatgcactggggaaccgctgtgatgccaagctttgctggcaaggccagttctgtattgggcaacaatgggatttccgttttcaaaggcgcttcagctgatcagatcaaaggtgcggttaccttcatgaaattcctgatgagcaccaagattcaaacgcaatgggctaaggctagcggttatgtgccggttgtgaagaccgcaacccagtccagcgcttatcaagcctacttgaaagagaatccgacctatcaggcagcagtggatgcttatgacgatgcgttttcctcaacgccatttattggttacaatacgtaccgcaataacttgcttgatgctgtggaccaaaccgtttcgaaaaatgctgagcccaaaacagtactgacgaatttgcagaagcaagctgatacgattttgaaagataataagtaagactcattagaaagcaggtcaccgcatgacgacattcaaacgcattttaaaacgaacgctgatgtacacgttgctggttttaggactggctattctcatgacatttggctacgtcggctatcgggatgtcacaggcggtaagggctacttggccatgcgttatttgattttgacactagaatcggtcgttggcggctttttcctgtttcttattgtggtgagcttggatacgtggagcgaacaccgcaagcagaagcgtgagcagcagtcaaaaaagtaaaatcgttgtaaaagggacttggttaaaagttctttgccgtgccaaactccgcaatctccggccagctggggctggcgacgcgtagctagagcggagacggcgcttcgagcccgcaaagcccgcggtctagaccactatcaagaattcgttatcatcgttgcacttgacttgaaaattgaggacttatttttatttttaacgacttacaggttctcaaaatgacaacatgtaccaattttcgttaaaaaaagaaattgaaatcatgaattcagcggtaacagacatttccataattagaccaaatcaggaaaataattattttgataagaaagcgttctcattacgttctaattttttgtttaacagccatttaatcacaccagtaacaaaaaaatccctcgatggtctaaaaacctgtcgagggataacttttgtctttatgaatatgttgggcacctgatgatccgcaaccttatgcgtctacccctggagtagaagtgacgattgccaatttgccagtgaatgcccaagtcttgatctggttgggaatcaagaaactatcgcctgttttgatcgggtaatccttcccgtctgcggaaaaggtcccgtcaccgtcaagtactgttacattggtataaggtgcttgttgggtgaacgtcatggtgccatcaacatcaaggcgataaacggcaaaatgcggtgacagcggcggtttaacaaacgtggtgatttgcccgcctgtcacttgttctttggtgatatcgagcttcgggtcatggaaaggaacggtcgtcacatcaaggctttgcttaatatgcaactcacgcctgtgaccttgatcatctttccgatcatagtcgtaaagccgataagtcgtatcggaactttgttgggtttccaatgccacgatgcctttgtttaaagcatgtatcgtgccgcttggaacatacacaaagtcgccagtcttgactggatatttccgcaacaagtgctcccaatcgccggcttcgatcatttctttgagctgttcatgcgttttggcgtgatgcccatagatcaaataagcccctggatcagccttcaggatgtaccagcattcagtcttaccgagttcgccttttgcttcgtgggccgcagcataagcatcgtcagggtgaacctgaacacttaaactagcttcggcatcgagaatcttcacgagcaacgggaactcctgactatgttgtggaccaaaataagcgggatcttcatgccacgcctcgcgaagggttttacctttcaatggaccgttttcaatggtcgccggaccatgcggatgacctgagatgatccaagcctcaccgattttaccgtctggaatgtcaaagccgtactcagtttcgagtttgcggccgccccatatcttaggattgaagtatggttttaaaaataatggttctgtcaaaatgcccactccttttttaaacaagcgcttcagatcagaaatccgcatgttaaacctctgaaccacatgatgaacaccccatcatctcattcatgtccgctaatacgccgttttctaaccaatttgcctttgcgctgctttttcgtcgttttcaagttcattatacagtacctatctagaccgctgacctttattttgtaaacttgcggctcaattaaactaaataacaagacgaaaccttactagccgattattttgcgggtgaatgctgacgaggtagttgtcaaaacagccaaaatcatctcaatgacatcacaatttcatcaaatccttgcgtgacactatgaaatggtgttggcgcacaacaccataacggcccgttgcgcaaaagatgcgtagcgggccgtattttcagttattgtcaggaattagacggccatgcgatgttgccgccaaaagaaaacaatgctaatgacaccaaaaatcgtggcaagcccagctagcatcaattcccacccggaagcttctgccgtttttggtaagtaccggtctggattcacaatggtttttgttggcacttgctgctgccttggatcgggttgcggccccggcttcagaaccaacgcagcgatggcagctgtgatcttggcagccatggtatcaacttgggcttgctgggtgatgctgagattacgattaacagcagcaagcgccgcatcaacggcactaatgtcttgatagtgtgaccggtcaagtttctttgcagctgcaatggcggcatcaacctttgtgtaatcggctggccgcagttgcagtgccttgatggcgacagtaatggtctgggcatagccgtcaaccaatgcctgatcggttgcctttttaccgcggacaacagcatttaacgctgcatcaagtttagcaactgatgcttcggtgtactgattaagttgccgcggcacggcagcgatggcggcatcaactttactgtaatcggctgggcgaactaagtaaggtgcataggcggtcgaaaattgatccatcaacttcaacagcgccggcatatctaactgtgcactcggatcatccgcccaaactgcctgcatactgccaataatcggcacggcactcgaagcgccgggtacatcagtaaattttttacttgctaaactagctagcgccgttttgtaactatagagatcgccgtccacgcgacctaaaacccaataccaaccgtcattggtattcatgattttcaaacccttatcggtcaaaaattctggctttgcgacatcatacccgccccagccagctgtccaataagagacgatcaaatccttgtcaaaagtcccgaaactggtgttattgtcataataaatcccgtcattgaaaaccatcggcttcaggccggcatttttggccatcaccgctaagtcgttgacgtatgccacaaactttttgtaggtgccactttgttgcaacttggcccagccgccagtatcgacatcatttgcatactcgtcactgccaaagttgaagatcgtagcatgccccttgaaatacatcacatacttctgcaatagcgcttttgtaaaggcaatagcagtgtcattgttaagatcgacagtccgtttagacccattaaaggcaggattcttaatgcctagttgcgccatcgccgtcaaaatggcatccatatggccgggactattgataaccggaatgatattgatatcccgtgccgctgcatatttcaagaccgcatccatgtcggtttgcgtcaacgcattcccgtttggatcatcgtagtacgctttgctaccagcctgtatggcctgtttcacgacatcactgccatatgttttgccattgatcgtcacgctcatgtcatcaagtagcaatcgcaatgcatcgttacccaataaaacctgcacatcggtgtaaccgtctgtatgtgcccgatcaatgatcgttttcaactgatccgcggaaaaatactttcgtcccgcatcaatcgaaaaaacgcttttcaaggtgttatcagcagcagctacctgcttgggcggctgactcagactcaacaccatacccagcagtccaacaatcgccaataaccaaaatcgaaacccgtgcttcttcaaaacttcaacctccttttgtggatggtttctgcaacaagattggcctattccaccaacaagttaagaatatgctggaatcgctttcaattcaaaatgattttcatatctcacacgttattctcatatttcgttaatattattcatcgtatgtttgcttttaaatggttaccccctcgctttaaaggatctagatggtcttgttggtatgtaaaaagagccatcccaaatggaatgactcttttcagcatgcgactagcagcttatttcttagttgttcgccgagtggttttgggcgccgcttttttggtcgtccgcttcgttatcttggctgctggcttcttagctgccgctggcttggtcgctgatgttttcgccgctgtcgttgttttcttggttgttttgcgcgtcgttgccgtccggcgcgtggtctttttggctggtgttttttgcttattagctggcaccggttttgcggtttctttgggcttcgccatttcttcttgaatatggtcaagtttctcatgaacggaagcggtcatttgcctattgagcgtctcaaagcctgtgagataatccgctgccgttgcaatttcatcgattctcaaacccgacacgttcacaaatggtgatgccaccactaaatagacccgaaccggcacaatctcgtctgcctcaagaaagttcgtgactttattgacattcgcaaacggcagattgatgatgccagtttcaactgtgatgatggtcggctcaggaaaatcgatgacgaggtcggcctgaatcagttgctgcttgtcgatggccttgcggacgtctgcaaacaccttcgtcaagcccgcctcgatgccgtcctttttgaacgctgcagcggtcagatgattctcggtatgctcgaagctgccatctaaaatggcttcctgaaacttgtgtacattgatttccatatcagtctccttaaaagcttagaactgctcagaccatcatagcccaccacagcaagcagacgcaaactaaaaaagaccatcaaggcaagcaacgctcgccttctagtcttttttaaataaagttatttattttcttttaaaatagtttcagtctgcttttgcaaattgttaaacgctgtttcgccgctgacattcttggtcagcgtgctgtcgacagtactcatcaaatcgttacgataatcggtgtaaccggtaaagacagttgaggcaaaactctgtgaaactgcagagaccgcggctttatacttgttgttcttttgtagataattcttaaatgtcgtactgttagatgccgtttttgtcaccggcacatagccagaatccatcgcccactgtgatgcattttcagacttcagcaagaatttctggaacgcccaagcgcctgcttgttgcgctttagaggcccctttaaacaaaacattgtaatttccgttcagtggattgctgcgtttgccttcgtatgtcggaatcacagcagtaccccagtcaagatcctttggggcctgttggataagaaccggcacggttgccgaagaaccaatcccaaagaccgcttttccatttgcaaatggcacactgaagtattgatcttcgccagcagttttcaacgcaccgctcttgcgcagatccagaatttgattcacagctgccaatgtcttcggtgcatttaaattagccttcagtttcggtgtaattagttgactgccagcaccatatgccatcccctcaagcgcaacatcataactttgatctaactcaatcgcgttgacatcagttcccttgagtttctcctgatcggctgcaaaatcagcccatgttttcggtatgctgatattgtactgggacatcaacttcttgttataaaacaacaccgaagtcgagactgagaatggcaatccgtagtacttgccctcatatttacctgcagacaaaaagcttggataaatatcttttaaatcagcattgctcaacttatccgcgccatttaacatttctggatcaaatggcaataacaacttgttcttcacgtagtcgccaatgttcgtatacggtgactgcgccatggtcggcaacgtttttgatttgccggctgccataattttctgttgcaacgcgttgtatgatccctgcgaagttgcgacaattttatacttcttttggctctggttgaacttggtgatgagcttgttcaacgatttatcataagtccccgtcatccgatgccagtaggtgattttcactggcgcacttgaagacgatttcgtagccgtcccctgcttgccacaggctgtcagtaacaacaaaacagcacccattaagcctaatagccgccaaaaactagtctttttcatttctaggtccctcattcagtgtcgcggcttaccgatcgacagtgtttgcaagccgccgtatttgtcatgtcttgacacccttattatgcttcttatatttataaaagcaaagaaacactcggtatttttagttttcaaaagttacgctaaaattgccgtgccaaactccgcaatctccggccggatgaggcttgcgacgcggagctagagcgtgacggcgcatgaccctgactcaccagtctttcccatagagaatgtatgttctatactaataactaaccatgacaagcaagggggggcgcagtgatggcaaacaatcgcattggtattcgtgagttcgttgagttaaccgttcgcaccggcgacctcaatccaatcaccagcaattcaaataacaccgccatcattggtagccaaattcatcgtaaacttcaagctgctcaccgtgagtccgattacgaaagggaagtttacctcaaaaccgccgtcaccgtgaacgatgaagactatcagctcgaaggccgagcggatggtgtctggacagatgacaccggcctcacagttgaggaaatcaaaaccagtgcgcgcccatgggaagaggccacacaaaatacaaaagaccgctattgggcgcaagcacgtatttatggccatctactttgtgaacaacggcatttggatcaagcaacaatcacgctggtttatgtccagaccagcaccgacacagtcagccgtttcagtgaagtcaaaagtgccgccgagttggctgatgatttcactgatttacttgaagaatttcgcgactggctcaaactacgtagtgatatcatcaaacgacgcaacacctccatcgaccagcttgattttccatttccgcaattccgagctggtcaacatgagctagccgccgctgtttataaggcgatctacagccaagcacgtttgtttgtacaagctcccaccggcactggtaaaaccatctctgcacttttcccaaccttaaaagcgatgggcacgggcttgatccaacgagccttttacctaactgccaagcaaagcactcgacgcgtggctgaacaggcgatggccttgatggcgcaagcaggtttaaccgccaaaagtatcactttaacggctaaagacaccatcacatttgctgacgaacctgatgaccccagcaagaatccttacatgttaggttactatgatcgcctaaaaccagccttacacgatctactggaacacgaggatcaactgacgcgtcccgtcatcgagacttatgctcgcaaacataggctcgatccatttgaattttcactggatgccagcctattttgcgacgtcatcatctgtgattacaattatctctttgatccgctggtttttttgcaacgcttttttagcgaaaaagatgacagcaatttcttcctgatcgatgaagcgcacaacttagtcagtcgcgcgcgggacatgtacaccgctgccatcacagatcaagatttcgtccagttaaaaaaagcgctaaccccttataaaggtggcccgttgacaaaagttcaccgcgccatgacacgtattttgaatacccttgatgcaatgacttcaaccttgttgacctcacaaccgaccatctttcaagatgatccgcttgatgacctcaccgcagttctttttcgcttcaccgaagtcgttcacgattggctcagcgaaccgccaacccccgcgttgcaacctgctgtcgatctcgttttgccggtattttttctagccaatcaatatctgcgaattggcgacttctatgacgcgacattcaaaaccgaagtcactaaagaaaacggccagattatggttaaagaactgtgtctcgatccatcgcaatttgtggacgaagccttgaaaaaagggcgtggtgccgtcttattttcggcgaccttatcaccgattgcatattttcaaaagttgcttggcgggatcgacaacagtctcgcctatacgctgccctccccatttgatcccgccaaacaagcagttattgttgacgctagtgtcaatacgacttatcgacgacgcacgcaggatttgccgcagttgattgcgagcctgacaacattagttcgcaccaaaagcggcaattatctcttcttttttccatcctatgcctacttgaaaacggcctatgaagccttcactgcggcgaatcccaatctaaaggtttgcgctcaagaaaatgccatgactgaagcggatcggcaaacatttctagatcattttcaaactggtagtgaaccgattatcgggtttgccgtacttggcgggatctttgctgaaggcattgatctcaagggaagtcgactgattggcgttgcaattatctccgtggggttgccaggtatcaatgctgaaaccgatcaactgcgggcctattttgatcgggcaaacggtcaaggattcgcatatgcctatcagctgccgggtttcaataacgtgttacaagcaggtggccgcgtcatccgcggtaccaaggacgtcggagtcatcctgctgattgacgaacggtttattaccccgcgttatgcccgcctttttccagatcactggacccacgcccaagtcagctacaacccaacgcaattagctcaactcttgacgcatttctgggaggcccatcatgaaaacacagctcacgcttgatttagaaaaaacgctttatgcctactggcaagaacaaggggccattgtggttgaagaagtgacgatgccagacaatcgcggaattgtcgataccctggttcgccaaaagcagcaagacgcgaccatttggcgttgttttgagctcaaagtcaccaaagccgacttctatagtagcgccaaactcagctttatcggtcattacaactactttgtcttgccacaacgactgtacacggcggtggctagtgaaattccacatgggatcggtgtttttacctaccatcccttctctaaagccgcaatcgccgccagcgctgttcctgtggtaacacccggtactttgacgatcgccaaaccagctcgccgtcaagaactgcaagtccctgaagccactttgaccgaccatttcatcgccagcctcaatcgcgaagtagtcaaggccaaacaagttgccaagggccttggccaattctcagaagccgatctatttactgaactgaaaaaacgctcagccgattacgatatttatcaccctgacaagaatctttatgatcaatttgtttcggagctcgacaataccacgatcaatgccttacaagaagagattgacgcgttgaatgctgaactcgctaccgccaaaatggacacctcaaaatgaactattttccgattattcgtggcaaattatacgacttggccgcagtgacgcagctggttgccgaccaccaattgcccaacactgtaacgcctatcatcgaaccggttaaagatatcgcgggcgtcacgaaagcaacgagcgcaatggcccatgcagcacatcccggctatgtgattcaaaatccgcaagttggcaactatcagttgttagcggcaccgcgccatcttgctgttttgagtcataccgtgcaacccgctcggatttttgatgcacagccagctgccttggtgatcgcaacaacagctgcccaagcgaaactcctgccaaagcgccaattagccctagtgccggacgaggcacgagttcgccaattggccttaccacatgccgtctatctcaatgaccatttcaccgtttatccacacacggatgattatggcatcttgcaagacgaattctatcaatacgcgccaccatcgctgcctggtattggcttcgccgactacccgctcgcgactagcgcttatttcgagcatggttatccgcaacgtgccgtcgcgatccatcttgtttaccccgccgaagatggcacgttacgattacatcattttgtgtcggtcaatcatgatgattttgctaatccgcaagctaagtttttcgaagtcttggcccaactcgcagcttggctgccgtttcatctcgatgcccaaacaactgggactgccgccttcatggatgcggccaatcgccatcattttcctggccttggtgtagttcgtaaatatcagcttatgcatcatctcgaacttatcggacgctggttacaaacatcaactcaacgttaacgaaaaatcgattgtcgcaaagctggcaatcgattttttgctagcgtttttacaatatttttgaaagcgtttcttaatgaatatttcacaattttagccgtggacaatctagtcatagacaaccaattatgttacgctttctttgtgaaaaggttatcaatttgtgaaggagtgtttaactaatgaaaattcttgttattggtgcgacccatgccggtacattcgcgacacagcaaatcttgacagagcatcctgattatgacgtcaccgtgtacgaacgtaatcataatctgtcatttctatcatgcggcatcgctttgtgggttggtgatcatgtcagtgaccccgaaaaaatgttttattccagtcctgaagcattggctgcgctgggtgctaacatgcaaatggagcatgacgttttggcgattgatcctgtagcgaaaacggttgaagtcaaggatctcaaaaccggcaacgtgaccactgatacatatgacaaattggtttacacaactggttcgacgccgatcgtcccaaacattccgggcattcacgacacggatgttcatctttgcaaaaattggcatgatgccaaggctttaaaggcgcttgctccgaccattaaaagtgcgatcgtaatcggtgccggctatattggcgccgagcttgccgaacagtatgcactaactgacaaacaagttactttgatcgatggcttaccacgtgtgttggcgaaaaactttgacgctaccattacagatcgagtagaaaaactttatacggatcatggcgtcaatttagcactgggtgagatggtcaccggtttcaaccaaggtactgatggtgagatgaccgtcacaactgacaaaggcagctatacagcagatgtcgctgttttgtgtaccggtttccgaccaaacacggaactgctgaaagaccatttggagaccttgccaaatggtgccgtgatcaccgacgcctatatgcaaactagcgatcctgctatttttgcagccggcgacactgctaccgtgcattacaacccgactggcaaaaatgactacattccgttagcaaccaatgccgtccgtcaaggtattttagtcggcaaaaatattgaaaaaccaaccgaaaagtatctcggtacccaatcaagttcagcggttgaacttttcgaacacgccattgctgcctctggcatgaccactgaaggagccaaagcccgtggcattgaggttgccagcgtgaccattgagcaggattaccgacctgattttatgctgaccaccacgccggttctttgcagcttgacttgggatcctaaaacgcacgaagtcaaaggcggggccttcttttccaagcatgacatcagccaaagtgccaatgtcatctccttggcgattcaaacgcacatgacgatcgaaacattggccatggtcgacatgctcttccagccaaactttgaccagccaatcaactgggtcaacgccgtcgccatggcagccgttgccaaagctcaggaaatggaaaaaacaccggtggcttaattcagctgaattgcaaacgattatctaagagcaacaaattcttcttagaatttatgatttgttaggttccgaataacccggaaaaagcgcaagggcaaaaaagttctttgccgtggcccactcataaatcccagtcattacccgataaaaaccaaaaagcgaatgatttcccctgtataagaagaggaggtcattcgtttttgcttgacgtctgaaaatttttccctgacttttccaatgcacgggttacccagtcactttcgcgtctgatcaagcgcatgaaactatttgcccacgaaaattgagcttgaagcagccaaacaaaatagccttgaaactgccggccaacaagtgctatctgagccgcgatcacgattcagaaactggtgatttttttcgattttaatcattgaatgtggctaaagttgtttttaatcttgagtaatttttaatcctaccgttaatgtctattttcaaacatattaatcaacagcaaaaaataaacgttgcaaaatcgtcttttttcgtcgcattttgaaacttatggctaaataagccacgaaaagcccgaataacgcaacgttaatttctctgctgcctataaatcgcctaatacttgtatattatgtacagggtcgctagcacctagatagttttgtctcagatctacggcaattagcgggaaggagaggaaagagaaatcatttttgaccccttcaaccgtgacatactaagcacactttttcatatgtgttcttgtactatcccaaacgaaggggtgacactacatggcaattgccgatactacctcagcaatggtttccgcactgctgggcattatggacaatcgccgtggttgtagtaagccgaaacattcaaaaaatactaggagctgaaacttatgttggaaaataacttagtacttaaaaacttttcgtgcatcgatgattcagaattagcagaaagtcaaggcggcatcggtgttgtcgctaccggtgtcatcattggaagcctcactgtatttctgtccggtgtcttctctggctttacggatggcatgacgcaagaaaagaaacctgcaactgtataaacaagtcgtgaacgtgccaaagcaattcgtacttcgcgttctcgcaaagaagctccctttggccattattgcccgtcttttgatcttgatgctttggcagtttggcacggaggtcttgcaaacttaatttcatgtgggttatcaaaaaggtagctctatagctagttgtttgaaatagacacgataaatggaggaagccacaatgaatcaaaaagctttgaatcaatttcctgaacttacctacacagaacaagtgtcggttgttggcggcgatttgtcagtcgaggtcatcatgaaaggtatcttcaccggtatctttgatgctgggtaccaagtgggtcagtcaatcgcaaaatgggttaagtaatcattgagctaaagctacaaaagcttgcatgatgctcaccagaccaaaacgcagtgcacacttattgagtgcactgtttgtgcttttcagctttctatttgtcctcagttatcccccactccaaaaaagctgacgcatctaaaggtatctcacttgcttagagagatgtcgttcaataccgtttaaaaataaacgtagcaaaatccgcttttttcgtcgttatttggctttttggacactgctagcgacgaaaaagcagcaattatcaacgttaaaatttaaagcgacggatttacaattcaagtgcaacaaattagtcaaatagaaaagactcatagttgagacagattttaagagacattcagaaccgcgtttaccttccacagctcaaatggcgacatggcgaaaactgcacaacttgccggatacttttacggctagcggcattatttccaagtcggctgattttaaagttaacaacagcgatctgaaaacctatacagcggatacatttatccagaagctgccgggttattcagcccaaaatagcacgtttgcgttcatgattggttttctatttgtgatttcgctgattgtcatcgcggtcttcctgtacattttgaccatgcagaagattcctaactacgccattttacgggcacaaggtgtaccggcgcggaccctcgttaaaacgaccattgcgcaagcactcatgcttgtgtcattcggtctgatcctcggtggggtgctgacggcagttacagcgcggttcatgcctctgggtgtgccgatgattttctccgccggtttaagcatcgcagttgttattggcattttgctcaccggcttactcggtgcaattgtcccagtccggacgattcttaaagttgatcctgtcacagccattggaggttgattgtatgtcagctatcgaattacaacacatcattaaaaattttaaaacgccaaccagcgatgtcgaagtcctcaaagatgttagcttcagtgccgaacccggcagtctttcgctagtgcttgggccgtctggttcagggaaaagtacgtttttgaccattgcaggtggcattcaaaccccaacatcaggggtcgtgacaaccgctggacaggagcttgataagttatccggcaaggcgcgtgatgcattgcggttggataagatcggatttgttcttcagtcatacaacctcgtcccatatttgacggttggcgagcagttcactttagtcgacaagattaagccaaaaaacaacctcagtcatgaggaacttgatcaattgctggatgatctcggtattggtgacctagttaatcaatatccggtttccttatccggcggccaaacacaacgggtagcaattgcacgagccttgtatcccgatccagccatcgtgttggccgacgaaccaaccgccgcattggatagtccgcgtgtggcagttgtcggacagctgctagctgatctggcacataagcgtgataaggcaattgttgttgtcacccatgatgttcgcttagaaaagtttgcggatcgcacgtttactttgttggatggtcagttaagcgaaggtgacacttccaacgcagcatagtgaaaaacaactggttgctacagtatgattaacgcggtagatgcttaaagagccctcttgtgtcagaattctgacacaagagggctctttttgaagcttaatcgtttatctggctgattgaaatgaagacatcatttgcctaatgtctttttaaaagtaattagaatcgcggttcgcctaaagcgtgttgcgcagccaagttcagcaagctccattgacgatcaaaacctggctggaagaagaagtcggcttcagccaagtcttcaaggcttaattgttgttgaacggcgagtgccaagacgttgccttgtgcagtcacatcgtaagtggacaatactgcaccgcctaacagtcgatgagtttgcgggtcaaagactaagttgacgcaaacttgtggattgccgttagcttctggcacatagtctggccgcagtgaatcggtgtagaaagcggtatgcacgttaacgtcagcccgtttagctgtgaaggtgttcaggccgctagctgcaaaatggtagtcgaaaacgctcaacgcactggaaccaacgacgcccttgaatggccgtgctggattttctgcaaaaatgttttcggcaaggtaacgggcttcacgccgcgcaacggttgccaaggcaatcggtaccttttgttgtgctgggattgagtaaaccaaagtggcatcaccgatagcataaacgtctggcaaattggtccgcagataaggatcggtgttgatgaagccgcgtttatcaaggttaacggtgcccttgagccattccgttgctggcttgatacccgctgcttgaatcacgagatcggttttaacgtcaccggcatccgttttgacggcgctaacagcttcatcgcctgtgaaggcttcgatcttgacaccaagcttgagttcaacacctttatcagtgagttccttggccagaatgtcggtcatttctggatccagataggtacccagtgggcgatcaatcatatccaacaacgttacttgtttaccagctttacgactggcttcagccgcttcaatcccgatataaccggcaccgatgatggtgacgtgcttaaccgccggatcttctaacttggccttgatgttggtggcccaatcgtagccacgcatcaagaagacattcttcaaatcgttgcctggcactggtaaggaattcgggcgaacgcctgaactcagaattaatttgtcataaggataatcctgcgtcgtgccgttcttcgtgtcgcgaacggtgacggatttcacatcagcattgattgccgtcacttcatggttgtttaacacatgtgcgccgcgcttgatcaaatcgtctggacgaaaattccgaacatcattcacatcggttacttgattttctaagaatagttccatcccgcaggacatgaacgaaacaaaatcacctgcttcaaacatcgtaatgtctgcatcgggataacgatgcaacagttctaagacactttggtgaccgccgtgtgatgcccctacaataatgatctttggcttgtccacaaaaattcctcctaattatgtagtaaccgcgacttttcgccatcggccctatctctatattagaatagttctaatctatagtcaatgatagacgacaattaattattgaacaatttatttttagagacgactaactttatgcagatgagctttggccacgacgctgcctaacagggatcgtggcaactatcatgttcaaaaaggtggcatcgtgcacgtttttatgtagaacatttttacccagtcaaaagcaatctcgttgatggttcacaaagacatgaaaaaagccgctgcagtaagattcaatatctcagttgcagcgaccattcatttgcttattgaaatctcatggcatcctgacggttagataatcgcgaagtgcttaagtgccttcaccacgccatcttcatcattgcttgctgtaataaaatcagcacgttttttgacaatgtcctggccgttagccatagcaacacttgtcccggcgaaatcgaacatatcgagatcgttatgttcatcgccaaacgcaatgacatcgtctgctgaaaatccgaggtgttgcgtgagttgcgctaggccccagcccttatcgacgccatggggcatgatttccagcataaatggcatactgcgaatgacggtaaaacgattgccaaattcagtttcggcttggggttgaatcgcggcaagcttatctggttcgcccagtaacatgccctttgcaatcacgaagtcttctggcatttcttgcggttcacggaccttaataccggccgtattttcccatgcttgtaaaacggtgtaacgactgatattgcgatctgccgtataaacctctccggctggcgtcaagacgttgctgtcaatgccgttgctagcgaccgaagccgcaaaagtcgaaaagtcttgataatcctgatgattcagaaacttttcagcaatgattttgccgctcgcgctctgcaccacaccgccgccttgaacaataacgtattgatcgttaccttccagtcccaacgcctccagtgtcgcatggacaccaggcaagggccggccggtacacggcacaaccttgataccggcagcaatcgccgtcttcaaaccgctaattgtagcgggtgacagctgcttatgtgaatttaataatgtgtcatccaaatcaaccgcaatcaaacggtacatggcagtcacaccccttcctcatgccagcttagcacagcggggtgggaggggacaatgtggaagataaacgttgggaagcggtggataagcgttacttacaatggttagacataaaaacgacttccttaacaaagaaagtcgccagtccgttcgaacgaccgttaataatgcgagtgacaaatccgcagtgatcatcgaatggtattttgtactgtatgccaatcacacattagtatgaaggattgtcgtcttaacagttgttctattactagtgttgtccgaagcggtctccttcagctagtagaacaaaataacgtcaaatgtcaccatgacgccccacatccagcaaccgtaccgtcaaatcttctacccgatagatcagcaaccagctgcctttaatgaacaaagcgcgatcaggtttgcgacttttgatgacatgatcgtcgtatttttccggcagcggatcgccggttttcaagtagttggtgacttgttcaaagtcgttctgagtaaagcggccagcttgaaggagttgcttgaggtgctttttgaagcgtgattgttgtgtgagttggtagtggggcatgatggacctgcctttcttgttttcttaagcgtaccgcaacgaacaacaatggaaaaatatttttatcaaagacagtggtgacttgtgaaggattggttaacgtcatgtcacacttttaaaaagaaattcacaaaattgatttggctttttttgaaatcgataccaaaaaagcgttgacaagaaatctgaaagcgctatattattcatgtaatcaaggagatgcggaggagcggtgaaaaatggcaacgatttcagaagtggcaaagttagccggggtttcggtttcaacggtatcacggatcattaaccacaaaccacatgtttcaccacgcaaagcggccctggttgccgatgccatggcgaagttgggttacacaccgcttcaagctgctcgacaaatgcgtggttctggctcgcagacgattgccgtgacggttccttacattacgaacccgtttttttcagaactcgttgcagcgattgaacgcactgccgatgagcgatcctataagacagtcattgtgcaaacattcggtcagaaaagtcacgaactgaatgccttggaatttctcaaaacgaaccaggttgatgctgtgattatgtgcgcaattgagaatgactgggatttgattaagcagtatcggcaatacggtttgattggtatttgtaatgaatacgtttccgatcctgaggttttgatggtgcgtgccgatcaggaaggcggtatgtatgcgggtactaaatatctcttgaatcgtggttatcgcaagctagcattttgcactgggcagcaagctattcgatacaatgacaaacttgaagatttgaatagtgatcgttatcgtggctatcttcgggcattgcgtgaattcgacttggagccagcggtggaatggcagtttacagatgttggaaccattgctgatggtcaagatgttcttcagcgcatcatggtcatgaagcatcgtcctgatgctgtgatcgccggctcggatcaagcagccgctggcatgattgctgaagcgcagatcatgcaattgaaggtgcctgaagaacttgctgttcttggctttgatgatcaaccgctgagtcaggtggttgcgcggccgttaacaaccattcatcaaccagtacatgagatcggtgatcgtattgctaatatggtcgctgatgacttggaagaaaaaacggttgaagccagacaagtcgttttaccgctttctgttgttgttcgtcagtcggtttaatcttttttgagcaaaattggtatcaataccaaaaatatggaggaaattaatatgacagtcgtattagcacgagtagatcaacgtttagttcatggcatcgttgtcaatcaatgggctgctgaggtgcagccgaagcgctatatggtcattgatgatgctgttagtcaggatgaagacgtgaaagctagcatgcggttgagcaaaccagccggcacaggtatgtccatcatcgacactgaaaaagctttgacgaattttaaagctggtaagtatgacgcccaacgggtattcgttatcgcaaaggagcccagcaccatgttgaaattgttggacgctggcatcgaaattccgcgtgtcgatatcggtatcatttttgcagaagacggacggacacagatcagcaaatttgtttccgttaatcaacaagaagttgctgattttaaagaactcgaaaagcgcggcgtccctgtgaacattcgctatgtacccgctgattcacccgaaccatttgataaggccattgcaggcaaagacattaaataatcagcgagttcttggctgaagaacgcgcgaggaggaaacatcatgccacatattttgcaagatatcctgatcattttcttggcatcatacgcaacgcttgataatcaaggtatcacgattatgaactactggccggtgacggtcggactttttgccggattgattatgggtgatttaccgacagccatgaccattgccgggactttccaattaatgagtttaggggttgccggcctaggtggcgcatctgtgcctgactacggcttagctaccatcgttgggatctatttgtcagcacggacaggcgcaggattgggagccgcggttgccgttggactgccagtcgggctgttgacgattcaactggatgttttaattaaaatcgtcaacaacttcattgctcacaaggcacaagcatatgcgcatgccaaagaatttaataaaatgcggatgattaactggcttggaccgttgttcttcgccctcaagaactttattcccatgatcttgattgtcacagttggaccttctgccatcagtgccttgctcaagatcattcctaagtggcttacaaatggtttgacaatcgcaggtagcatgttgccagttgttggtattgggatgctgatgcattacatgcctttgaagaagtatatctgggttcttatgatcggtttcgttatgtcagcttatctgaaagtgccgattcttggcgttgcgatcattggtttggcactagcaatttacacctatcagaacctgatcagtgcttctaagaagaaggaagcggcgacagctaatggtgctgatgcttcagatgatgatgacgaaggagacgattacgatgagtgatgtacagcaaacaaccaaccagccgagtgcgacacaacctaagctgactaaaaaagaacgacacagtgccatccttcgttacatggccatgggcgtcaacaattttaactacgaaacgcaacaggggccatccgttgtttgggcattttcaaaggttctgcggaaaatttatcccgatgatgatgagtatgtcgctgctttggacaatcattttaaatacttcaatacgaccactgcaatggctggcatgatcttaggggcaacgctggccatggaagaacgtgatggcattaagtccaaagatgcggttcaggcgttgaagacatcgctgatgggcccatttgccggcgttggtgacacgatcatctggattctgttaccgacgatcatgggttctattgccggttatatggccctccaaggcaatccactaggtgcaattatctggattctcgttgatattttgctgttctgggttcgaattaagctgtttgatatcggttatgattctggggttaagctggttacgaccatggctaaccaattgagtgctttcacagaagctgcttccgtgatggggattaccgttgtcggtacattgattgcaacggttgttaaagtttacacaccactacaattccagtttggcaaagttaagttagcgatgcagacaggtattcttgacaaaatcatgcctgccttgctgcctgccttggttgcctggatggtttacaagttgctcggttcgaaaaaatggacgcctaatcgtgtcattgtcctaattttagccattgcactcgtaggttccttctttggtattctcgggattgaaccaacaaagtaatcatgatgaaagattgagaggttgatattttgaatcagaaaaatcaagtcagcggggatcattatcggtttaccgtcattacaaataagatgatccgcatggaatatcaatctgccggtcagtttgaagatgcaacgacgcaaacagtggttaatcgcgattttggcaagccggattttcaggtgacccgtgatcaagaaggttttgctgtacaaatcgagacagattcatttcacctctattatcgcggtggtgaattcaacggtgccaacttgttcattgatacaaaatacaattttcagacgcactatccgcgttggcattacggtgatcccgatgtcaagaacttgcttggaacggcccgaacgttagatggtgcagatggtgctgtatcgctggattcagggattatgtccaaagacggttttactattttggatgactcaaacagtatgctgcaagccggcacatcgatcaggaatcggcctgttgaggaaattgatctttatggctttgcatacggtcacgactatcgcaaggctttgtatgattattatcagctcactggatttccgccgatggtaccacggtttgcgttaggtaattggtggagtcgcttctatccttatacgcaagaaagttaccttgcgctcatggatcgtttccaaaaagccggtattccaatagcagtcgctgtcttggatatgaactggcatgtcacagatattccgacgacgtatggcagcggttggactgggtatacctggaataaaaagctgttcccggaacctgaaaaattattggcaaccttacacgcgcaaggcaaacatgtcacgctcaatgtgcacccagctgctggtatccgcccttctgaagtgcaatatccagaagttgctaaggctgtcggcattgatccagcctctaagcagccagtgttgtttgatttaaacaatcgaaaatttgttcaagcctactttaacttggttcatcatccgcttgaaaaacaggggattgatttctggtggcttgattggcagcagggtgctgcacgatcacgtgcgcagattgatccattatggtcgcttaatgtgctgcattttctggatcaggtgaaagaaaagaaggatcaagcgctgatcttgtcacgctatgctggacctggcagtcaccggtatccaattgggttttctggtgattccattgccagttggcgatcattaactttccaaccgtacttcacagcaacggccacgaatattggctacacttggtggagtcatgatattggcgggcatatgcacggcagctatgatcctgaattgtcactacgctggctgcagttcggtgttttcagtccgattatgcggttgcacagttcggacaatccgtttatgggcaaggaaccatggcaatatgatctggaaacagataagagcatgacacgtttcatgcgattgcgcgctcagcttgtcccttatctggcgacggcggatgtgttgacacatcagcaaggcatgccattgattgaacctgtttattatcgatatccagaagtaaaagaagcttatcagttcaaaaatgagtacttcttcgggtcagaaatgctggtcgtaccgatcacagcgcctagcgatgacacaacgggcttagccagtgcagaaggttatgtgccagccggtacctggaccgatttatttacccaccagcaatatactggtccagcagttgttaagttttatcgcaacaagtttcagtatccggttcttgtgcgctcaggcggcatcgtgccattagctgatgatgctatggcggccattgatgatctgcccgaagctatgaccgttacgcttttccctggcaagcaacatgcctatgtattacatgaacagacagcggctggagaagcgcaaaccaaattttcttgggatcccgtggccggtacatttgggatgaccgttactgatcctaatcacatcattcccgagaagcggacctatcaattacaaattgtgggcgttaaaaccacaatgaaaccattctcaggacgatttgatcagcgactgacacttgatttagaagccgaagatcaacaggtaattaaactgcagcatatctttgcaattctgcaacatgctaaagttgcgtttgatctgaaaaagcagttgtggcaaagcgttaacgatatgccagcaagtagagcagcattaactgttgccagtctcgcaccggcaacactgagcgatgcacttttggagatacttttgaatgattaggcctgaaatgaccgtcctttggtcattgcggacaaggtccttaggtgcaggtttctggtctggtaaacgtggttagaggaggaagattcatgaaacgcacaatcgtattggcgtcacatcatcggctcgctgaagggttgaaagacacattggatttcattagtggcggcggtcaagacatcgtgacgctggcagcgtatttggacaatcagccggttgaaaagcaagtcgatgaggttatgactgctttcccagctgatcgtgatgttgtggtactgacggatatgacggcagggagcgttaatcaaaagttcttcaaatatcgcacacgtccgcatacacatatcatcagcggcatgaatctgccacttgcacttggcgttgcgatggaaccggctgatcagtatattagcgatgctcgaattgatgcgctgattcaagaggccaaagatgcaatcgtcaatgtcaacgagattcaagttgaggaagatgacgatgatgaatgaaataccatggtggaaaaagagcgttgtctatcaggtttatccgaaaagcttcaatgatagtaacggtgatggcgtcggagacttaaatggtatcagtgaaaaattggattatttagccgatttgggcgtagatgtgctctggctgaatccgatttaccgatcgccacaggttgataacggctacgatatttcgaattatcgcgatgttgaaccacaattagggacaatggccgattttgaacacttgttgcaggcagcacatgatcgacatctaaagattatcttggacttggttgtgaatcacacgtctgatcaacatccgtggttcaaagccgccaaatcatcagtgagcgatccgcatcacgattactacatctggaagaagccagttgacgatcatgagcctaataattggggctcaagctttggtggttcagcttgggaatacaaaaaagatctgggcgagtattacctgcatctttttgccaagcaacaaccggatctcaactgggaaaatcctaaggtacgccaagaagtttatgatctcatgcgcttttggctagataagggagttgatggcttccggatggatgtcatatcactgatttctaaagatccggcttatccagatggcccgctcattcaaggcaaggcatacggtagttattatgccggagcggcaaatggccctaaggttcatgattacttgcaggaaatgcacgagcaggtgttgtcgcactacaatatcatgacggttggcgagacgccccatacaacggcacagcaggcgcaattatacacggcggcagatcgtcacgagttggatatggtttttcattttgaccatatgcatcttgactatggccaatatggcaagttctcgacaaatcgatttaaattagttgatctcaaagaagtcttggcacgttgggagaacacattagcgcaagtcgatggctggaacagcctttactggagcaaccacgatcagccgcggcctgtgacacgatttggagatgaaggccagtatcgaattcgatcagccaaaatgctggggacggtgctgcacatgttgcagggaacgccttatatttttgagggagaagaactcggtctgaagaatgttcattttgatcaattaagcgattataacgatcttgagaccaagaacattttcaaagaactcacccaacagcatcatgaaagtcctgaggcggccatgaaggccatttatctgcattcgcgcgataatgctcgtacgccgatgccttgggatggcagtgaaaaaggtggtttcaccaccggacaaccatggctgggactaaatccagatcacaagcagattaacgcggctaaggatctggcagatagtgacggtgtttaccactattatcaacacctgattaaattacgacatgaagagccattgattaccactggtgtatttgagctacttgctcctgatgatccgaacttgtttatttacctgcgcaaaggggaacatgagaccttgctggtggcaggtaacttctcaagtgaggaacgcacatggtcagtgccagatgacttgcaagctaaggatgtggatgtgttgattcggaatagtgaaatttccgattcactaaagaaaacactgacattaccaccatttggcgcagtggtgtacaagcttcaatagcaatacgagtgagttcgaattcacgaaaaatgctcatcttctagtttggcttagaagatgagcatttttgtgttatatcgtgtctttgccagaaaattaccatcaatagattttgttactggagtgtttttgacttacgctgttttattgtaagcgtcacatagtgcagtacctataattgtcaaaatcctccctctatactttttggtgttgtgtcgtgtactttttggtgttgtgtcgtgtactttttggtgttgtattagtgcgtttagacctgcggttgagccattctcgccgacctaagtacttaaagtatttaaaagtatttagaagtatatatagcgcgcgcgaagcttgtgtttgtgttttgcctgtgaataaccacaaaagaccttggggagaacctctccccaaaccccataccaacccatggtcgcttcgctcccaaaaaggtgtggcttcgccacgtttaactccggctccgcctgcgcgcctctggcttgccctagcgcgcttcgcttgcgtggttcaaggagaacctcgctcacgagctcggtgaacggtcactttgttccctcaaaaaccacaactaaggtgaaacgctcttttcggcaagatcggcaattttctgataatgagcatagtcaggcgcactgggtggcaactgctgaaacagcctcaaaatagtgcgacattttgtttgatcggtcataaccgtggcgggcaacaacaagtttcctaagacctcataggcttccgaaagctgatctaactgcttttctaatgctaaagcttcttcttgtttgggttcgccttgcagttgtcgcgctaatttttgctcatttttgtttagcatggcctggttacgattcaataaacgctgttttttgttggttaaatgagcatatggattgagctgatacgcacgcaacttagcttgcttgtgttgctcacttaacagctgtgattggagcgattgcgttgctgcgtgtctgtattgatgggttttaatcgatttaacggttaactgccgagtcatatattgataccacaacgtttcacccatgacccgaattcggccattgctagcacccaggctgatcgccagtaacagcagtaaaaagctctctaaaagacgccaacgcagctggtaaaggctatgtatcatgatgtgaccccctttatttcggtataaagactagccacatcagacacgcggtggtgatgacgccgcccaaaaaggtgagtgcataaccccaataaacagcctgacggctgtgctttaagtcagtttgtaaggcttggctgtctcgctgtaacgctgtggctgtttggatcgcttgcgttaaggtggcctcagcttggttttggatttcagtagcattcaatgcctttttggcgtggtcgactagctgatcttgattggttttgaggcgagttttaaagtcttccaaagcgtcatccagtcgtccttcagcgatttgacgatcagcttgagcgtccccaaataagtgaccgcgatcttgagcatacaagtcatcaatctgttgctcgagataggcggctaaccggtctgattcggcaaggcgcaactgtccgtcactcataccttgtagtaattcggtcaccaatgcgttgatttctgatggtgaaagcgcagccatgctgatccctcctatagtcccaatgtggggccttcattttcctgttgtttttgaatgggtttttgacgctgttgttgcagctgcttcttttgctcaccaatggcttcattttctttaagcttgctcaataactgctgataagttgctgatggcggcgtttgttcgctcgcttttggagtatgaccaagttcggtatctagtttctgcttaagcgccacgtagttggtacttacttgttgctggaggtaggcggtaactgcttttgcaagtcgtggtactgctttgctaaagcgttgtaagcttgctgcaagtggcttaattgctgctttaaggcgttgtcggacttggcgataatgggttcccattgacttagctttttgttccaagcgtctacttgtgcttgtaaggtggtcaaactgttgagctgttggtgcaactgctgattttcgttgttgagttgctggttttcttgattgagtttgtcgttctctttgttgagttgctcgatgagcgtcaataagtcgctggtggtcttgctctgataaacgttgggcttcaaggatttgggatcggtttgccaactcatcaaaaatcgctcctttttcgtaactgctacctagtttggtgccacgggcttgtcgatgcttgttttcggcgtctaaaaacgcgtatgagacattttgaccgcgaatgcggataataacacccttatcagccaaaacggctgagaggactttaaaatcgcttatgtgtggatcttgcatggcctgatcgatccgttgacgtaaatcatctttccagacataagcgcctttggcgctgattttgcgttctgccaatgtgtgacgctcgggttgttgcgctagatgctgaatgactgttagaccgtggctttggcacagctgatcattgagacgggtcacgcgctgccaatcgttggtgtggtgatattttttgccggtttcaaggttgggcatattgatgatgatgtggttgtgcagtttgtgaccgtccccgtcaaggtgggtatagacagccacttcgtgattaggggcgatgagacggcctaattcaacgccaagatcgttgacacgttgccagtcggctgggctagtggcaacgaagtcttgagggccaaatgattgaatgacgcgcatcacctcggttttgccccgctgaccaaaaagggagcgcgtggtgtgcatttgttccttcacatgcgcgagatcgacattttcgccgccacgcgcaactgcacggtcagtcaagccacttaccagggacgaatcgacaccgttttcaaggatccagtcacggtcttgttgtttgagttttccttgaccaatcgcataatttagtgccgccgtgccgctttgcgcccggcttattttaatcgttgccataattgaaccaccgcctgtttcatttcccagtattgttgggcttggatgggggataagtcattttgattggctttgtgtgctaattgattgaggttcgtgccaatgcgacgtaaggctaaattgatggctaccgcatcttcatggctaaactttggttcacgcagtcttgatttaaccgcaagtgctttggcataagcgctcaccgagagcccaaagggcgcagctgatttttgaagtttttcgtattgatcagggtctaggcgaaaattaatttgaggacgcttgggaatcatgaaaacgaaccacctttcaggagacgtccgacaagttcagtaagagttgccagaagcgattaatgagtaacgctagcttagcacagtagacaagtgagccacaacagaaacaggaagagaggcaagcagttcatttgctagacaattaggcatcgctgcgctccctaattgtcagcaaatggcttgtaagaagggcgctacgctcccctcttaactccccacaaaaatagccgtcacctgttcggcaacgactatgaaaacaggtagatttgggtctacactttctggtgttgagaaataatcaacactgaacgtataggccctttggacaggtcttttttcacattttctgggtggtaactttaattatgcaatctaggttcagataaatcctgttgaaaatcgccattaacgtgtcccggaatatcaaaatcaatatcatcggcgacatcttgcaacgttttggtcgctaaatcataatgccacaagtgactttgcgacacatttggcagatgattgtccgaccccacaagcagcaattgcttgccatctgctgaaaatgcttctggcgataaggccgcttgcggtaactgatcattaaccatggttacctgttgatcagctaaatttaacaaataagttgcttggctaaaatcatttgggtcatcgggcaggcgctctgcagtaaatgccaaggtctgtccgtctggagaaatcgccccgacttcaaattcatgctcccggcccattaccaaacgactggtcttttgacgcaggcgttggactcgtaattcataagcgacatgttctggtaataagccgactccatttaacttatagggcacacgtgagaccgtcaccggttgtggccactgcttatccgtctttttcggctttgcgccaactgtcgtctgaataaacagtgcttgactgtccgcttgccaaccaaagtaggacacgccttctttttcagcagaaaattgcttggcagtaccgccattgaccgcctgtaagaaaacttgagtcgttttatcggatgcttgactcaaaaaggccaaccattgctgatctggactaagcagcggatgccgatcatgtttttgatcaaagccatacgcgatagtgccgccacgatgattgacgaaacaaatgcgctgataataagtattatcggcctccgaaatgcgattttcctgaacaaagtagccatcatctgtcgcacttggatacgacaatgataccaatttaaaaagatctgtcgctttaattgccatacgatcacgcccttcctcatattgctttaagcgtagcggttgggctataccatgtcaattagctggaccgcttgaaataaaaaaaaaacatggcctccgccatgcgtttacgtcttctatcgaactttaatactggatggaggagataggattcgaacctatgaacccgaaggagcggatttacagtccgcggctaggagtctatttttattttcttacttgttgcacttcaattgtaaattcgtctgagtaagaaaaggtatctttagttgcgttgtgccttttctcacgtttcagaggctatcagcgctttgtcattatctgcacgatcatcagtttgacgcatcacaagcgaccaaaaaggcagccgcaatccggctgccttttgacatcaaaaaattatttcgcttttggcatcacattatcaatcaaatcttctacctctgggccggacagaatttgttgttcaagcttaaggttttggacaactttaccatcacgaatgataatgaggtaggaatccttgtaaccatcattcaaataaacgaaggtaatccctgactcaacgatgacctgtgctgatgcagcaccacccataatcgggtcagcgctggcatcactgtaaaagctgatggtccgttctggatcaggatcattcaacagggtgagctcaaattctaacttggttgctgtgtgctcagtgtcaaaatttgcgtcatgtgtgagatcattgacataatagggaaagtcaaaagctttagcgacatctttcacgacaaattgactcatggtgacgagttgatcttcaggtaatgttttgatcggcatagataacacctcctatctttgagtctacaccaagcgcttacaaagaggtagtaaatgacttgccgcgtcatgttacattaaagaaaaggggcaaaaacaatgacaaaacgatctaactttttatactggctgaatgtcggtggcgacctgctttacttattgattgttggtggcctttatatcagcggccgctcgttatttcacggtcagatgatgttattggcgcaggttgcgtccggcatattgattgtcagcttaccgcgattgatggagcggtggtggcattttagatttccaccggttttaatttacttattcgagatctttattcttttaagcgttttactggggacaggattgcaatgctacagtgtgccttattgggataaatttgaacatttattcagtgccgcgatgctcgccggtttaggatttgctatttttgcggcattgaccccgcaaaaacggttgacatcaacaagcccgttgttgatggccttgtttgcactagcttttggcaccaccatcggcgtgctctgggaattttatgagttcacctttgatgggttgttaggattgaatatgcagcggtacatggcgactggcggcgagctactgcgtggccgggcggcattaatggacacgatgggtgatttgtttatggacttctttggttcgttgggacttgctttgtttggttattttggaatcaaacgggatctacgttggttggacaccttcgcattccaacctgaccataagtcggttaaccattagccgaatacatgctgcagtgtcagcgtgtcgttgggtgtgaggaagttgggctggtaacgggtgagaaaatgaaattcttccatcccgacttgccgcttagcttcctcttttgattgggcgagccatcgcagccatgggccaattgcttggccggccatgaattcgcgcgcgtaatcaaacagcgctggccattcagccgctgtcgcgatgacggccatatgtccaaaaatctgcggatcgactgaaatttctggcaactttgcttcatgaggctgcaattgcttcatgaaagctggcaaatccatcgccactgtcagccactggtcgacttcggtatcaatatagcgaatctggcgtggctcctgctggagatcgaagccaaaatattggtgcccggttttggcaaatggcaaaaaatgtgctggcaaatcgcttgaagtcatggctgggccaacagttgcaaaggcgtggatacccacgccgtcaatggcatcactcgtcggctccttagtcggaagccaccaattcatcggtaaaatacctgtttgaatgagcttaaaataagcaggcggaatggctgctgtttttggaatcgttggcaaatcaggacgagggataagattaggccatggttgtaacatcataggtcaccctttcttagatagaatgaggagagctagcgcagaaaccggattgacttacgctctgattgaaacgcgttcgccaacccagaaacctgcacataaggaccttgaacgcaatggccaaggcccggccatcacgttcaaggccgcttatgctccggtttctaagcgggttggctcacgcttttaatcttaacgcatgtgatgccgtgaaagtcgtataattaagtcgggagtattgaaggggttttaaacgtgcgaaatgcgatgatttatgtgcgccatgaaccgttggcgcatttgtttttgacatatggcatttcagcaagtgatttgctgagcgaccatctaaaagtaccgaagcatctgttattgctgccccctgtggatgagcaggaacagatagatccgcatacttggttcaatattatcgacggcgcggatcaggttcaggactttttgcggagtaaagcgggtcagacgcgttgctggctagattattcaagcccgcgatttttgcaggaactcacgcctaacgagattgcggaactgttatacttaggacatgccaaaacgcatttaagttcgccattttactacaaattgcaaaacgagttggtttacctgccattgcgaaacggtatggtgaatatgtatctgcgtaacgaatctttatttgcgaccttcttagcaaacgccattaacaagtatatgcggcgaattgctaatgaggaaccattctggttacgcttacggcaacagcacttttctcgcgtgtcacatgccgtctatacacagtttttaccattattggaagatggcgtggtatttgatttccggaatgtccggttttctcgtgaaaaaatcagtgtgccacttttggtaccgaaagctcggttcgttcctgatggtatcttgacggatacagatgtccggcgattgggaatgcttgttttgatgcggcaaaagaatcagtggatgatgattgatgatgctgcatctgccgatcatcgccaataatggactgttttaacctgttcttaaacaggatgaagttgaagaattggagtcgaattaattatgaagatgacattggcagagattgcgcgagttgtgaaagctcaaccgctctctgaagcagacgggtcgcatgtggtgaccggactggcttttgattcacgcaaattgaagccgggtatgctgtttgtgccgttacgcggtgaacgtgatggtcacgaatttattccggcggctgctacggctggcgcagtggcaacatttgttgcagctgatcatttacctgtcaccaccaagctgattacgctggtggtgccggatccgttgaaagcgatgcaacaattggcacaatattatctgttgatgaaagtgaatcccaaagtggtggcgatcaccggcagcaatggcaaaacgacaacgaaggacatgaccgctgcgatcttggccacacaatatcacgtcgttaaaacccctgataactataataatgaaatcggcgtgccaatgactattctcagcatggaacccaataccgaagtcttggttcttgagatggggatggatcggccagggcaattacatgcactgtcaaccttagctgaaccggatgtggccgtgattacgatgatcggggaagcacatattgaatttttcaagacccgggataaaattgccgatgccaaaatggaaatcactgatggtctaaaggatgatggtacgtttatttttaatggtgacgaaccattgttgcaggaacgggcgaagaagattacgcaggagcgcgaaacttttggcttgcatcctgaaaatacgatatttgcccattcaatcagcgggcatcgtaaccacactgagttcacagttgaagcttggcctgatctgacgttctcgattccgattatgggtgaatataatgttgtcaatgcgttagcagccctgttagttggccgcaaattccatgtcaaacccgaaatcatgcaaaaggcattggctcattttcaggtgacggctaaccggacacagtggttgatcggggatgtgggtgaacagattctaagcgatgtgtataacgccaacccgaccgcgatgaaagccgtcatccatgattttagcgaatttacggcaactggccgtcacattgcagtgctaggggacatgctggagcttggtgaacaaagtcccgcgttgcatgcaggtctggcagaggcactcgatcctaaggaagtgcaggttgtttatctatacggtagcgatatgaaagcacttgccgatgcattggcggcaaaatatccagccgatcagttgcactattatccgcttgatgacaaggaacagatgacgcgcgacttacaaaacgatgttaaccatgacgatatggttttgttgaaagcgagtcacggattgcatctggaaaccgttttgtcagctttggtcgctggtggtcgtgcttaatactagcgttgtaagcataaaggccgttccatgaaaatgaaacggcttttagcatgttttgacggtttttattcttttaaaaatgtcagtttaggcttaaataagcatgtgttgactgaagcttttggtgattatgcaagacttggccgaatctcggcacttgtttttttatagtgagcatgatactattgttcggatatgtttttttgtcatttactgaaaatgcacgtgatgcccgcggattcctttgaaaacacgcttgggtaaacgcgtgcaggaattctcaaggaggaactcatttgaagtttaaagaactaggtttggatcatgatctcttaaaggcaatcgcccagtcaggttttgaggaagcgacgccgattcaagcggagacgatcccactggttctggcaggcaaagatgtgatcggtcaagcacagaccggtaccgggaaaacggcagcgtttggcttgccgatcctgcaaaacatcgataaggctgaccggagtatccaagcattggtcatttccccaactcgggaattggcgattcagacccaagaagaactttatcgtttaggccaagataagaaaatcaaggtccaggcagtttacggcggtgccgacattcgccggcaaattcgccaattatcagaacacccgcaaattgtggtggggacaccaggtcgaatccttgaccatattggccgtcacaccctgaagttgcaaaatcttaaagtcttggtattagacgaagcagatgaaatgctcgacatgggcttcatcgatgacattgaaaagattgttgaacaaatgccaaccgcgcgtcagactttgctgttttctgcaacgattcctgcttccatcatgcgtttgaccaataagttcatgcatgaaccggtcaccgttaagattaaggcaaaggaactcacagctgataccgttgaacagtattatgtccgtgcaaaagactacgaaaagttcgatgtcatgactcgtctgtttgatgttcaagacccagacttggctttgatctttggtcggaccaagcgtcgtgttgatgaactaacccgtggtctaaaggcgcgtggttatcgggcagaaggcattcatggtgacttgacacagcaaaaacggatgagcgttttgcgccagttcaagagtggccaattggacttcctagtggctactgatgtcgccgctcgtggtctggatatttccggtgtcacccatgtttacaactatgacattccgcaagatcctgattcctatgttcatcgtatcggccggaccggtcgtgcaggtcacaagggtgtttccgtcacctttgtcaccccaaacgaaatcgaatatttgcacacgatcgaagatttgaccaagaagcggatgctgccgatgaaaccaccaacagcagaagaagcattgatgggccagatctccagcggtttagaaacgatcaaggcacaagtcgaagctaacgatactgaaaagtacgaggctatggctgaatccttgttggaaaactataccccgttacagttggtttccgcttatcttaaggcagtcagcccggatgatgccagtgccgttccggttaaaatcacgccagaacgtccgctgccacatcgcggtcgcagcaatcacggtcacggcaataatcgtggcggttataaaggcggttacaagggtaagcgtcgcgaaggtggctatcaaggcaatcgtgataataagcgcagttacgacaaaaaacgcaacttcagcgataaacgcaagaatgttaagcgtagtttcaaaatccgtaatggcgaatgatttttaattaaagcgttcaaaaggcctcaggttaaacgtcctgaggtctttttttgcttcaaccaaacacccgttttctgtaaaagcatgctagaataactttatgacaaagcgtgagcaggaacagtggttagttccggcgatgtcaacgcggttaaggaggcaacccatgatttacggtattggggtggacgtcacagatttggcgcgaattcaggcggcacaggaaaaaaacagcggcttcgcggttaaaattttgacgccgactgaattagcaaattatcaacaacttgatggccgccgcgccgttgaatatctttccggccgtttctctgccaaagaatcgtactcaaaggcatttggtactgggttaggaaaagtcgccttacaggatgtcgaaattctcaataatgagttgggcaaacctattctgacgaagcatcctttttccggtcaggcttttgtctccatttcgcacagtgaaaccttggtcttcaccgaggtaattttagaaaaagaaggtcctgaacgtgacgatcggtaactttcgaccagcaacggtattaatagatgaaacagccattttgcataatattcagcatgaggtcgcacgattaaaaaagcagacgcagcttttcgctgtggtcaaggctgatgcttatggtcacggtatgttgcgggtggcgcgggttgctaaagcagctggtgcaaccggtttttgtgtggcgatcttggatgaagcattggggttgcgcaaggccgattatagtgaaccagtattggtgttgggcatcgtaccgagtcagtatgcggccattgctgctgcccaaacaatatcattgcctgtcagcagcaccgaatggcttgaacaggctttgccagtgttagaagcacagccagagctgccgccgttgcgtattcatctggctttagataccggcatgggtcgtatcgggtttaccgaagatcaagcactcaagacggcagttgcgtttgttgaagcgcatcccaagcaatttgtcattgagggggtcttcactcactttgcaacggcagatgctcctgatgatacttatttcaaacagcaagttgacaagttcaatcatctggtcaatcttttaccaagtcggccgcgttatgtgcatgtttctaattcggctaccagcttgtggcatgcggcttgcaatggcaatatgattcggtatggggtggctatttacggcttaaatccgtctggggacgcgattccaaccacaccgtttccactggaaccagcgttgtcattggaaagtgagttgacctattgcaagcaggtgcatgctggtgacggtatttcgtacggtgtgacctatcgtgttaaaggagatgaattcatcgggactgtcccgattggctatgcagacggctggctgcggcgcctacagggctttcatgtccttgttgatggtcagtattgtgaaattgttggccgtatctgcatggatcagtttatgattcgtttgcccaaagcatatccagctggcacaaaggtagttttggttgggcaaagtggcgatcaggagattacgttgttggacgttgctaaatatagcaagacaattcattacgaaattgcctgcaatttaacgccgcgcctgaagcgacagagcgtgaatccggtcgattgatggtggctcgtatgctcattttgtgctaaagtaacaacatgaacttgggaagttggaggaagttgtcatgaaaaagcaaacgtcagtagcggtaacgtttgatgatgccattaaggcgcggttggatgcctattgtgaattgaatgacattgacgctcaggctgtgattacggaggcagtggcgacatttttgaagtcacaggctcccgaaatcaaccaattgatttctggctatgtagcaatgggccagatcaatacagagatcagtcatgctttctctgcctgcgagagcgaggcatacgcccatattcgatgagcgataagggggcaaaagcatggatgtgtccgtaaaacgcggcgatgtttttttcgccgatctgtctccggttgtcggctccgaacaaggcggcaaccggccagtacttattattcaaaacaacgttggcaaccattacagtcccacagtgattgtggcggccattacctccaagattcaaaaacccaagatgccgacgcatgtcgggttacgggccaagcaagatggcgttgaacgcaactcagtcattttacttgagcaaattcgcacgattgacaagcaacggctacaagcccgcgtgacagctctgtcaagcaccaaaatggcagcagtcgaccgcgcgttggcgatttcagtgggtctggtcagtttgcccaagcccaaaacatataataagaattaacagcaacgcgcttaacagcgcgttttttgttgaacgtccgccagagcggttagaaaccgggaataagcggcctcaaacgtgatgacggggcttgggttactgcattcgctgtctttttacgtaggtttctgctccggcaaacgcgctatgacgaaataatgtgacttttaatggaggactttcatgacaaatctaaaaacacgcggttgggtacttaatgctttggtcgctgctatctatattgtgctatcaattggtcccgcgagccttaatttggccagtggcgcgattcaattccgcttgtctgaaagtctgaatcacttggtcgtgtttgatcgtaaatatattgtgggtgttgtgacaggagtcgtgattttcaatgctatcttctcaccgcttggttggcttgacgtggtctttggcggcggtcaaagtttgctcggcttgctgttggtcgggtgggtggcgccgaaattgcgtcagctctggggccggtttgccttaaatatcgctgtcatgacgatcacgatggccttgattgccgttgagattgtgtggacggggcatttaagtttcgccacaatgtttttaccaacctatgtttcgttgatgctttccgagttcattatcatgacgatttctgcgccgatcatgtacggacttgataaaatcgtccactttcacgccgccatcgtgagaaaatgatggcagttatcttaaacaactaaaaaataaaaaaagatcttgcaaccgaccatgactaacagtgcaccagtctgatttcctattaaatcagtctgatgcactgtttttgattgtgaccagatggcggattctgcaagctttgatagacttcggagccaaatgtgaaacggcagacaaagaaaaaagcattgtaatctcgtcattattagaatactatgagaccaatatctttaggctcaagacattgatgttaactaataaggtggggatttcatggatcacttagcacatgacaaaaaattaatgtacctgccggaatttgagcatgcggcctgtggtatgggatttattgcgcaagtggatggtcacgctagccacgaaattgtggaaaaagcgttgaccatgctacaacgcatgaatcatcgcggcggcaccggtgctgaacctgatacaggtgatggcgccggtatcttaatggcaatgccggatgcttttttccgtgacgaaatgcaccgctatgaattaacgttaccggcgcaaggtgactatgcagtggctcagctttttttgccgcatgatgcagaagaaaaggccgccatgttaaaggcggtcgtgagtcaaatcgatgaagccggctttccggttctttggacgcgcaatgttccgtttgtttacgaaaactgtggtcccgcggctcaacaagctatgccgggctttgttcaggttgtggtccaacggccgacagacacacaggcagggcaggactttgaggatcatctttatgcattgcgacggcagttagagaaaacctttgatcggcaagccatgtatatctgttctttctcaagccgcaccatcgtttataaaggcatgcttcatgcttaccaagtaagtcttttttacccggatttacataacccgcaaatgaaaagtgccatttgcttgattcactcccgtttttccacgaatacgtttccgagttgggatcgtgctcaaccgttccggtttttagcgcataacggggaaatcaacacgttaaagggcgccgaaaattggatgaccagtcatggtattgaaatttatgatgaaactgactctgattccgccaagttagagaactgtatggaatatctctatcggcatggccgatccattccgcaagcgttgatgatgatggtgccggaagcttggggcgaaggtaccgaaatgtctgatgaacaacgggcgtttgacgaatacaatgctactttcatggccccttgggatggcccagctgccttgtgctttacagacggcattcaagttggtgcctttttggatcgtaatgggttgcgcccatcgcgctacacattaatgaaaaataatcaattggttgttgcctcagaatcaggggtggtagatgtcgaccccggtgatattgtcgaaaaagggatcttggcacctgctgagatgttactagttgacaccagtaccggccgcatttcgaagactcgtgatttgaaacgggcttgtgccgaagcgcatccttatcagcaatggctcaatgccaaccgattaacgttgggggaattacctgacgctaaatcagatgaaagtatgccgatcgacagtttgaaaaaactttggctgcgcaacggctatacccacgaagtcattcaaacagcgttgttgccaatggcgcaaaatggtggcgaaccggtcattgccatgggctttgattcgcctttagcagttttgagtaaaaaatcgcaatctttgttcacgtattttaagcagtcgtttgcccaagtgacgaatccgccaattgatccattacgggaaaaagtagtcattgggacttttggctttttaggtcgcgatggcgattgtacgcgcgatactgctgaaaattgtcacaagcttaaaattgacagcccgattttaagcgatcaagaatatgctaaaattctcaacttggatttgccgatgttacaagtcgctaaattgtcgttggcttatgatttgacggatacgcccgatcgtttggcgcacgtgctcaaggatcttttcacgcaggcggaaaacgcgattgatggcggtgcaacgattttagtgttgagtgatcgaccagttgctgacaatcagatgacgattccggttttgttggccgtatcaggcttgcataattatttggtacggcaaagtaaaggcactgctgcgtctatcgtcgttgacacggcagaggcatgcgaaattcatcattttgcctgtctggtcggttacggtgccgctgccattcatccgtatggcgttttcttgacgctcaaggaacgtggccttgaagcgcaattgccagattactgccaagcggcgaccaaagggatcatcaaaatcatgagccgtatggggatttcgacaaccgccggctaccaaggggcgcaattgtttgaagcagttggtttggctgatagtttgattgaccaatacttcaccggaacgccaactcggattggtggcatcaatcttaaccagcttgaagacgagtattaccaaaagtatcagcgagccttcagcaatcacgcgattgacgatttgccttctggcgggagttttcaatataaggccgatggtgaagagcatctgtacaatcccaagagcatttatcaattccaaaaagcagtcaggaacggcgactatcaggcctatcaacagtacacggcagagctggatgccgaagaacaggaaaatccagtgaccttaagatcgatgtggacgattgatcaaaacggccgtaaaccggtgccgttgagtgaagttgagccggtgagttccattgtgaaacggttcaaatccggcgcgatgagttttggggcactctctgaagaagcgcatgaaaccattgccattgtcatgaacaagttgggtgcacgtagtaattccggggaaggcggagaaaacagaaatcgatttcatatcggtgcagatggtctgaaccgcaacagcaaaatcaagcaggtgtcaacggcgcgctttggcgtgaacacagagtatctgatgagtgctgaagaaatccaaattaaaatggcacaaggagccaaaccgggtgaaggtgggcagttaccagcagggaaagcttacccttgggttgccagcattcgcggatcgattgccggtgtgcagctaatctcgccgccaccgcatcatgatatttattccatcgaggatctcgcgcaattgatttatgatttaaaacaggtcaatccgtatgccaaaatcaatgtaaaattagtttcttcaaccggggttggtacgattgcggccggtgtggtgaaagctggtgctaacacggtcgtgatctctggctatgacggcggcactggagcggcaccaagaaactccacccgagattgtgggttgccatgggaaatggggctagcagatgcccatcaaacgcttgcgctcaacaagttgcgccaacgcacgacattggaagttgacggcaagttattaacagggcgcgacattgctgttgcgattatgttaggcgcagaggaattcagctttggtaccttaaccatggttgctattgggtgtgtcatgatgcgcaaatgtaacctcaacacatgcccggtcggtatcgctacccaaaatccagagctgcgcaagttatatgcaggacgccccgaaaatgttattcacatgatgcaatttttggccgaaaatttgcgtgaacagatggcggcattaggttatcgcacagtcgatcaaatggtgggtcacggcgagcatctgaagccgcggtatgtaccttttgggaaagccaaaacccttaactatgatcggatgttgggcaaaacgattccaattgaacgtaaaaaggccaatcctttcaagccaaagtatgactggccggatttagaccgatttgctgaaactagtctcaaaaatcaaaataccacaaccattgacctaccaatcaataacgtggaccgcgcggttggcacgcgtttaggcggctggattgcggcgcattttggtaatgacggattaaaaccaggacaactggctttcaactatcacggtacggcgggtcaaagttttggagcgtttattacccaaggactatccattaagttggtcggtgaagccaatgactatgttggcaagggcctgtcaggcggtcgcttgatcgttgctgcaccgccacaagctcgagaactgtacacccattcaccgattgtcggcaatgttgcgtgttttggcgcaactggtggcgaagcttatttcaatggccgtgctggcgaacggttctgtgtccgcaattctggcgccaatgttgttgttgaaggtgttggtaataacgggtgcgaatacatgaccggaggcgtcgccgtcatccttggccgaaccggccgtaattttgcagcagggatgaccggtggcattgcatatgtctatgactggacacacgattttgcgaagcattgtagtcaagacctagttgatctttatcacttggatgaagctggagacgacagtattctgattgaactacttaaaaagcatgtccagtatactcactcggaaacggcccagatgattctggatcactgggaaaaggaaaaaggtacgtttgtaaaagtctatccccgcgattatcaccgaatgcgcgacttgattgatgcttacaccaaaccgggactttcagacgaacaagtgattgaaaaagcctttgatgaagcaatgaaatagagagcgtgaaccagcccggttagaaaccggagtataagcggcctcaagtgcattggccgggctttggccagtgtgcttgaggtccttatacgcaatcaatgaagtcatcatgaccagtcgtcgtgctgaagccgatcgcgaagcagccaaaaatgccgcagcccaagatgcacaacgcgcttctgagaatcgcgcgctcgccgaaaccggcctgtgacccggccaagacccctttaacagtgagcaaaaagtcaagcaggcttatgttaaaaagcatttaattgggcgaattgcgattccgaaaatagaagtcgacttgccactatttgataccaccaacaacaccttacttgatcaaggcgccgttgttttactgggtactagttatccgcgcggtggtaaaaatacgcacacagtgatttcggcccatggcggcttgccaaccaagcgctactttacggggttgaagaagctcaagaaaggtcagcagtttctgattgaagttaacggcaagaaactagcatacaaggtctttcgcattcaaactgtgaaaccagatcagactgaaagcttgcagattgaatcaggtcaggatttagcaacgctcatgacgtgcacgccatacatgatcaactcgcatcgcttgttggtcactggtaaacgcgtaccctatacggaatcgttgggacaagcagcaaaagccgctgaccaatggcgcttttggaaaagcgctgcaattatcggcggtgtgctgttgctagctgtgctgatcgtctggttagcccgccgttacttgcgccgacagcgtaggtcataaaaggtcaggaagacagttcgattgaccaattttgtcaaaaaacctcctagattggtcagcaatctcggaggtttttacttggccgtgataaaaaagccagtcagtaagacaggacaaggtcggggatatacaggttaataagatgttcattgctgctttttatggttgttagcgggttatataatcgcatggttaattctgatatattataattctgatatgaaggagtgtgtgcatgttgaaaaaatgggtttgggtgacggtattgtcagccatcggtatcgttgcacttggctttggcggctgggcgttgattgatcattatcagtacagccagttagttgatcagccaagtgatgttaaaaaatgggaagctgatccgcggccgttgcagtccaaaagcgcggcaattaagcaaattaaagctatcgggcaatcagatccgcttgaaaaacgcgcggccaccgatgccaaattagtggtgattcctagacttcgcggtgcttggtcgatcaatgctaaaaccaaaaaagcgggttttggcaataactgggtgcctcaaggggtcacccagtccaaagatgcgatctatatgagcttgtatgatggtaatcacaaactgaattcaatcattgttcaggtgaacaagcataatgttaagtacaataaaaccttaattttaaggagcaaatcgcacgttggtggtatcacttatgacatcgaccatcaacgactgctttggtctgatgatgccgcgcagacaacaggtgctggtatcagttatgtgtcacagcgcgaaatcgatgcctattcggctaaagcaacgcaacaaccgataaagtcaacccggattgaacttcatttggcaagacggacctcagcgattgccctgtataacaatcaattggtttttgttaaatatggtcagaacaaaaagaaccgttcgatccttgccttaccgctcaatgcaaatgggctgccagcacccatcacgatgaagcaaatgaaagcatgggctttggaacttgcaccaaagtttgccggcaaaacactcgatcaagaagttaacatggtctttaaatcgctgattcaaaagaaagtcattaattcgtataacaatggctgggatcggcttcaaggcattgccattgccaaaagtgggctgacgttgctcagtcagtcaaatggcagcgcaccaggcaaaatctggattcgggttccgggcaataaaagctggactaaactagacttcactgcaccaaagtcaggatctaaaattattaacgtgccaaactcggctgaagaaatcagccttgatccttctgagaagcacatttcgatgatctttgaaagtggtgccaaagcttatcgtgaagcaggctccttcatgcatcgtccgagttacatggatcgggtcattattttgccagtgttggttaaaaaaggccaagtccagtaattgcgtggcttgacagtaagagagaagccaaaagcagattttgcaatcagaaggtgattgcggaaactgctttttgtttgcctcagaaactagcatttttaataacacctgttttgttcgcacatcgtttggccaaaatgataaagttattattacaatattaattgacttattttgggggtgtggggatgcgtcaatatgggataaaaggactggcggcgcttggcatgctgctggtgatgttgggcatgccaagcggctcagcggaaagtgagccgacgccattaaaagccaatcatgttgccgcagtttatgaggccaagaaggttagaccactctttcaacaactagccgtctttccggatggcacgcagcaaccacttgctggcggcatctttgctttttatcgattcgacagttcaggccgccgccgctatcgaacaacggatggtcattggcggtcagttgggaatccattaacttctaaagaagcctataaggtaaaagcagatcggcacggtattgttgccatcgccaagaacctaccagttgggactttttacagtgagcgcctacttttgccgcgaccatatgcgaccaaaatgccgctgcctgtcaagattcacgtgaagcgcactggcatcacggccaatggtcaggccattcatacaggagaggaactgcctagaatttacgcttttcgggtggcggtgacgcggcagtgagcgatttttgacactgcctatgcctagtttatatttttcgcccttatttcagtaaatggttggctggcttgatgcggaaaagagtttttaatccccgctgaatttcggttgtcgagatagcagtgacacacgattatcggcgcaaatacaacgtttatttttgaacccgcttagatgctttcttgtacgatacaatgtttttgaaagcattgtgtcgttttaaaatcttttgcagttcttggaggtatgattgatgcgcgcgaaaaagaaacaaaacaaaatgacaaatgcgttgcttttaaccgtgagttttatcgtggtggcttgctacctgcttttctttaaaggggttagccaaccttttcagtttatcttagtttgtggcagtctcagtgggttcttggttcttctaggggcacaccttagacaattatttgctcggagttgagtaacgatgaggcgtgcgtataagcggtaatcaacgcttcggaatacctgcgcttgacttttcgtcattgcccgcatacaattcacttcatcaagtcatagtagcgcctcacagagatcaggacaatcgctgaaagtcctgaaatgtgcgcgaatccaagcttgtatgatgagtctcacaaaacttaaataacgataaaagcgcaaagcattgctttgaacgagaatggtaccgccttaacgggtgtctcgatcaaggcggtgctttttttgatagattagatttctcgacaagtatgcattcagcggaggtagcaatggcaaaacgggcgatgcaatgtaaacgattagtagtgaagattggcacgagtagcctgattcatccaaatggtaaagtcaatttgcaaaccattgatcgactggcctacgctttgacggcgctgaataatcaaggctatgagctggtgttagtcacctctggcgcaattggcgtgggaatggcggaactaggcatgtcgaaacgaccagctgtcattgccgagcaacaagcgcttgccgcgattggccagtcggaattgatgaccttgtacacgcagcggtttagtgattatggtgcgaaaattggccaattgctgctaacacatgatgtatttgattatccgatgaatcgtcagcatgtgctggacacgattgatgcgttattggctcagcaagtgattccggtgatcaacgaaaatgacagtgtagcggttgacgagttggatcatcgcacgacatttggtgataatgaccaattgtcggcgttagtggctaagcaaattggcgctgatttgttggtcgtcctttcagatattgacgggttgtatgaccgtgacccgaatcgccatccggatgctgcgctcatgccgacgattacgcagctatctgccaaagtgctggcagctgcaggcggcagttcgacgcgcttcgggaccggcggcatggtgacaaaactgaaggccgccaagacgatgatgcgtgctggcaaacaaatggtgcttgctagtggtcgtgatccgcggattattttacaaatcttggctggcgacccagtcggtacctggttcggtcagcccaaacaagcagcaagtgtcagtcaaagttttcaatagtaggttttagtagcatttttaaacggctcatatcacgttggcagacgcagaagcttgctcgcgtgcactaaaaaaggagaccgatgatatggacgcaacgacaattgatcttgaacagatggggcgggcagccaaaacggcggcgatgacgcttggccaattgacgacactaaacatcactcgacatgatcaaattcgaagcagacttaatggatgttcgccaaaacattgccgatcaatgctttcatgaaggcggtgtcgatcatgaatgagaagcctggttactatgtaatcatcccagcaggtgtgcgctatgacaaacagctgccacaaggagccaagctcttgtatggcgagatcacggcactcaccaataagaacggttactgctgggcatcgaatgactatttcgcaaagctctattcggttagcatcggcactatcaaaagttggctaaagtgtctcgaagacaattcatatatccgcagagtcatcaaatataaaagtggaagtaaggaggttgaacaaagatttattagtttagcccctcggtcagaaaacttacccccctcggtcagaaaattgacccacccccggtcagaaaactgtccagagaataatacaagtattaataatacaacaacattaggggaaccggagctcattaatttttgggagaaaaacggttttggttttatcagcccaaagaaccgtgaagacctcatatactgggtagatgatttcaagaagattggctcaactgacgaacaggcagttgaggtagtcaaacaggcaatgagcaacgcaatcgacaataacgtgcgtcgttatagctatgtcaatgccattttaaaaaattgggaatccttaaggcttactagtttagaggcagtgacggcctatgaagcccaacgaacacaacgccaaaagtcaaaatcaacgtcacggcaagcatctgcagacgtttatcacaaccagggggatgtccaagatgaagacttaccttggtagagaagaggcgtgtgatgagcaatcttgaaactaatcaaggacgtttagcagcgatcgaaacatttgctgaacgttgtcccgattgtggcagcctcttgtatcgcccgaagggattgagcaaagtcaccggtaaaaaaatggccggagtgtgcatgaattgtggctataaacagccacccacggagcctaaaaacatcacgccagatatggaaaaagaggctcgcaagaaccgaaccgttggatactacctagcttattcggtatttagtacagacgcgattattgcaaaggatttcaacaacttccatacagacggcagccttggacagcagcagttgaaactcttcgctgtcggtttgtctaacaaaatatgccgtaacgaggttgtacacgcattgattatcggtgacacaggagttggcaagtcacatattgctaacggcatattaattgacactcagaccaagacaggctatcgcaaaacatgccttttcattgactggaacgctttaatgcagaggctcaagtctggcatgagtgctaatgcacaagatgtgcgaatgaagaacgagaaaattatgcatgagattggcaaggctgatgtggttgtgatcgatgatctaggctccgagcgtggtagtgattttgaccgccagacggcggatgatgttttcagaatgcgggaagacaaagcaactatcgtgacaaccaatttgcacggacaagatctgaataagaggtacggcgagcgaactatgtcccgtatggccaagcacggccaaggaaatagctttggcgttaaaggaatcctagatcagcgaaaagaggcgttgccttgatgaaagaatacgtgattatggacacggagtttaactcaaccagtaatcgagcaattcaaatatcagcagtcagaattcgagacggtctgcacattgcagatcagttcaaccgattcattccatcaccagataaatttgatcagcttcacatcattaggacaagtaacatgcgatacagcgactatttagctttaccaagcctgcaacagacagtgcgtgactacgttgcctggatgagaactacgactgacattgtgggctggtcgattgaaggtgacgcagaacgtatcagagaaacgtttaaacaggggtcacatggtatccccaagaactggaagtttatcgacatcgcagacgtcgttgaaaagcagtatagctttaatgctacgcccccgctgcaaggactggcgaatgttatgggcatatcagcaaaccgtgatcacaacgcactggacgactgtttaaggacatttggagttatcaaggaattagagtcacgagacggaaagctattttgaggaggcgattgagtagaagaaaatttatacattaaattcaatataaaaagaagcattactggtattaaatggaaaaggaatgcgaaaaatccatactgagacagaattgcctctcaggttgttattgttcttaatgaaatcttcagatgcatttttcttaattaaatctaatatttccttttgcttaggagcagccatttcgcacaaataagcaaagttggtatctttcccgacaattcgattcaattgcttgtaaaaatcgggacaaacattgactgaacttttatcaactacaaagggaaggtgctcaacagtttcatttgagtcataaatcaaatagtctaaaccattagcaacagacgaatatttattggaattaagcgatttcgtaagaatttcttttgataagttgaaaaattcatctgcagtagttgctttattaaataaattatacattgccaatgttatctccttaaagtttaaatcgaaatgttagtaatacttttcttaccactaatggttatagcactgatattcgaaaaggggtagtttacttgtttgacggagaaataaaaccgattcttgatatgacggccggaagccgcatgttctggtggaataaagctgaccctcgtgcaatttttgtcgataaacgcgatgagtttcacagcgtgcctgattgtaatgccaaggacggtgaacgtcagatatggattgatcctgatattcaattggactggactaaggaaccgttgccattctcagacaacacctttcaccttgttgtctttgacccaccacatttaaagcatgctggcgaaggcagttggttggcagcaaaatatggcacgcttgatgatctttggccaaaccaaattcggcggggattcagtgaggcaatgcgagttttgaaaccttatggcactttgatttttaaatggaatgatgaccaaatcaaactagcagatgtgttgcatgaaattacctatcgaccattgtttggtgacaaacgtagcaagacatattggctcatattcatgaaagaggcggagaaatgaaacgaatagaaataaaggttatccgtatgcccagtggcaaatacctttgcgattccgcatgggatggaaagaaccagacatcaaagctgtcaggggcaataacgtggtacggagaaaatagagaaatcgacccatacaaaactgcacatgattggggcggtaaggttgtcgtgcttcgggaggtgcgagatgaaacgagagattaagttcagaaggaggtgaatgatttggacagcaaacgagcattggccgaaaatcttagaaagaatatatacgatctgaacatgacacaagccaaatatgcgaaagagattggaatacctatcaccacgcttgaatatgtaatctctgggaagggtagtgtttcactcaccactttggacaaaatcgcatatggagctgggattgatccatgggaactcattcggccttttgaaagcaaataaaaaagcgcgcctgatgagggacgcgccggaggccaaacgtacacgtgattgatagcaaatggaatcatttaaaaggagtagggggaaaccatggacgatgacatgctcgaaatggcaatcagtgctgaaagggaacgcgcaaggaacgaaatgattgattaccttgctacagcttaattatcaatctaggcgttgtataaggcacctaaaaaaatagacgaaagaaggcgtcacatggcagatacaaaatacccgcgacaattatcgcttgcaattgaaacatctgggctaagcaaacggtccatcagcaagaagtcgtttttatccgagagctcaattggcaaatatgcgttaggtcagcggagtgttgatcacgagaagaaaaaatcgctgtggtcacttttgaaaggagttcgcttaggactttcttcagccagagcagactttggaaccatttcgttcatgaacaatccacgaatcaatgaagatgttttcgctgctacgactacggcagatcaagaggagtctgaaagaaaagcaatctggactgacttcaagaatgcaatcaaggttccagaggaaaagcgaacgcgacagcaacaagagactgtcacaacggggtttaaggaattggttgaagagattgcttcagaacaaaccgaattaattgaacttgctgaatatggcggcattgatccacagcctttcattgacaaatttaaccaaacgtttggagggtaacaaaaatgcagaacatgaagcaacgagagcacaagcgtacttttattactcaaacagaggccgctcgcatgtttgacgtcacgccattcagtgccaagtggagaaagatgagacaacagcctgacttcccacaattgcactatatgaccaatgatccgagagaacgagggacattcaagctttccgagattgaggattatctaaacaacttgtaggaggtctaacaaatgctagaagcaatcatgtcggtgctgttcgacccatcatcagccttttggaaatatctgcttgtaactcttgccggtatcatgattggtgccacagcagtaggaggctggaaacaatggacacgataaaaagagcacaaaaaaatcccgtagcgccaactacgggaagtcaaaaacttagcacattaaattataacttaagtttatcacggaaggcggtcgatgaccatgtttgattacaacacagcggttctgaatgaatatcaacggcgagaagcacttgaagataaagccattgccgattgggagtcctatcacggtaccgtcctgcccaaagatatggatatcgaacaagcggaggagttcttggccaccgccgatgaatatgaagttgatacaaagaaaccttggctctatcaaagctgtgctacatcgcgttatgagggcgcctttaacaaagacaaggcgaaggaatacttgaaagattggatcaacattcacggccctgagcgattcttaaaagacgctgccagttctacatatccgaaaacagaactggttgagattttcttcggcggtgacagcttagacgttatcgatttcatgaagaatcaaggatttcaggaatggaaataggaggagtagcatatgacggcacaatatgacctaacaaaaatgccagttaagaaactgattgagacgcaaacaattaagaataagtttgcagcgcttctggacaaacgggcaccacagtttctgtcatcgattgccagcgcggtaagccttaatccaagcttatccagagttgatcagttaagtgttatcaactcggccatggtagcagcaacactcgatcttccggttaacccgagtctgggttttgtctacatcgttccatacaagaaccaggcgcaaccacagattggttataaaggctatatccaattagctcaacgatcaggacggtatcagcgcctgactgctttaccaatttatgaagatgagttcaagagctggaacccactaacagaggaacttgagtacacgccgaacttccacgatcgcgaagcaagcgaaaaaccggttggctatgccgcatcgttcaaactgactaacggttttgaaaagatggtctattggacatatcagcaagtcgatgatcatcgcaagcgtttcagcaaatctggtggtggcgcggagcccaagggcgtttggaaagacaactacgaagctatggccctgaagacggtaatcaaatcgctgctgactaagtggggtccaatgacaaccgacatgcaaagtgcggtcagtgccgatgaaaaaccagtcgaagctgatccagaactgaaggacgttacccccgaagatcctaactctatcgaggatgcacttaacgctcctgctgaaccagtcacaaaatcggaggtgaagccagatgctcttaagccagacattacccacgacccaaatgcaggaaaacaaccagaaatctttgacggtcaacaaggataattattactcgctggataccagtttcaaatatcagtctgctacctggtttaagaagtttctgacatgcgaagcagaagcgatggccgagttgcaaggtaaatggacaccaagaggtgacccgactgccttgctggttggaaactatctacacagctattttgaatccaagcaagctcatgagtcttttatcaaaggacaccaagagatgttctcaactcgtggatcatcaaaagggcaactgaaagctccgtataaacaagctgatgcgatgattgccacgcttgaagctgatgagaatgttcaacgactttatcagggcgaaaaagaagagatcctgaccggtgatctgtttggggtcgagtggatgggcaagctggactgcttcgactcaacaaagtcattctttttggatctaaagaccacacagtcgcttcacaagaagtattggaaaccaggagaacgtcagccaaccagcttcgttgatgcctacaactatcagcttcagatggcggtttatcaggagctgatttaccaaaattacggaatgcgaccacgagccttcatcattgccgtgactaaggaagacgtgcccgaccatgccgtcatcgaagtaccacagtaccgtatggacgaggcgctggaagagatccaggacagcaccgaacacgttgaggcggttaaatccggtcaggtgcggccacatcgatgtgagaagtgtgactactgtcgcgctaccaagaaagttgccacgatcatcagcatggacgagctagtcgagtaggaggtgactcaccgcatggatttattcaagctaattcgagagttctacattcagcaaagcgttaatccgctaagcacaggacagatagcattatggcatgggctggtttaccaatgtaaccagctaggctggccaagcgaattcaatatgccgaatcgaacactcgaaacgttgactggtttaagccgtcagggcatcgtcaaagcccgcaacgcgctaaagcagtcagggctgatagattttcaaactaacggtgttaaggcaacgacctactcagtcatcgatatttcacgaaagcttagtacgtcagatagtaggcaacctagtagtcaagctgatgacagtgtgtcagacagtaggcaacctagtaggcaacacagtttacaaggtagtttacaacctagtaggcaacacagtagcacatacactaaacaagacgagactaaactagacaaaactaaacgacaacagactactgctccagtaaaggcagcagagaggcctgctgaagaatcatcgtcgtcatcatcaattcttgaaatttgcaatttctgggaaggcaacgggtattaaggcctagatgcttcacaaaagatctatcaactctacttgacgaagagccccatttctctactgtatcttctttttgaagtcagtctgggatccttacggtgacaccaagaatctgccagtagcagtggtcaaccttgaccaacctgtcacctatcaaggcaaaaagcttgatgttggtgcgcagactttgaccaagcttaagaaaaatcatcaacttggctggcatttcgtttctgaagcagaagctaaaaagggcatgaaggcagacaaatactacactgtcattacgctgccaaaggatttttccaaaaatgccgccaccgtcttagacgagcatcctaagaaaatgacgctgaagtacgagacaaatgattcactcaactatattggccaagtcatctccggcatcggcgttgacagtctcaactccgaaattcgggctaacgtgaccaacgcttatgccagcgcagtttttgatcaaattaagactatcggtaatggcatgaaaacggcagccggcgccgctacccaaattgatgctggccaagtcaaacctgacgatggcattgatcagtacaccgtcgccgtttcgcaagtaaatgacggcgtgcaaacgatgaaggttaaagttgcaccgatgtcctcacaaatacctaagctcgcaagcggcgctaatcaagtcgctggtgggttgcaaacactcaatggcagtacgacaaacctagcaagtggcgttaatcagcttgcggcgggatctggccaagttacgagcggtttgggaaccttgcaatcgcagactggcacacttaaatctggtgtagggcagcttgcaacgggatcaactaaagtgactaatgggctgggaactttgcagtcgcagactggcacacttaagtctggtgtaggacaattagcaacaggatccaataaagttactagtggtttagcgtctttgcagtcgcagactgacccactcaaatccggcgtaggccaattagcaacgggatctgatgcggtcaccagtggcttaaacacattgcagaaccaagcaggacaacttgttgacggtacaaatcaattacaaactggttcaaaaaagctaacaactggtgtcaagaactatacgcaaagcgtgacgacactctctaacggcattgatcagcttgctagcagtaccagttccttagataatggaacaaaagcattggtaaccggttcatctcaattaacacaaggtcttcaacaagtaggcaaatccgttgattcacaaaatcagcaagctgcctcatccttgcccaagcttcagaacactctcactgaatatgaagctaagttaaaatccgaacccaatcaaaacccagaattgattgcgggctttgagcaaattcaagcaagcgtcaacgctttgatttctcagactcaaactaatggcgccaaaatggccacgactctcaaccaaagcttgattccgggttcggaagaactaacaaacggtttaacgactttgaatcaacaagttccgactttaacggcagcaattattggccttcaaagcggttcaaaacaaattatttcaaacaatgaccaactggtaactggcgcaaacaatctgactaacggcatagggcaaatggcaacacaaacaccttcactagttagtggctgttgaactaggccaccatatcttcgacccttgtagtaaatttatagcagcgtatcgccacgtgccgcaatccatgcgccaactttgcttgctgcctgtagaaatgctggatccgcgccactattggcgccacaataaactgcaattttcatgttgtcccgcctttcgttcacccgtttatcatacggcgtgaaaacaagcgggacaaggcgttaacccaatttttgtttaaagttaattgatgtctttacgaaccggatgggtgacatgacgatcttgcatcacaatcaacttgcccggggcgtggtgtgtttccaacatttcatgcgcagcaatgacgccatccacgttaaaagcaaatgattgcgctacacgaacttgcagaccccatttttgggcgacatcaactaaataggcaaagccatcatgaacagaatagtccttcgatgggttcaattgcaggtgggttgtgccgggcttgctgctaacatcaacgtcagcataagcggtcgtcacatattgaccgccagctttgacaagctttagcgaggcaccgtggtctgcagcgccaaaaacggcgttgaccacagcatcagcaaggctgtcaggtaaatcatctgtatagctgtaaatctgatcggccccgagttgttgcaaatagtcgtggtgttgggcacctgcaacggcaatgacatttaatttttcaaacttggcgagctgcaccaagatagcaccaacaccgccgcttgcaccaatgactgccaaagtttggccaggcttaagtgacagcatatagtgcaaaatgttaaaagcagctaagccaacttgcggtagtgcagcagcgtccaaaaagcttaaggcagtcggttttttgtaaatttttgaagttgaggcggtgacatactcgctgtaaccgccaattggtcgataattcaagacaagatcaccaatagcaaagtcagtcaccccttcgccgagtttggtaattcgcccaagaacatctgtgccggggacaactgggaacttaacttttcgaaaagccgcctgttcaccacgacgcagtgaagcatcgtagggattcaagccaaagccaagaacctgcaattgtacttggccagtttttggttcgggaatcggcgcctcaatggtttcaaaaacgttcggatcaccgtactgttcaaaaccaaaacgttgcatagcctttcacctccgtcgccaatcagctaaccgaccactttttgccagccagcttttggcgtttgtcaattcttcttcattcaaattgtgactttgcccatgacggaaaatcgtgacatcggcaccttgctcttcaaggtacgtatcgagcactttgaagttttgtgctggcacaatcggatcttgatcgccatgtgacatccagactttgacatcgctaagatcttgttttgaatcgactgtcgaaagtgccatcgggtggaagaaaatgcctgtgtggaatgtatcacttcgcgtcaatagcgcccgtgcagcaacgttagcgccgttagaatagccgatcacgataaatcgctcatagtcgatgtcaaatctccggcaaaggtcatttaacactgaaaatagccaagtggtctcctgttcaagatcgtttaaatcaaagccgccattttccgtgtgcttgaagtagcggttcatgccttgttcttgcacgcgaccgcgaatcgacaacatgggactatttggcgagaggtacttgccaattggcagtaagtcattttcatcgccgccttggccatgcagtaatagtaatggtgagacagttggatcacctttaacaaatgcgtagtttactttatcttctgccatcgcaacctccaatcattaacgtccgcgccagtcggttttgactggggttaattgcttttcaatttcttcgcgtttgctttccaagaatggtggcaactctaagtgaatgccggcttcatcataagtttcatcctgtaagaagcctgggccggttgttgcaagttcaaacaaaatttgcggtgccgcgcggaaatactcggatttgaagtagaagcggtcaacgtaacctgattgcggcaaacgatactgcttgatgcgatcaatccatgtacctaaggtttctcgattctcagtcgagaaagccgcgtggtgaatgttgccaaagccctcctcggcaatcggcagatcttctcgatgctcaagaatcacttgggcgccatgaccgccttcgccaacctcgtaaagtgaccagttgccatcttcagcaatttgcttataacccataatctcggtcagtacatattgcatatgacctaagttgaaaatggtaacggtcactggtccaaggccagtaatcgcgaattcctcaggtacgtcattgtgtttccatggcgtcccaccggcaaccccatgatcgttttcatcggatacaagctgatactgttgatcatcttgatcatggaagttaataatcttggtaccgaattgattgctaataccttcattagcaacccctttttcagcgaatcgcttgagccaataatctaacgctgcatcactaggcacacgaaaacttgcgcgggagatcatgttcgtgccttttttacctttaggctggttagggaaggtgaagaatgtcatgtcagttccggcagtaccttgatcatcagtgaaataaaaatggtacgtatccaacgcatcttggttaactgtcttcttaataagatgcaatcccagcgttttgctcatgaagtcaaaaatcgcttgaggatcgctggccatggctgtgacgtggttcatacctaataatgtgtgttcaatcatggaaatccactcctttggttttaaaatacgtttcaatggcttgacgttgtgcctcgaacttcggcggcagtccgagaccttcgccgaggtgggcaagcggctcatctaacgcaaagccgggttccttagtggcaaattcaatccggttatcggcaggatcgcgaacatataggctcttaaaccagccgcgatcagcaaactcctccatgcttccgcggccaaatcgtttgatgctatcagtgaggctaggcttaagggtcaaggtgttaccggcctcaagcctgaattgattattttcgggggtcacacacagcatggtttgaaagaaggtcttttcagcttcatgatcggccactaggagatcgacattaattaatccggtaatctggttttcgcccggaacatcgtttggcacgacaagttgcgttggtaacgtttgatcggtcaccaacagtctgaccggcgtatcagccggatcaaccaaagttaaactggtcagcgtggctgtcaccacacaacctgccatccgcagacgctgttcccaaaatgccaatgacccagttggaatggcaagatcaatcccacccaattgattttgcccatcgtaacgatgccccaatcgatcaatcgcaaaaaaggtaaccacactgccaggagttccttggtaatcaccgaaaaacagatgtcgaacatgaatgttctcctgattgacggtatttttgaccagacgtaaacctaaaacctttgtataaaactgaattgtcgctggagcatcaccggtcaacagcgacacatgatgcaaacgggtcatgacattgcctcctccttgatacacttactaaaaataagtataacagtcttattcgctgaatgcgagtcgctgctatcaacttaatcgtaccttgttttgacatataaggcgatgatttcgtctttaaaaagataacggtttcattcaagcttgacgcttgtttggaaaaatagcaatttttataattgctgaaggattttgctgttggaagaaaacagaatagcttaactagtttctttaattttaatggcaagcggagagctcgcggaaccatcccggacaaaggcgtacacctttggatcaataggattggagctcgccacgcctgtcaatgaagctgactcgcgctcggcacgcttttcggctataatataaggatatgaaaaccggagaggggacaagatttgtggcagtttttgagccgacttggctggtaacgaatattttcagtttgacacctgccagcttgaaacaacaagggattaaggcggtcttgacggatctagataatacgttgatggcgtgggatcatcccgaaggcactgaaacactgactcgctggctgacggacttgcgcaatagcgggattaaagtggtggtcgtctcgaataacaatgcaaatcgaatccacaaggcaatggccaagctgggtgtggcatatgttgctcgtgctttgaagccgcttcctgtgggtatcacgaaagcccgcaaacaattagggcttaagcgatctgaagtggtgatggttggcgaccaattgctgaccgatatttgggcaggcaatcttgctggtgtgcgaaccgttttaacccagccacttgttcaaagtgatgcgtggaacaccagaattaatcgttactttgaaggttacgtttttaaagcactcgccaagaaacggcatttggattatcaggaggatattcatggataccacgaacactgaaacagagcgccgttgcataggctgcggcgctattttgcaaacaactgatcccaaaaagccgggatacttgccaaaagccactttaagcaaggccgatcctgatgacgagatttattgccagcgctgttttcggttgcggcactacaacgaaattgcgccggtgacgttgacggacgatgattttttacgcttgttgaatgccatcggtgaaagtaatgcgttgattgtcaacgtcatcgatatttttgatttcaatggcagtattatccctggactgcatcgttttgtgggtgacaacccagtcattcttgtcgggaacaaagccgatgtgttgccgaagtcgcttaacccgaatcgattgaagaattggttacagcagcaggcaaaggcacaagggttgcgtccggtagccacgatgctggccagcgctaaaaaaggttttggcgttgatgagctgttggatgccattgaaaaatatcgtgatcatcgcgatgtttacgtggtcggcgtgacgaatactggtaaatcgaccttgatcaatcgaattataaaagaattgactggcgttgaggatttgattaccacgtcgcgttttccgggaacgacgttggatcgcattatgatcccgctggatgatggccaatcattgattgatacaccagggatcattcatcggcatcagatggcacactttgtcggccctaaagacttaaaattagtctcaccgacttccgtcatcaagccagcaacctatcaattgaatgaaggccaaactatttttcttggcggtttagcgcgatttgattaccttcgcggaggtcgcaacagtttcgttgtttacactgataatcagttgacactgcatcgcaccaagttagaaaatgcggatgatttctatcagaagcatgtgggccgtttactgtcaccaccacaggcggatgaagtgccagactttccgccattggttcggtttgaattcaccccaaaggaaaaagccgacttagttttcgccgggttaggctggatcactgtgcctgctggtgttacggttgccggctatgcgccaaaaggtgtggatgttttgttacggcgtgcgttcatttagaaaaactatctttggtatcaaaattaatcatgtcgaagtaaaacgtgtacggcggtaagtatccatgaccacaacgaggcactcagccagttgtgtttaaagagctatgcctgccgagacacggttagaggagcgttattgatgttaacagggaaacagaaacggtatttacgcagtttggcgatgaccacgaagccgttaatcaatgttggtaagaacggtttaggtgacacgtttgtggctggggtgaaagatgccctcgaagcgcgggaactagttaaaatcagtttactgccggctgccgatgatacaccgcaagaggtagccgataccttacaggcggccattcaaggtgtggagatcgcccaaatcattggtcacacggttgttgtctataagcaggctgagaagaaagatcatcgaaaaattagcctggaagttaacgcacgctaagaggatcactatggagaagacgcagagtgtcacattgacccagcccgtgatctccgttgaaatgcgcgagcagattcttggccagcatcggcgaaaacagattggcctatttggtggaacttttaatccgattcacaacggtcatttaatcatggccgaagcagctggcacggagctgggattagaaaaagtttattttatgcccgataatcaaccaccgcatgtcgacacgaaaactgccatttcggcgcggcatcgtgtgaatatggtgcaactagctatcgcggataatccgctttttggattggaagggattgaaatccgacgaggcggtgtcagctacacttatgagacgatgttggagttgcaccggttacatccagacaccgattattatttcattattggagccgatatggtggattatctgccaaagtggtcgcacattgacgaacttgtcaaattggtgacatttgtcggtgttaaacggcgtgggtatacgccagctagtcgttacccaattctgtgggtggatgcgcctttgattgatatcagttcaactgatgtgcgtgatcgggtcgcaaatggccgaagtttgaagtatctggtacctgattcagtaattgattatattcaaaaagagggattatatcgtgagtgaacatcaatatccggcaagtctgacacatggcttaagtcgtgaggaaattttaaatcggctgcacaatcggctcgatgaaccgcgttatgagcattgtttgcgggtcgaagcgactgccattgaattggccaagcgttttgatcaagacgttgatcgcgcaggcttagcaggtttactgcacgattatggtaaagagattccagttgaaacctataaacgcgtgattattgaagatggtttcgatccggatttgttgcaatatggccgcggcgtttggcatggtgttgtcggcgttcatttcattcaaacagaggtcggcattactgataagcaagtattgactgccattgcgcggcacacgacaggtgatccggaaatgaccaagcttgatgaaatcatttttgttggtgattttatcgaaccggcgcgatctttgccggttgaagcaaaggcgcgtaaggcagcggaaacgaacttggaagaagctagtcgaattgaattggagaataccttgacttatctcattggtgcgcgcaaactcgtttttccaaagacactattaacttataacgcatttttaacaaaggagtaatttatgattgattcaaagacgatgttggaagttgctgtcaaagcaggtgattctaagcgtgctgaagacattgtggcgctagatatgcgcggtgtcagtttattagctgactactttgtcattatgagcggtacttcagatcgacaagtgcaagcgattgtcgatgaaattgaggataaagaagaagaagccggcgttacgattcgtcgcattgaaggccaaaaaggatcgaaatggatgctgattgacatgaacgatgttttcgtgcacgtcttcatgccagaagaacgccaattctacaaccttgaaaagttatggcaggaagcaccgctggttgaagtagatcagtgggttgaagcatgatttatcaaacgtttgccgaagtttacgacaaactgatggatcaattactctattcgcagtggcgggattatgtcacgaagcgggttgcaccagctggtcagcctatcttggagttggcaggaggctcaggtttcttggctgtgttgttggcgcaagccggctatcaggtgaccgactttgatttatcggacgaaatgttgtcgctggcggcagaaaaggctgaggaagccgatgcccaactgactcttgttcaaggcgacatgcgtgatttgagtgatttaccaccggttccggtcgtgacatgttttgacgactccatttgttatatggcgaatcttgaagaagttcagcaagtcttcactcaggtagcgtctttgctgccgccgggcggagactttcttttcgatgcgcactcgctatatcaaatggaccagatttttcccggttatatgtacaattatcagaccgatgattttgcctttttatggcacagtttcgtaggtgaggtgccgcatagtgttgagcatgatttaacgttctttctttatgatgagggcctagatgcctataagccgcttacggaaacccataaagaacgaacttatccgattaacgactatctcgatgccttaaccgcaagtgggtttgaaaaaattgaagtgacagctgattttggccgtcagccaattcaggcggacagcacacgctggtttttccatgcgaagaaaaaatgaatgaccatgatgatcttgcagtttaggaggcggccatgcagacagttgggatgattgctgaatttaatccatttcatacgggtcatgcatatgccttggcacaagcgcgaaagctggcgcaagcagatgttgtcgttgtcgtgatgtctggtaactatgtacaacgcggggagccggctatttttgataaatgggttcgggcgcaggcggctttgcagcatggtgcagaccttgtcgttgagttgccggtgactggagccgttcaggccgctgaccagtttgctgaagccggtgtgaccgcgttggccgccatgggtgtcaacactttagcctttggtactgagcatcctgaagttgcttatgcggatttagctaaaaaactggcgacagcagcgttaactggggatggatttcgcgattatacgcagacatacgccacgcaactcaacgctgtttatgcaaaagcggctgggatcacccaaactgatcctaattttatgctgggcttgagttatgccaaggctaatttagcgttgaagaggccgatgacattgttaccatttgcgcgtcgtgggattaatcatgatgaagtaggcattcaagccaacatcgccagcgcttcgacagtgcgtgagtatttacgtgctgatcaatcggttgaagccatcgtgcctactgagcttgtcgatttttatgctaagcaacaacagtatagctgggcgcaatttttcccgtggttgaaatatcgcctgcaaacagccgagctcaatgaactgcggctggtcgcaaccatggcagaagggttagagtatcgcttcacccaaaaaattgatgacgcgcaagacatgactgcttttttgaagcaggtaaaatcgaaacgctatacctatgcgcggttgcgacggctagcgttggccattactttgaatatgacggctatggcggttaatcaggcacggcaacacccgctgttgcacgttttagggttcacgccaactgggcggcagtatctcaatattgtcaagcatgatcttgactggcccttgctcacaaaggtcagtgctgatatgcttgcaccggatggcgtcctcgcgatgacccatcgcgcggatcgattaatcacaacgattggtggcgttgagcagaactatggccgacgaccactgatgtgaagagcgcgaactggcgcgcttagtaaccggagcataagcggcctcaggtgtgatgaccgaacttgggtcattgcgcctgaggtccttatacgcaggtttctgcgcctaagaacgcgtttaaaggaggtaaaccacatgttgaaatggaccgttcaggagttaataaaacacgatcaggagccgttgcattttagcaccacgttagatgttaaaacggatttacaggatcgcgatcccgaggttcttgacgtgagtcccattcaggtaagcggcgatattgtctatgatcgtggtgactttttggtcagtgtcaacctaaagggtgatttggttgtgccgtcaacgcgcagtttgacgccggtcacactgccgcaagattctactttcagcgaaatttatttaacggacgctggtcatgctgaccaatatgaggacggcgaaattcttatgccgctcgaagatgctgaactggatctgttgccagcgattgaggaccatctgttgttgagcattccaatgcaggtcctgacaccagaagaagtcgcaagcggtgatatgccctcaggcgatgattgggaagttttagcagaagaggattttgataaagctgttaaaaaagaaaaacaggcggacaatccctttacgaaattaaagggaatgttccctgatgacgatcaagcgtgatcaataaggtcttcaggctcacggtaatgtaatttgatccattgaaaaatggcaccttcgtaattgtattgcgaggatgccattttcttttgtagtagcgaaaacgatttttatgagaaagccttgttgggttcatgactcaaaaacagttgatgagggagcgggctcaaaaagtaaagctcgctgcggtgaatataaaaatgatttctgataatcagttactgagaaacttagacaaattgcacactacaaaactagggcgcatccggattgaacacaatctttcacttactgatcgggacgtcattgcattttgcaaagagaaaattctgaatcctgaagcaatcatgaatcgaaagggtaaaaattggtacgtcaagattgatcacatcatcgtgacaattaatgctaacagtttcaccgtgataacagctcacacagagggataacattttaaaatagttgaaacaaagcagattctgtctgtttgcctgaggcggcgtcttctttttcaaagaaaataagcgaagaaaaattgaccgcttctaacctagctgttgactgttaaacccaagctgtttctgctaacataaaaggagtaaatgacgaaatgaatgaggaggtccatgttaatggataaaccacaaattggtgttgtcggcatggcagttatgggcaagaatcttgccctgaatattgaaagccgcggcaatacggttgctatcttcaatcgcactggcagcaaaacaaaggcggttgttgaagagcatccggataaaaagttggtaccaagttacaaaattgaagattttgtcgcatcacttgagaaaccacgccgaattatcatgatggttaaggctggcgctggtacagatgctgttattaaggaactactcccgttattggataaaggcgatgtgctgattgatggcggtaatactttctttgaagataccatgcgccgcagtgctgagctcgacaagtcaggcattaactttatcggcatgggtgtttccggtggcgagttaggcgctttgcatggcccttcattgatgccaggcggccaaaaagaagcctatgacctagtcgcaccaattctggaagccatctccgctaaggctgaagacggcgcaccttgtgtcacgtatatcggaccaaacggcgcaggccactatgtcaagatggtgcataatggcattgaatacggcgatatggaactgatcgctgaaagctacaacttaatgcgcaatcttcttggccttgatgtcaaagaaatggctgatattttcagtgaatggaacaaaggcgaactggattcttacctgattgacatcactgctgacattttgactcgcaaggatgatctcggcagtgacaaaccgattgttgacatgatccttgatcgtgccggcaataaaggcacaggcaagtggtcctcccagtcagcacttgaattaggggtaccgcagagtgtcattactgaatcagtctacgctcgttatatcagtgccatgaaacaagaacgggttgaggctagcaaggtattgccgaagccggttgccaatgtttctgttgacaaaaaagaagccattgaaatgatccgcaaggctttgtacttcagtaagctcatgtcgtatgcccaagggttcgaacaattgcgctttgcttcagagaagtacgattggaagctgcaatatggggacttggccaagatctggcgcgctggctgcatcatccgcgctcgtttcttgcaaaacatcactgacgcatataacaagaagcccgatttgcagaacttattgctggatgactacttcttgaatatcgccaagaattatcaggaaagtgtccgcgacttagttggtgttgctgtcaaggctggtgtaccagttccaggcttctcagccgctatcagttattacgattcctaccgttcagccgtcttgcctgctaatctcacgcaggcacaacgtgattacttcggtgcgcacacttacgaacgaaccgatcgcgacggcatctaccactattcatggtataccgaagcttaataacttcatatttataaaaatgaagaccaatctcacaaacatatttattgtttgaaggattggtctttttatgagaatttaccagttttgaaaaatgagaaagtctccgaacaaagatttcttgtgtttgtcgagccccatcgttgcgcggctgatagtcaaaatgagaaaactgtgctaaactgtcgtagcatatgtttttatgagaaaaaacaaatggattcagtctgtgagtgcgtcagagacgaataagtataaggagaccattgatgagtaaaatattaattattgaagatgaaaaaaatttagcgcggtttgtcgaactggaattaaaacacgagggctatgagaccgaagtgcattttaacggtcgaaccgggttggaagcggctttggcagaggactgggatgccatcttgcttgacttgatgttgccagaattaaacggcctggaagtttgccggcgcgttcgtcaggtgaagaatacaccgatcattatgatgaccgcgcgggattctgtcattgatcgcgtcagtggcttggatcatggcgctgatgactacattgtgaagccatttgccattgaagaattactcgcgcgcttgcgtgctttgttgcgccgaatcagtattgaaggcgaaaacaacaccgctaaacagacaaccatcaaatatcgtgatttagtgattgaaaaagaaaatcgcgttgttcggcgcggcgacgacattattgaattaaccaaacgtgagtacgaattattgctgacgcttatggaaaatgtcaatgttgttttagctcgtgacgttttgctttcaaaggtttggggttacaactctgacgtggaaacgaatgttgttgatgtctatgtccgttatattcgtaataaaatcgatcggccgggtgaaccgagttatattcaaacggttcggggaaccggctatgttatgcgttcgtaatgattccgaagaaacaaacgcttgagcaaactagaaaaagtccccgcatctcgttaaaggttaaatgggccttaacagtaggtgtcgggatttttgtgacctttgtgaccttttcaatgatcctttatggcgcgatgcggcagattttagtgaatcaggaacgccgaaccgtgacggacacccttaacaccgtcgtccaacgactttccccagtcagtggtgacttaacgatggcgcaggtcgtaccgcgattggaaggtgcaatgccgagtgggcaagcctctattccagcgccaagtgaatcgcaaaatcgtattttctccgattccgtgattcaaaaactagcacaagcggatgtgagcgtctctgttttttcacctgatcggacaaatatttttcaatcgcgcgatacgccgattacattaggcaaggttcatggcgtggaagttcaagaagccaatattgatgattttcatggcttggtcggtacggcaccgatttattctgcaactagttcggatttgatcggctatgtgcaggtaacggataaactgacggcatttcatgcgaccatgcatgagattacgttactcattatgggactgtcatttgcggccattcttatttctattctcattggctatgctttggcgacgcgctttctcaagccgattaagcttattacgaatgctattgatgttgtcaatgaggaaccgcagagtacggttcggataccagccttgaagcgcaacgacgagcttggcgatttagtgctggaatttaatggtatgttggatcggattcaacgctacattgatcagcaaggtgagtttgttcaggatgtttcccacgaattgcgcacccctgtggcgattctcgaagggcatttgcagcttttaaatcgctggggaaaagatgatccggaagttttggcggaatctttaacggcctcattgcaagaagtgactcgcatgaagagtctgattcaagaaatgctagatcttactcgcgctgatcaagtggatatccaatttccaaatgcggttgttgatgtgcaccagactgtgcaacaagtcgttggtgattttcggatgattcatccggaattcacgtttacattagatgacgacttggaacagaaaacgtttgtgcgcatgtatcgcaatcatttggaacaggtcatgattattttattggacaatgcggtcaagtattccactgatcgcaaggagattcacgtatcaatggctgaaaacagcgtttccggtgtcgccgttgcggtgcaagactttggtgaaggtattgccgaagcggatcgtcgacgcgtctttaatcgtttttatcgagttgataaggctcgtagtcgtgaaaaaggcggcaacggactaggtttatcaatcgcgcaacagttagttgagagttatcacggtcaaattgaagttgactccgctttaggtcatggatccattttccgaattgatttaccaaccatcacggaagctaaagcccaagcactggctgcacaggaaaccactaagcgcgcagaagcaggcaaaactgatacacatatcaagagtaatctttaatcgttttatacctcagacgagctatttgtctgaggtttttttgatttcaagcgcagggtgagttcatatgagcgtgtcatcaagcaacccacactgtatgaggtgaacaaacagggggacatcaaatacttttggcttcagatcctgttgcgcacacaaatagccctaatcgcaagctttgcgatcagggctattcataacttgacgattatttccggggacgctgttgtttaccagcgttacgccgacgtaatttgctatgatcaatggcgtctggatcagcaggtttgctgctacctgttgtaccagctgcaccagtggcaccagcagttgccgtatcccagttatcaaaagtatgttcgtcaacaacgataaccggtggattttcttccatttcagcatccattcgcttccggatgttcggcgtaacaacataggttacgatcgcttgttggataattagaatgatcccgccagcaccgaagtagaggcctaatccggcgttgtacatcatacaaaagacaaatgtcaagatcggattcagaaaggcagttgtctgcatggctttacgctgttctggcggtacgccttgcagcatgatcaagctgacgacaatgtatggcagagttgctaaaatcgtgacaataaaattggaatgccccaactgaatgccaaaaaaagtggcttcagaaatttctggggagtaagcgatggcttgatacaaaccagagaaaattggcagttgaatcagcattggtaggcagcccatggaaggaatcatgcttgtgccattggctgagtatattttccgcatgtaaccgttcattgccatctgctgttcaggtgtcttggcgcgcttagtagcctcttgaacgatctttagttgtggctggatgatcttctgcttctcttgataagccgtcatcgttcgttgttgccgcagcatgagtggcaggacaatcagacgaactagcagggtgatcacgatgatggcgatcccataactgctggcagtgccaaccagactggcgatccactccatcaaatgttgcagtggcagcccgatcactttataaaaagtgccaaaaaacggatccgtcggcggcttcatggttgtgccttttttagtggtttgcgcgcatgctgctaaaatcaacggcagcaagctcaccaacccaagtgtgacaaattttttcgacttgtgcatgaatgttttcccttcaaaatgtaatcgggtttaactatactgtatggactggttggattcaaccggtaacttgaaaaccgcggaagtttggcacgtcttcaagcggctgttcttcgtaggtcgacacgtttgcgtatgggtttggaccggccttaaccttcgccacaaatttggcaaggtttaacggttcacctgcagcctgaataaagacagagccatcagaccgattctcaatcgtgccgctaatatcaagattgtcggcgatcatcttcgtggcccagcggaaaccgacgccttgcacccgtccgcggacgacgatttgtttagcaagtttgaccaaaaagacacttcctttcttaattggagatgctgtcaagcagcatttgctcatcttagctttctccacagtccatactagtgtagcataaggcttataggagaaacgacaacagacttaagttggattttgtcttgcaagaagaaaacccgccaaacggcatcaagcaaacaaagtaccatttaataataaggagaacttcatggaatatatttcatcacctaagaatgacagaatcaaaacagccaagaaactcacggttaaaaaacatcaaaaggatgctggccgctacttattagaaggccgtcacttggtccaagaggcacttgccagtggccagaccccttatgatatttatgcgaccgaaaagtatgttgaagatcgtgcgctcaagccattttatgacaaaatcacacagatttctgaatccgtttctgagcatttaagcgacactcagaccccgcaaggcatttttgctgtgatgccgcgccgcgcagaacaattgccagagccattgagtggtcagttcttattgttggatgcgattcaggacccgggtaacgttgggaccttggtgcgaactgcagatgcagctgggattcaaacggtggtcttcggtaatgggacagcggatgcgttcggtccaaaagtattacgtgcgatgcaaggcagtcaattccatgtgcgcattgtctccgctaaattaatgccaattatcaaagccttacaccgtggcggcatcccggtttatggctcagaattaaatgaaaaagctaaaagttatcatagcattcaaccgagcgaacgatttgccttaattgtgggcaatgaaggcaatggcatggatccacttttgttacaaaataccgatacgaacctttacattccgatccggggcaaagctgaatcattgaatgtggcggttgctgcagcagtcatgatgtttcatttagtcggggattaagaatcccttacaaacgtgacctttctggttagaacctgttatactataagtgtgttcatcaaaccacaaaaggagcagatgtcttgagcaaaaaacgcgattggcaatcggatgctgagtacgttgggtatgtggcggatcttttagccaaacccgaagtccagcgactggcagaacacccgcaacatcattattctaaccgattggaacactcgatcagtgtttcttaccagagttatctgattgggaaacggctgcacttgaatgttcgttcgatcgcccgggcaggcttgttgcacgacctgttttactacgattggcgtaaaaccaagtttgacttggggactcatgccttcatccatccacggattgctttgcggaatgctgaaaagctgactgaattgtcaccgatggaaaaagacattatcgtcaaacacatgtggggcgcaacggttggcttaccgaagtataaggaaagtttcgttgtttcacttgtcgatgattatgccgccatggatgaagtcgttgtaccatggatgcacaagctccggcatccgatccacactcacttaaaggctttaaattaggatcgcaaagttttagcagctatttggctgtgaaggacgattggaaccacggatgaatgccgtggttctttttctggaaagttttgccatatttttcaacgtttctcgaagactggcttgtaatattttcacattgtggtattctagcactatataaatgtaagtgaatgggaattatgaggtgagtagagtggatgcaacagtaaccagtacagccgattgtcaaagccagcaggtcgctctttgtccaaaatttcaacatacgtttgagatcttaggaaagaaatggaacggactgattttggaagttttattaaacaatggcaattcccgttttaaggacattgcgcaattaatcccgcggtgttccgatcgggtcttggtcgaacgcttaaaggaactcgaaagcgaaggccttgtggatcgcttgacccacaaagactcagctttgattgaatacgcgttaactgacaaaggccgcggcctcaattcagttatggccgctgcacacgcatggggcgatgcatgggtcacagatgctgaatgccacgctaacgagaagtgaaaacgcgttgatagcgcgttttttattgtcttgtgctaatggctatggctaaaagtcaaaggatatcattgtcttggctaatattcagctgtagactcagaggttccaaatacgattggtgaccaccgcatagtcattatcacgcttgttcacgctttgctgaaatcgccacttgacgttggcgctgaatttgctaagcttagtttatctaaaaagacgtaaaaacgatgacgaaagcccaaacaggctgacgagatagggaatgacgttcatacgactgcaagacgtctatcgccaaagtgtttgtcttcactttctgagttgacttttgaagtggcaacacttagaaagctccggcctagccgttaccttgttgagtgcatggttatttcgtgaccatgaacaagggtggtaccgcgatgcttcgtccctttttcgagagggactttttttatgccttcaaatgcatcagaaagttgtatcaaccctcacgtcagcaaccaaggaggaagaacatggatcttcaaaccaaacttgaacaattgttccaacaaaacaacgacaccattaaaaaggttaagtcgttagatgaattaaatcagattcgcgtccaattattgggcaagaagggcccgattaccggtgttttgcgcggcatgaaagatttgtccgctgaagaacggccaaaagtcggcgcgttcgccaacaaaattcgcgacgatctcagtgcagtgatcgaagcccgcaaagcccagctcgaacaggcggtgatcaatgcgaaattagcatcagagaccgttgatgtgaccttgcctggtgatccggttgaggctggcacaccacatattatcacgcagattatggacgatcttgaaggcttttttatgggcatgggttaccaagttttgaccggtccagaagttgaagaagatcactataactttgagatgatgaacatccctaaggatcatcctgctcgtgatatgcaagagactttttacattaccaatgagttactcatgcgctcgcagacaagtccaatgcaggcgcggacaatggaaaagcacgactttaccaaaggaccgctgaaaatgattagccctggggtggtttatcgacgtgatgacgacgatgctactcatagccatcagtttcaccagatggaaggactcgtcattgacaagcatataaccatggctgatctaaagggaaccttgttggccatgtgccaacacgtttttggtaaagatcggacaattcgcttgcggccaagttattttccatttacggagccatccgttgaagttgatgtttcctgttttcgttgcggcggtaaaggttgcccggtttgcaaatataccggttggattgaagtgttaggtgccggcatggtgcatcccaatgtgctacgggcagcgaacattgatgctgacgtatacggcggctttgcctttggccttggtcctgatcggttcgcgatgctgaaatacgggattgacgacattcgcagtttctacacagacgacttgcgcttcttaacgcaattcagccaggagggttaagatggacgtctcatatgaatggttaaaaaaattagttgacgtgccggtttcaccagaagaactggccgataaagtgtcacgaacagggattgaagttgatggcgtgaagcatccagacgccggcttgaaaaagattgtcgtcggtaaagtggtaagtgctacgccacatccgaactctgatcatttacatctttgtcaagttgacgtcggtgaagaaacgccgcgccaaattgtctgcggcgcgccaaatgttgctgccggtcaaactgtcattgtggcgctgccaggcgcgcgcattgcggataacgttaaaattaaaaaaggcaaaatgcgcggtgaagaaagccttggcatgatttgtgccttacaggaaattggttttagtgaaaacgtcgtgccgaaaccatatttgaatgatatctatgtctttaacgagccattagagcccggcagtgatgccttagctgcgttaggcatgcatgacgccattttggactttgagatcacgcctaatcgcgctgatgcacttggcatgcggggcgtagcttgggaagttggcgctacttatgcagaaaagccccattttgaagaaaagccattaactgaaggtgatcgtccggtcggcgactttttgagtgccgaggtcaaggatgccaaagacgctccgagttatcaactgcgggtcattgatcatgtgaaggttcaagaaagtcctttgtggttgcaaaagcgcctgtggttagcaggtatccgtccaattaataatattgttgatgtgaccaatcttattatgctggcttatgggcaaccgctgcacgcttttgactatgccaagttaggcagccagcagattgtggtgcggcgcgctaaaaatggcgaacctttgaccacgctggatggcaatgaacatgaattagatgatcaagatattgtgattacgaatgggcaggtaccagttgctttggctggcgtcatgggcggcttgaattctgaaattacgccagaaacgactaccgttgtgattgagtctgctagttttaatccagtcaatgtccgtaaaacagcccttaagtacaatttacggtctgaagcctcttcccgatttgaaaaagggacgaacttggctgatatcaatcgtgctttagatgctgcagttgcttggatggctgaattaagcgagggccaggttgcaaagggaacggttagcccgacttcagtttctgcagaagatgttgtcgtcgatatttcgcttgatcatatcaaccatgttttaggtaccgatttgacgcagcaacaagtgacgcagatttttgaacaactcggttttgatgtgaccgaatctgatggcttgtttgccgtcgctgtaccgccgcgccggtgggatattcatatcaaagcggacttggtggaagaagttgcgcgaatctatgggtttgacaatttgccaagtacgttaccaacgacaaccatgactattggcgagtacacctcgcaacaaaaacggatccgacgtacacgtcatctattagaaggattgggtctgacccaagtcatcacctatgcgttgacaactgccgaggctgccgagcaattcaagctgcaacctggggtcccaaccaaagtcgattcaccgatgacgaccgatcatgctgttttgcggatgaacatgattagtggtttgctaaatgtcatcaagtataatcaagcgcggaaggaaaccgatgttgcgatttatgaacaaggtcggatctttaccaaaacaggcgatcaggtgcggccaaccgaaattgaatatttgggtggtgccatcactggcaatgttgtcgcaaaagattggcatcaatctgcgaaagccgttgatttcttttacgctaagggcattgtgacacatttgctggatgattattcgctggccgatccgattcgctttgaagcaacgcaagctgtggctgaactccatcctggtcaggccgcaaacatttttgtcggcgatcaacttgttggcattttggggcgcttgcatcctgcctttgaacatgcagagcacctgccagccacctttgtttttgaattagatttggatgcgctatttgccgcgccacgacaggaaaaaatcgcgcaacccgcaccgaagttcccggcagtaacccgtgatattgctttgcaagttgacgagcaagtaacgaacaatcaagtcatggctattttccatgaacacggcggtgccttcttgcaggatgtgacgttgtttgatgtttatgcaggcgatcacattgccgcgggtcagaagagtttggcgtatacgctaacttatcgtcgagacgatcagacgttgactgaagacgaagtgacgcaggcgtttgataaagtgaaggcggcgttacagacaggaatcggggctgccattcgctagatgcagtcgcatttttgtcgctggttgggtataatatttgctgattcagatttattgttcagaatagttaagtagagcgggactaggtacgtttggaaaccgtcacaaaggcagccttgggcacgatggccggtactttggccattgtggacgaggtccttaagtgcagatttctgtgccagtgaccgtgttaaccttagaggaggcaacatttttggatagacggtcatcagatcgacaagacaagcggcgccagcgttctagtgaaaagaaagtagccaacaagatcgttgcttgggttattgggattgtattggcggtcctagtgatcgttggtttgatgggctaccgctatgtccgttcagcgcttgagccggttgatccaaatggcaagacgtcgattagtgtgacggtgccagcgggttcgtcaacgaaacagattgccgcgcagctggaagccaaacatgtcattaagagcgtcactgtttttagttactatgtgaaattccacaatatcgccgactttcaggcgggccagtacaagttgacacaacgcgccaatatgagtacggtgattcaagccttgcgcgcgggtggcagtgccaccactgctgcgggccaattgctagttaaagaaggcacaacgatcgaacaaatcgcgacgtcgatggataagttaacgaaaagtaacaaaaatctgaccggaaagaaatttctggcattgatgaaagatcaaaccttctttaatcaattggctaagaaatatccgcaattgctgagttcagcggccaatgcaaaaggagttcgctatcgattggaaggctatcttttccctgcgacttataacgttggcgctggtgaaacagtcaaggaccttgtggatgcgatggttgccaagacagacagtgtgatgcagagttactacaagagcattaagaagcagcaatacaccgttcaagaagtcatgacgcttgcatcgttagttgagcgtgaaggggtcacccaagatgatcgtcgcaaaatagctggtgtcttcttgaaccgaattgatgcggggatgccactacaatcggatatctctgttatgtatgcattgaacacgcataaaacgcatctgactaacaaggatactagcgttgattcaccgtacaacttatacgtccacaccggctatggaccgggaccgtttgactcgccaagtgagcaaagtatcacagcggttctcagccctgatgcacgtgacaaggactacttgtactttgttgctaaccttaaaactggtgaagtactttacgcgacaacacgggaacaacatgatgccaatacggctaagtttgccagcgataatgcagcggcagataagtaacctaattggactttggccgcataaggaccttggtcattgtgaccagggtccttatgcggttgtttctgggctgaaggatgagttttgaggagggcttcaaggtgcagcagaaaaaaccgattgtgattggcgtgacaggtggttctgccagcggcaaaacaagtgtgagtcgagcgatttttgatcatttttcggggcactcattgcttttattagcgcaagatgcttattacaagaaaagtgacatgctgttttcagaacgaaaaaagattaactatgaccatcctttggcatttgacacaccattgttaaaggatcacttaaatcggttgatccatcggcaagctgtcgatcaaccggtgtatgattacacgattcataatcgctctgaccgaaccgttcatctggcgccaaaagatgtgattattctggaaggtattctaattcttgatgacgcagaattacgcgatatgatggatattaaggtgtttgtcgatactgatgatgatattcgggtcatccgccgcatcaagcgggacatggtatcgcgtgggcgttcactggattcgattattaatcaatatttaaaaacggtaaaaccgatgtatcatcagtttgtcgaaccatcgaagcgttacgctgacttgattgtgcctgaaggtggccaaaatcaagtcgccattgatttactggttactaagatcaaagccattctggccgaacgcggtttgcaagagtaatcattgacaaatgcggctggtcttaatacagtgactaaggaaaataagaagtgaggtaagaattttatggcagacaaaagctatccaatgacagcggaaggcaaaaagaaactcgaagacgagttggaggaactgaagacaaagaagcgtccagaagttatcgaccggatcaaggttgctcgcggttttggtgatctttcagagaactctgaatatgaagcagctaaggatgaacaatccaccttggaaaatcggatcgtgaccattcaaacaatgcttcgttacgctgaaattattgattcaaaagcggttgctaagaacgaagtatcacttggtaagaaagtcacgtttgaagaagacggtgatgaagaaacatatgaaatcgtcggcgctgctgaggcagacgccttcaacggtaaaattagcaacgaaagcccgatcgctcaaggtctgattggccgtaaagtgggcgataaggtcacgatcagtacccctggtggtgagatgaagatcaagatcaccaaagtcgaaggctgatcagcacataacgctttgtcaacttgcgccaaaagcaatcaacggcaaatgtcttttccggtcatcaaggagaagacgtttgtcgttttttgtggcttaaaaaagtgaaacggcgactgagccacatcttgggttgcaaattcagccttacgccctaagtcaaagacaacgaaattcgttataattaattgaaatgaatcgacatcgagtcaacgtatacgctaaaaagtagacaaggagggatcgtcgtgcgccgctggcaattatttttaggcatcgagttagctttaaccctgtggctgtttttccagatcatcacgaatcctatggcactgacaacgatcctagtgggcgtgttttttcttttcctcggtgcgcgatggcatcggttgcgctcgttcaatgtggcttttggcgggattttgttagtcttgggaatttttatcaatccggccatttggctcattctaatgatcgcgggtgtgttcataatcatggtcgttacgaaaccaggtatggggttttcggcttgggatcgcaaacagtatgtagcgccagtgaccaaggagcccagtgaaaaagccggtaagcgcacgattaactcgtggactgatcggcatacgatttcgccaacctatgattgggatgacattaatatggttgtgccagctggcgataccattattgatttaggggatacgtttctacctaaaggcgatagtgtgatcatgattcgcaaaggttttggcaaaacgcgaattctggtgccgattggcgttggtgttgcggttgaacacgctgccttttatggtaccttgcattttgaaaataaagattcgatgctgcatagccaaagtgtcacggcatattcaaaggactatgatgatgcaccgcgccgcattcacatcattacgagtgtgggtgttggcgatttggaggtgctggctgtatgagaagacggatgctggttggcttttttatggcattactggtctgggcgcttttggtcgaggcctgtttggttttcatgctagctaaagtaaccgaacatgattttttgcaggtgttattgaccaccgtcctgtccgcaccagttttggtttatctggtaatcggcgctttgttgatcagtaccggtgcgacggttattgtcatgtggcggcagcgagtcatgcacagtcagttggacagccgattggcacaattaaatgctggacaatatcaggcacctatttttagtcgctcgcagcaggcagtcggcgctttgggtaagcaaccggtagccttgcttgaagagttgcggcaaaaaatgatacgcttacaacgtgagattgaacggtatagcaacacgccggttcgattttccggtgaaacaaaagaagccattttaaccggtgaacggcatcggcttgctcgtgaactgcacgactctgtctcacaacagttgtttgctgcgatgatgatgttatctgcactgcgtagtgtggctgatcgtgaccctgcgcaggctgaactgagcaaacaactggatacgatccaaaaggtgatcaatgaggcacaggcggaaatgcgcgcattgctgctgcatttgcggccgactaatcttgaaggcaaatctttgaaacaagggattattcaattgttgaaagaattgcaaaccaagattacaatcgagatcacgtggcagttggatgatattaaattgaatccagcggccgaagataatctttttagaattgttcaagaacttttaagtaacacgttacgacacgccaaggcaacgagccttgaagtttatctgaaacagctgcaggatatggtggtgttgcggatggtcgatgacggtgtcggatttgatgcgaaacaagccagcagtaatggtaattatgggcttgcaaatatcaaggaacgtgccgcggccatgggcggaactgcgaaagtggtgagcgtggtcggacagggaaccagtgttgaagtcagggtgccattatcaaaggatgttgagcatgattaaagtattgattgttgatgatcacgaaatggttcggttggggttggcaacttacataggggtccaacctgatttggaagtggttgatcaggccgaaaacggtcaagagggtgtcgatatggcacttaaagatcggcctgatattattttgatggatctcgtgatgccggtgaaagacgggatcacggcaaccaaggagattctgaaggcatggccgcaagcacgaattattattttgacgagttttattgatgatgccaaggtgtatccagccatggaggcgggggcggccagttacattctcaagacagccacagccgaggaaattgccaaggcgattcggcaaacagctaaaggtgagcgagttttggagccgcaagtcacaactaaaatgatgaatcgcatgaatcatccgcaaccacagtatgatgagttaacgaatcgtgaacgtgaggtattgcaattgatcgcgcaaggtaagtcgaatcaagaaattgcgacagaactttttatcacgctaaaaaccgttaagacgcatgtgtccaacattttggcgaaactggatgtggaggaccgaacgcaggcagctatttatgcacttaaacatggactcgtaaaaaatgatcaaggagatgatggggttgcaactcgcgatcactgatgaagcaagtcgttggtttcaccgtgaattaagtttgccagacaagggtgctggtatccgtttttttgggaaggcatatggtaagactcaggttcatgatggctttagtgttggcatgacacgtgatgattatcctgaccagccaatcatggcagtagaaaaagacggcgtcacttattttgttgatccaaccgatgcatggttctttgaaaatcttgccatgacagtggactatgatgcgcacttggatgagccgaagtatgaatttaaagaagaataagcgtgctttcggcaagctttaatgcccagcgcgtcttttatggctcggctatagtagcattaggcatgcttgaaaaagtttgtggacaagtctgaattagcgcgtttaaaaagccagtatacctgcgcttttgattgtaacggccaatcaattggctacgatcaaagacgtttggatactggcttttggattgcaatggtcggtcaaataactttggatatctcaccgtcgcgaaacaaggtgtcgcgagaagcgccgcttatcaacgacataccaacaagccgttaagcataggccagtcaccgttatcacagcaccccaccctgataatggcgggacgtaacgcatggtaatcacgtgttgcccaggttttagcggcatggccatgaaaatgcctaaactttttttgacggtgacaggtcgattgtcaactttcacgtgccaaccaggggtggttgggatcgtggtttgcagcatttggtggtcgtgcaaaatgttgattgtcgcttcaacggtggtagccgtgtgttgtatcacatgccaagatcctgtttgcagttttttaagatcgtggataacttgcttggcgtcagcttgatataagtcaaaattttcaaaccaggcgtcttttttattcaggcgaaaccgcaaaacttgttcaactttaggattacggggggtgacattgaccgtaatggtatcgttaaaactatctggcaaggtgacagtttgcccattttgattgagtgtcactaaatggtcagcaaactggctgccgagggttaacacatagattttacctggtattggcttaaatcgataagtgacatcgtggggaccgtgaccaaccttagcataagtgggtgcgctgccagttgagactcggcgcacaccggtgagttgcggtgcctctaatgctgttggcgtaaaataaggattgcccgacttgccgagggctgattgcaggattaaggactgattggcaagcggggtttcactatagagtggttgtttgagcaaatcagtatcgcctacaaagccctgactttgggcaaaaggtgatcgcaggatttgccaagtaggcgtcgttttgatcggccgataccactttagatctggtcgttgaccggcatctggtagtttttttgccgctcgtttggtttgcgtcagataatatttcatgcctagtagactgtccgtaattaatgtgccatttgtgtaggccaccgaaccatcgtcttcaggttatcctaactgaccgaagaatttggggacagccggctctaacatggagttaaattggtctgcgccgagataattggccgtcatggagtcattacgggttcgaatggtggtttttccaactcgaaacaagccgggatcatgttgccgaatggtctgtgtcccgcgaatcaaggcggcggtataatcgtggtaatcactgtgattcaaataggctagttgattaagcgtcaggattaaactgccacttaaatcaattaacacgatcgcaaaaccgaaccagactggccgacgattgtccaaactgaaccagacaaaagccagcagtagacagcctgcgccaaaaagcaagtggcccacggtcagaaagctgaagtgtttgaggttggcagcgacatcaatgtaaatagcgccgaacacaagcagcagaacgcctagccattgcaaagaaatgccaatttgtaaatgcggcaggacagcgatacccagactcaaaaaccagaagcacaatacaaatgtaaaccggtatggataccaaaccggaaactgaaagccgtgccacagtaagtcaagcggttctagcatgcacgataggattaacacaattgtcacgccagccgctgccaatttttggcgccaaggatgacttttggataggaaaaagaggacaaccagtacaaatcctaaagcaccaatgtaatagttgggataaccggatggcatttggtcaaagttaaaactgcctggcagcattttactcaaaaaccttgttggcgcatattcaaagcgccagcgtatcgtcgccacggtgtaagtgccttttgactgggacagttgaaaccaggtgggcaatagcacaaccgcactgatcatcccagctaacccgctggcgccgacaaaccgcagtccagatcgccaaaaatgctgccatgttgaggtgtgggcaatgagccagtaaatggcatacaagattaaaaacaaggcgatcatatagccggtataaaaattaatgatgagagccgcggcgagccagccaatataggccatgacgcggccgtctttgaatagtatttcaacactgtcaataatgagcggcagtagcattgcagcatccagccacatcagattaaagctattggccaacagccagccactcaaagcataggctaacccaaacgccggaatcatcatgccgtggatggcgtgacgtttagcgtaccaacccatggtgaagccgatggtgctgattttcaacaccgtgattaagaaggcagccacatccagcatatctgctggaaacaacacaactagccagttgaatgggctaagcaaatagtaagcaaagaccccgtacatgtcaccgccaagtgctttattgaaggcataaaaaagttggccaggatggccgagcaaggtttgccgcaagtaagcgaagaaatcgatatattgctgtcccagatccactgtcaacacactgcttgatccaaatggaaaggtgccacggattgcaaaataaaggccgacgagcagtcccggtaaaagaaaactgaggatcagcggataatttttcaaccaacgttgtcgcacaagtgtccaccaacttctaaaataagattaattccggcattttaggtgtcgtcttccgtatttcaagcatatcataagacacgtgtcatggcgttttgactggttctttgctacactttataagatagaaattctgaaggagcaattttaggtgaagtacattcgtacaccgcaacccaaacggaacaagagtcaaattccgtttcgcttaaatttattatttttcattgcgtttctcctgctggcagccttagttgcacagctggcttatttgcagattttaaatggcccgcggttggctgctgaagtcgatcgaaccaacaaaacagtggtcaccggcaatgtgcctcgtgggcttatttttgatagcaagggccgtgctctagtgacgaataaggcgaataatgccatcacttacactaagagtgttggggctaaatcgcagcagatgtatgacattgctaatcagcttgccaagcttattgacaagcctgaagacaatcttaccaagcgcgattatattgactactatttggcaccaacgaaagtttcaaaacagattgtttccaaactgccaaagaaaattcaagatctgccgacagacaaagctgacgaattgtacaagtatgaggtcgcttacgtgcgtcaacacatgccaacctttacggcgactcaaaaagaagcagccggcctttacaaaattatgaatggcgccactcagctatcgactgtctaccttaagaatcaggacgtgacggcacatgaagtcgcggttgtcggtgagcgcttgacgcagatgcctggggtgaaccttgggactgactgggagcgatcttatccgaacggtgactctatgacgtcaatcattggacaagtttccaacgaaaagtcagggttgccagctgaccaactacaggcatatttggcaaatggctatgctcggaatgaccgggtcggcaccagttaccttgaaaaggcatatgaaaatgttctgaagggttccaagagtcaaacgcaggttgaaatcgggaataacaaccagattattcaatctgtttccaagttcaaggggcaacaaggcgccaatttgaatctgacgatcgattcggattatcagaagaaagtcgaaaagtctttgagtgacaccttcagttcgattcgatctgctggtgcgggcagcttgtcagacggtgcttacgcggttgcgatggatccaaatacgggtcgtatcctcgccatggcgggtcagcatcaggatgttcagacacataaggttgaagatgatgcacttggcgttatcaaccgcgcatttgttgttgggtcagcggttaagggtgccacggtgctaggcgccttgcaagacggcgtgattaccgtcaattctaatactcaagctgatacaccgatttacttgcctggtacaccagtcaagaaatctgtttacccggtcggtaccttcagttcattggatgcagcctctgcgctggaagtttccagtaacatttacatgatgtggctggccatgaaagaaggccactatgcatactcgccaaataattatctgaaattgaattcggatatttttagcaaaatgcgcggctactttaaccaattcggattaggtctcaaaaccgggattgacttgcccggtgagattgcagggttagaaggcaatacgcatgattcatcaggcaatttgcttgtcggttcggcgttggatttgtcttacgggaactatgataactacacacttattcagatgctgcagtatatcagcgccattgccaacaacggttatcggatgaaaccattcttagtgaacagtattagccaaacactgagcgatggcagtagcggtccggtgttaacctcaactcagccttccgttacttcaaaaatcgtcaatacgcaagatcagattaacctagttaagcaaggaatgtggcaggttgtgcatggcacaaacggttggactacagcgacttcgctgaataccttgaatccgggcgttgccgggaaaactgggactgctcaagggtttgctcgtgagtccaaagattcagcgctcactgaaaccatcacggaaagtttcgttgggtatgcaccagcgaaggatccaaagattgcgattgcagtgattatcccgaatctgaaggctgaaaccaccacgccttatcaactgcagattgccaaagaaatgtttactgacttctatcagatgaacaacatcaaagaagataaggattattcgattcatcagaagacagttaacggctgatcgtgttggcagcgtgtgcaaaaaatgctaaactactacaagaacatggccgccaagtgtttggccaacgcttctgacggtgcgaaaaacaacaggcgggcctgttgtttttttagcggattggtgcggcaggctcggcatacggcaagcagttcctgtctgcttggcagatgggttagaaaggaaactatgaattattcaaactggcgctctcggctgcaaaattcagcttatgtgaccaatgctattttagcggttaccattttggtcttccttttggagactttctctggtggcagtaccaataatagcgtgttggttttctacggcgcgcggctgaatcctttgattttgtatggtcagtggtggcgattgatgacaccagtatttgtccacatcggcttaatgcacattctggttaacggtttctcattgtattatttgggacaaatgacggaacaactatttggccattggcgattctttctgttgtactttatttcgggttttgccggtaatgtcgcgagttttgcctttagtcctaacacacttgcggcaggtgccagcacagcaattttcggtttgctcggtgcctgcttaatgctcggcgacagcttcaaagaaaatccagtgattcgtcagttggcgcgccaattcttactgttggttggcttgaacttactgtttaatctgttttccagcggcattgatatttttggtcacattggcggtttgcttggtggctttcttgcagcaggcatgttgggtgctccggcacttggtcgcatggggacaccgcggcggattgcttcagctgtcaccctgctcttcggactgggcgcgttgcttttcttaggatttaacgcaggctagtatgaaaacttactatgatgttctgcaattattaaaggggtttggtacgttcattcatgttggcaagcgtgagtgggatatcgaactggctgcacttgaattagatcggctgcacaaagcgcagctcattgatgacaaggtttatctgaatgcaaaagtcgtgctgcggcatgcacacgcgcaagaagaggcacatcctttaaatcatgagttgccactgcccgccgaaaaacggaggaatgacaaagatgaatgacaaaaaattaattggtgtcgatctgggcggcacaacggttaaattcgcgatcttaaccactgatggtgagattcaacagcgctggagcatcgatactaatattttggatgaaggcagtcacatcttgccggatatcattgattcgatcaacgaacatctcaaactctacaacatgacaccgaatgattttgtcggtatcggtatgggctcacctggttccgttgatattgaagcaggcacggtaattggcgcttacaacttgaattggaaaacattgcagcaggctaagaaggatattgaggctggtactgggattccctttagtattgataacgacgccaatgttgctgccttgggcgaacgttggaaaggcgctggcgaaaatgacgccaatgtaactttcgtaacgcttggcacaggcgttggcggcggcattattgccgatggtaacttattgcatggtgttgcaggctcagcaggcgaacttggacatgtgactgttgatccggtgaatggttatctctgtacttgtggcaaacgcggctgtctcgaaactgtagccagtgcgactggcgttgttcgggtggcccgggatatggctgaagaattcgctggcgactccaaactgaagcagacgttagatgatggcgatgagatttctagcaaaattgtttttgatcttgccaaaaccggcgacaaacttgcgttgatgattgttgaccgggttagctactttcttggcttggcattggcaaatgtcggcaatctgctgaatccgaaattcatcgtcattggtggcggcgtttcagcagcaggcgactttttgctgaagcgagttgacaagtatttcaaggaaaatacgttcccgaatgttcgggaaacaacaagtctgcgtctggcaacgctaggtaacactgctggcgttatcggagctgccagccttgcacttaagtaagcggaagaaggagtcatacacgtgttaacttatctgttaatttttgttggattatttctgatttattggggtttcaactggttgtggagttactatcaaaaatcacggtttaaggctatcggcggcgagatcacgccggatgactttgaacataccatgcgtaaagcacagattattgacttacgcgagcgtaacgaattcaaagcgggccatattctcggtgcccgcgatattccttatacgcagttgcgtgaacggatgggtgaaatgcgtcaagatctgccggtttatctctatgacaaaactggcgtgctctccttgcgtgctgctcggcgtttacgcaagaacggtttcgaaaaaatcagttggctaaaaggcggctatgataactggtcaggcaaaacaaaaaagagcccgactaactattagccgctacataagcgcaagaaaaaagcaatcgaacttgtcgattgcttttttgctgatagcggcgctcattatgaacataccgctattaacagctggtgttgcttaaccttgatgagctgagaaacgcttacgggtagctttacgccggttatcgttaatttcatcgaccttagtttccacaggttcgatatagtttttcttaaaggcaaaaacgctaccggcaattgcgccaagggtcattagcgtgccaacaaaaaagccacgagcaaatttatgtttcatgaaaatccccccctgattaatgatctatgatactatttttattatactatactatcggagcttaatgaaatggataaaccacccaaacggattgtcatgattgtcggaccgacagctgttggaaaaagtgacctcggcgtttatttagcccagcagctacacggtgaagtgattaacggcgacgcctatcagatttatcgccacatggacattggaacggcgaaaatcacgccaaaagagatgcaaggggtgccacaccatttattggatatcgctgaccctaccgtcgcatactcggtcgccaagtttaaaaaggcagcgacggcaatgattgatacggtggctgatcggcaacaattaccgattctggtaggcggtaccggtttttatcttaatagtttgcgcttaaatctgcctttaggcgggaaggcgccgcccacagctattcggcagcgctggcaggtggcgctagcaacaaacggtcaatcatggttgtggcagcaattggcacagcgcgacccagatgctgcgcaacaaattgcgccggccaatacgcggcgggtgattcgtgccttagaagtcggtgaattaaccggacggcgcttttctgaccagccacaaccagagccgttgttctcgaccttggtcattggcttaaccacggaccgagccgttttgtatgatcgaattaatgcacgggtggatgcgatgatgcaggcagggttacttgctgaagttgagcagctattaaaaactgtgtcagcagatgcacaggccatgcaggctatcggctacaaagagctagtgccatatcttcacggtcaggctgaattggcgaattgtgttgcactgattaagcaacattcccggcattttgctaaacggcagctgacctattttcgcaatcagatgccgacccattggtttgatctggtcgcgcatccggaagacaaaaatgccattgttacgttggtgcaacattggcttaaacaacgttaacgcgaatacagtcgtatcaatttggatatgagggccgtcaaccagattggctaggttcggcttcgaacaaatctggttgacgcccatctatgcaccgatttctaaacgcgcctcttcgcgctcatttaaaggagaaaagtatcatgagttggatggataagtttgatccaaaattacagacaatggttaaagaagttgacgcacagatcgcgccagaactggcaaaaattgatgcgcgtatcttggagaatcagaataaggttttaacaagttttcaaaaccatcatgtggcagaaagttatctaaccggatcaaccggttatggtcataatgatgaaggccgcgatgtcttggaggccatctacgccgatgttttgggcggcgaagatgcactggtgcggccgcaatttgtttctggtacgcatgcaattggcgttgccttattagggttggttcggccaggtgacgatattgtgtacatcaccggtaagccgtacgataccctgcaggaagtactaggcttagctggcaacgggattggcgcgccgcaagaatatggcattggtgttgattatgttgacctgctgccaaacggggcggtagacgatgatgctgtcaaagcgcggttgaacgataagaccaaagtggttgccattcagcgatctcgcggttatgcaacccgcgattctttcaccgtcgatcaaatcgccgcgatgatcaaggttgttcgcagtgttttgccgaatgtctggatctttgtcgataatgcctatggcgagttctcggaaaccaaggaaccattggaagtcggtgctgatgtcatggccggctcgttgtttaaaaacgcaggcggtggcatggccaaaactggcggttatattgtcggtaaaaaggatctgattgaccgcatcagttatcggttcacggtaccgggtcttggcggggctgaaggggccacagtcggtgcgttggctgacatgtatcaaggcttcttcatttcgccgcaaaccacagggaatgccattaaaggcgccattttcgaagcagccttgtttgctaaactggggctggacgtctcacctgcttgggatgcaccgcgaaccgatttgattcaaacagtcaacttcggcaatgccgatgacatggtgaaatttgctaaggctgttcaagcaaactcgccagttgacagctttgtgacgccgattccggaaaaaatggccggttatgaggatcaagtcattatggcaggcggcacattcgttgctggctcaacgattgaattttccggtgatggcccgttgcgcccgccatatacgttatacctgcaaggcgggttaacctatgcgcatattaaattggcgaccatgggagccgcgcagtccactttctttgataactagaataggctaagcaaaaaaacgcgatcaagctaattgatcgcgttttttgacggctatgaaagttgttcatgaacaacatgaacatatggctgaccacctgcacgagcgataacgccttggatttctggggtaaagccggggaagtgccgtataccttcaaaaagtgtttgaaagtaactgatcgcttccggtcgccagcgttcgccagggacaaccacaaagattccgggcggatagggcagcgcgccgtcgactgcgatacgggccgtggcttgctccagagggatggtgtcaatttgaccgcgaacaaaataacgatcggcggcttgcggggtcatggcagtggggatggcgttggtgttggtaaacaagtcacgttgttgctcagctaggtgcgcttctcggaaaaagtccgacatggtctgacctagctcgcgtaatgtttgatgtgcatacgcctcgtcagtttcagcgactaattttggcaaactttcagcaacggttttatttgcaaaataatcggcttcaaactgggctaacacttggcgcaatcgttgccagtctgttcgagcggttcctggcgtcactaaaaaaagcaggctatttaggtcggctttttccggaataatgccgtggtcaagtaaataacgatcgactaaccaaccgctgatgccaaatgcggctgtgtcaggtaatagcacggtcactttacctggatcaagaaatgcttgatcaggttgaaggcctgcgagttgatgccatgcagcttgtggcgtcatggaccaagcctcagcagtctgaatggcctgatcagcaggcaaagttgtcaactcaggcggttcgtaagcagaaaagagtcgcgaatcgttgagcgaatggcgaaagacgagtgctgctcgaatggcatcttgccagattttttgtccgcgagcgccttgattaatggcagtgttggcgactaatgacgcgtaaagcggataattgtagctggtcgtaacatgttttaagtacgcgtggttgaactgttcgtgaccgacatatcgcgcttgtcccttaatatgggcatcttttttatgaatctgtgatgcctggccaaacccggattgctgtttgtggacactttgggtgacgatgataccagggtcagtcggcccaagcggtaactgcaggggatccatgggcgtcattgctggaataaacggctcataaccaccccaagcagcatcgaaagcaatgtagtcggttaaaggcccaaaaagatcgattaactgacggacatttggcacaatgccatcaaaggtttctagttcaagaattgtcagtcgaaatggccgcgattgatgtgccttttcgggagccaccgctactgccatttgtcgcaaactttcatgggttagattctgtaaatcgatcggaccaatcaaaccacgtttcgttcgaagtgtatccaaataaaccgggcgggcatcattttgaatgagtgccgcgttataaaaagatttgtggttattccgatcgaataaaaccaaatcgcctggcgtgagcaatgcactggccacaatgttattcgatccagtcgtgccgttggtcacaaaataagtttcatcggcatgatataactgcgcggtcgcttcttcggcagctagcggggtgcccccatgtgttaacatatcgcccaaagaagtgacgacatcgctggtatcgctagcgaagaaagatgggccgtaagcctgatgaagtaagtaacctgctggtgctaagtcgtcgtagtgaccgctgtggtggccaggagtcgcaaagctggttgggtccgccttcgcatagtccagtaagtcgcgaatgaatgctggtaccatggtttgctcataagcttgtgcagcagcagtaatctgagccattgttgcggtattaagtgtatcgatgttggtgactgtcagctgaccagtgtgactgattggtatctggccgatgataaaagttggtaagggtaattggctggccacaagctgagtgagcgttgcagtgtcagaggcatcgatgattgctgcgccaaaggcagctaacggtgccgcagttaaacaacgccaattggtgggcagtatccttgctgctactttttctgagtagccgatatataagtgcatgcctgcgagttcctttcaaaatagattcagttgattttaacataatgttaaacggaaaatttttagagtgacttcaaagactgtgtcttcgatgccttctattcgtgccaacagtctgagccggcagtgtgatgatgtgattggtggtgggatgatagcgacatatcggttggaaacggttgcgcttaccagagatgatgaccgtttttttatttattggtctatggcatcttcattttgaaaacaaaaaaagggtatctttttatttgaatgtcagaaaagcttacatctgccgttgacacgccttatatggtttgataacctgacattgttgtaaaggaggatgcctatggctgagatcgctgatctgagaacgcgatcggttctgccgattggtacagtcatgttattgactgatttaaccgcgcgccagattcgttattatgaagcgcaagggttggttcaacctgcacgaaacgctggtaatcatcggacatactcgctgaataatgttaatgaattgcttgagattcgcagtcaaatggcagacggtttcacgcttgccgacgtaaagcgactcaagcatccccgacatcatgaagacagcgatgccgaagtgcggcaagtactgcgagacgagttgttaaaccagagtcgactgaaccagagtcccgatcccggtccagccataggcttccgccaatcacactaaagataggagttcacgtatatggcaagaaaaacaattaccgctgatgagattcgtcagactgttaaggatgaaaatgttttgttcctgcgcctgatgttcactgacattaacggaatcgttaagaacgttgaggtcccaatttctcagttggagaaggtcctcaataacaagatcacctttgatggctcctcgattgatggctttgtccggatcgaagaaagtgatatgctactgtttccggatctcgacacatggttattgttcccttgggaaaacgatcacggtaagattgcgcgtttgatctgctccgttcatcgtcctgatggcagtccttttgctggtgatccacggaataacttgattcgggtcgtgaacgaaatgaaggaggctggttttacttcatttaatattggaccagaaccagaattcttcctgtttaagatggatgaaaatggcaatccgacgactcagttgaacgacaagggctcctactttgattttgcaccattagatttaggcgaaaactgtcggcgtgatatcgtccttgaactcgaaaaaatgggctttgaagtcgaagcttctcaccatgaagttgcgccaggccagcatgaaattgacttcaagtatgctgatgccttagaagctgctgacaacattcaaacctttaaacttgtggttaaaacgattgcccgcaagcatgggctttatgcaaccttcatgccaaaaccactccacggtattaacggtagtgggatgcatatcaacatgagtcttttccatgacaagggcaatgctttcttcgatgccaatacggatgaccagttgagcgaaactgccatgcattttctcgccggggttctgcgtcacgcttatgctttaaccgctattaataacccaactgtgaactcctacaagcgtttggttcctggttttgaagcgccagtttatgttgcttggtcaggcaagaaccggtcaccgttgattcgtgtgccacaatctcgtggattgtccacgcgactggaactgcggtcagttgatccaaccgctaatccatacttagccatcgccgggattctccaagccggtttagatggtgtgactaagaaattgaagccggaagaagccgttgatcgcaacatttatcggatgcaagacgatgaacggaaagcaaatcatattcaagacctcccatcaactttgcacaatgctttgaaggcattagcggctgatgatgtggtcaaggctgccctgggtaaacatttgtatcaaagtttcatggactcaaagaacctcgaatggtccgcttatcgtcagcaggtttctgaatgggaacggcaacaatatctggagctttactaaaaccagacaacccaaaagctgttgctgtcaccgttgaagcaagttgattgaacagttaagtaagaaaaaaggagatgtcaggccgactcggcgcttgatatctccttttttgatgcatcatgcatgaaaaaactggtgagaatcctattaagttaaatgcggtaagggagggtgatgctgctattagccaaatcaatttgataatgagttgttttgatcgggcgaatggtttgggccatatctgccccatgaatgaccaaagcgagttgacgaccagctggcagatgatagtgggtgggttggagatccaaactgatatggaacggttggccgggcgtaatcctttgcacttcgtaagcattttttggattttgcaggttgatatggccaagcgagatcaacttgcttggtgtcggtttagccgttggtttgaattcgagaatgtctgttgttttataatcaaaaccaagttgaagaccgtttaaggctaccgttgccgcggttgcaccgaatcgcctagccattcctaaatcaatgaggcgaacactgagaatacctgttggggcatcaatggccagcgtcagctctaagtgcggaatgccttccagtgtttggtcgcgctcaagtggcggctgcgtgagccacaagcggctattggcataagcactgttaggggtgatgatggcagtctcgaaactggcactggtatcatgctgggcattaaaagttgctgttgcgtgatcggtaaattgatccgtggccgcctcgaaatccgtttttagattgcgagtgttggtcacatgctctgctgctgggctggcaaaattctgataggccgaccaagtctgaacagcaacattatcttgcacaacaacatttggtaatacatcttcggcgccattcgcctcactaagcaattcatgtgtgagccacaaattcatcatatctagaaaatctaatgagcgaacattgtggacgtaaacgtgctggccttgatgcaaaaccagtttcttttgaattggcaggtctgcgatggcctcccaaaacttgatggcgtttgtaggttttacgttccaatcattaagaccatggatcaacaccacatctgccttgaccttgttagcgtttttccggtagttgcgcgcatcccaccatgtgttgtaagcgccagttgttcgatcctgatcgtgagtgatcgtagcaagatgcttttcccaagcttgtttgatgttgatcaggtcgccgccggacttttgccgggagaaggtatccacagccagaacatcagcatcttcaccttggaaaccaccaggggccactacgagaccattttcacggtagtagtcataccagctggaaatgccagcgtcggcaataattgtcttgagaccgtcaaccccagttgtggccgccgccatggctaaggtagccaggtaggatttgccggtcatagcgacaagaccggttgaccaccaagctttgatggtaataccatctgtccggttcgtaaaagcgcggcgtttaccggttaaccactcgatgacagcaacagcaccatcggtttcttctgggccaccggttgtccggaagccgtcggaatagcgagtgccaacacctgccgaataaaccacagcaaagccacgggcgagaaaataatcgttaaaggcatacatactgttttcttcggcataagcctcggcctgtgtcgcctcgccattaactggatgatgaggcaagttggcaggctcttcaggatttgccgtaacttcagctttcgaggctccgtgtgttttaacagctaaggtcgtttccggcacgtgcgtcactgcagtcacatcgttggttccatgaaaataaggatttgcagtaaataacacgggcactttaagcccttgatctgtggctttcgggcggtaaatagtcgcttcgagcaagtcgcgttggccatcgtgatcggtatccatatccgattcgatccaaacaacttcacgaaccgcctgccgcgcatcaaaaacttgttggactttgccgttaaaaagaaggtgggtcggttttttctgttttttctggaagtcctttaaaaaaccgcgattagctagatcatccaaataactaaccaaatgcttggttcgcgtatttaacaatagataaacagccttgagcaaatcagcggtgctcgttagatcgtgatcgaggcttggtaacttggttgcagtcatcattttaaatggatcattcaggtcaaagtcagtgaaagcttcgaagccaagtagttgtagcgccacattataaaagtcacggcgcgtcattttggatggttttttcgccaaccatgctgctagtgtttggtccatgttgactgctacttgggcgagcttatcttcctttgcggctaaagtataagtctctggaaaaaaggcattgaaaaggtcggtcgcactttgactaaaagcgtcatcaggatcggcttgcaggccaatctgcttaagctccgctacttgcaccttgaagtcaggtgtcaaacgggcaaattgatttaatttcatcagcattgtcttcctttatgagaaaattgtgataaattcagtgtagcggtctcattgactgctttcaactatatccgtctaacttgcgtatcggatgatcttcctcatagaacccgttgacggcctgtcgcgcttctcgtatacttaataacgatttgtaccagtagctcagttggatagagcaacggtcttctaaaccgtttgtcccgggttcgaatcccggctggtacataaaacttacaaatgccatgaagcattgctgtgacgacggactaccagtgactaagcaggagaacaatgcatcaggctttttttattcctacgagtcgttagtttgaactgttgacatgagtcacgacaatgaaggtgtttattgatggaaatgggtccaatttcagagtgggttgcgggtatatctgaatttcttgccgtttgtgttgccttattatcacaagcgtaaaaaagaacagagaaaagtccgaaatttgaaaacggtcattaaaaagttaggcgcagaggtaatcgcaggcgatcaggatgccatcaaagccttaaacatctacttaattgtttcttttttgagtgatacaaatgctgatattgaagcgttagtcactcaaggccgcgaattgcttgatcaaatcaaaaagttaccggccaagaccgatggcacgtacgaggaggccatgaccaaggctaaattgcttttaaaccagattagttaaagccggtttgagcgttgctatcttgatttatcccgtcaaaagcaagtcagttagcaatcgttgtgttttttaatacttgacatactaacaaaaagtgagtagtataaccttcatcgctacctgagaccattcaaactattttttaaagaatggagggattacgatgtcatatcgaatccaactcaacatgaagacgcaagaatttatcgctattgactcaagcaatgctaaacacattggaaaaggcaacacgatcgaaaaagcgttacaacaattgaagaagtaactgaaggctgctgaactgaacaatcagcggctttttttgtgccgtcgtttcaaaggcttacgagtcaaaatacttggaagcttttccgagaacaaaccatttcttttcagcaatggtgttttaagtgatagctaaaggggcttttggcaacaatgcggcctccaaaattcaaaagttcagtaaaataattgcgcgcatctatggtatattaaaggtccttggcaggggcaggctcggagatcttttctgagcctttttcttttgccgttctgctcaattaaacgatttcttgttgaaagaagatggctcgtatataattcttcggggaggtgacagcttatcattatattacttaaccttttaattcttctcgtgaccggtgctttgctgatcgttgtgaccacacaattggctcaaccggtcaattggattgtggatgctattctagtcattagtttactgttaattaatgccgcacttggtggttggatgaccatctttacgatgatatacatcctttacatgctggcagtcattgctggtgtctggctttttcgaaaaaggcacagttgatggtttctagattaaaacgtgattactgaaggcggtgccgtggctttcaacttttggttgaaacgcgttcgctagcccagaaacatccatatgagagtcttgaaggtggcatgtttaaaaagcagcacggcttgtgacataccggtttctaaacgcaccaatctacgcgcttgttgtttgtcttgcaacttgacgtcgtctctggtaatattagtccgttgtatttggcacccctcctatgcaaccgcacaatgttgggtttttaagcgtaagcacccaacttggcgagtcttcaggggaaaagccgaaaggcaaaacaggaggtgcacacagtgtacgcaattatcaaaaccggcggcaagcaatacaaggcagaggttggcgaagccatctatgtcgaaaaactcgacgctgacgaaggcaaacaagttacttttgatgaagtcatcatggttgcaggcgaaggtgacgccaagattggcacaccaaccgtcaaaggcgcgaccgtaactggcaaggtcgaaaaacaagggcgcgagaaaaaggttgttacttacaagtacaagcctaagaagcactctcatcaaaagaagggtcaccgtcaaccatacacgaaggtcgttattgacgcgatcaacgcttaagaggtcagcatagttatgatcaaggcaatttttcatcgagatgaacatggtgatatcgtcagcttctcgttgacgggtcatgccgatgccggtaaaaccggtaaggatattgtatgtgccgctgtttctgcggtgagcattggtgccgttaacggcattgaaggcttagcagggtttgaacctgatgtcattgcggatgaagtccatggtggacatctccagatggcaattaaaaccgccattaccggcgaacagctacacatcagtcagattctgttggaaaatttattgctcgaattacagagcatccaagaccaatatcctgatcgtttgacgattactactaaacaacttgaacaaaattaatcctcggaggtgtacgttatgttaaagatgaatctgcaattcttctctcaccataaaggtggcggctcaacatccaacggtcgtaattctgctggccggcgtttgggcagcaagcgtgccgatggccaattcgttaaggcaggcaatatcttgtatcgtcagcgcggtaccaagattcaccctggcgaaaacgttggtcgcggcggcgatgataccttgttcgcgactgctgacggcgttgtaaaatttgaacgcttcggccgtgacaagaagaaggtttcagtttatccggcagcagctgctgaataaagactagacgtcccggtaacggggcgtctttttttcagagaaaacaaagcatgagtcagtaaaggagcgatttggatggatcgaatgacagcattgcaggcgcgaattcaggataaaaaactggatggcttttttgttaccgatacgaagaacgtgacttatttgaccggctttacaggtgaagaaagcaccttgcttgtaaccccgcaaaaggcttattttgtgactgattcgcgatttaccgaacagtttaagcagcaagtacataatgccgaaatgattttgcatcaggacagcatgtttaaggccgttggcaagctggccaatcgcttacaattgactagaatcggttttgaagcagttcacttaaattatgccaattatgaagcatttgatttgctcacacaaggaactttagtaccaacccgtgactttgtcgaaacgcaacgcgagatcaaggatgccaatgaattggcgttaatcacacaagctatcgttattgccgaaaagggctatcaacatgtcattgctacgatcaaaccaggcatgcgtgaaattgatgtcgccaatgacttagatttcttcatgcgcggacttggcgccagcaatgtttcttttgaaacgattgtcgcttccgggacgcgctcagcgatgccccatggtgcggcaacagagaagaaaattgaaaaaggcgatattgtcacacttgactgggggtgtatctaccacggttacatgtctgatttaacccgcacgtttgcggtgggcgaaccagatcctaggttgaagaccatttatcaaattgtctatcaaacgaatcaaaaagtgcaaaaagctttaaaaccaggtgttcttggccgagtcatcaatgacttagctcacaacacaatcaatgatgctggttatgggaagtactttggccacggaacaggccatggcatcggtttgtcaattcatgaaggacccggcgcttggggaccgtatctagacgtgccggctgctaagggcaatgttgtcacggatgagcccggtatttatgtaccggatcttggcggcgttcggattgaggacgatttattagtgactgctgcgggtagtcaaagcttgagtcaaccagcacctagtgagttgttggtgctgtaagttacgtgccagaagctgtcttgtgagtcaaatcggttagcttattgatttttggctaaaacgcgttcgcaggcgcagaaacttgcacataagggcttgaagcctaattgaccaaaacccgaccatttaggcttcaggccgcttatgctccggtttctaaccgcacctgctcacgctctgattgaaacgcgttcgtcagcccagaaacctgcatgtaaggaccctgagcgcaatgatcaaggcccggtcatcacgctcagggccgcttacgtctggattaccattggcaagctcgctaatttttgctgaaacgcgttcgcaggtgcagaaacctacacataaggacctgaagcctaaatggccaaaacccgaccatttaggcttcaggccgcttatgctccggtttctaaacgcgcctgctcacgctctgctgttgcaagcattcgcagtgcttgctagaataggtttagtttacgactgaatgtatggaggaagttcatgatatctgttaatgattttaaaaatggtttgacgattgaggtcgacggtgacctttggcgaattgtcgagtttcagcatgttaagccaggcaagggttctgctttcgtgcgttcaacccttaagaacctgcgtacaggtgccgttcaagaaaaaacgttccgctcaactgaaaaagttgaaaaggcgcaaattgacagcaagaacatgcaatacttgtatgccgatggggacaattatgtcttcatggataccgatacttatgaccaattgacgcttcccggcgacgagatccgcgatcaattgaattatttgaaagaaaatatgaatgtcaaaattatcatgcatggtaatgaaacgcttggaattgagttgccaaagactgttgatttagtggttaaagaaaccgaacctggcattcgtggcaacacaagtagcggtggttctaaaccagcaacgatggaaacagggttggtcgtgcaggtaccgtttttcatcaatgttgacgatgttttaacgatcaatactgatgatggcacctacatttcacgcgccaacaaatagggcttaggaggttctcacgatggctgaagaaacaaatatcatattagcgaatcgcaccgatgcacaggggactattgagattgttcctgaagttttggaagtcatcttgggcatcgcggctagtcaagtagatggtgtttatcaaatgcgcggctcactgggtgcttcaattaacgcctggttcggccgggctaatcatggcaaaggcgtcagtgtgacggtgacggatgatcagattgccgctgacgtttatgtgtatctagactatggcgtctcggttcctaaagtggcactgacgatgcaggaacggttacgggaacagcttttgttcatgacagatttgacgctcagcgaggttaatgtccacgttgttggcatcattccagaaaaagctgaaaaagttgaccctgataatctgttcaacgacgatgataccgacactgacgatgcagaaagcgctagcggcaaggatgacgaataagatggaatcacgacatgcgatccgtgaggctgcttttcaggcgctgtttgccttggcaaccaatccggaagctgataaagatgcggtgtatgccgaagttttacctcaagataccgaggtgccggcttatttaaccacgctggttgagggtgttttgagtaaacaggctgatttggatgctgccttgacgccgcaattaaaaaaaggctggacccttagtcgcttgacgaagccagatttaatcatcctgcgattaggtctatacgaaattcgttatgaagaagcgatgccggaagctgcggcgattaatgaagccatcaatttggcaaagcgttacagcgatgatcaatcagccaagtttgtgaatggcattttggcgaacttcattcaagcaacgccgcaagcataagtcaaccggtcaaaggcatttgctttgaccggttttgatttatcttgctttggtcgtactatgttcgcatattgataagtgacgattgcgcgcaacaagcgccgataaaatgaggagtgaagctcttggcaacccgactagatggcagagcagtttcaaagaaaatactggcagaccttaagcaaaccattgctgaattggcacaacacgatgtgacgccgacattggcagttgttttggtgggatcaaatccggccagtgaggtttatgtacgtaataaacagcgccgtgcagaagatattggcgtgcgttctttaatgtttcggatgcctgaagcgacaacgcaggcggacttgctagcgaaggttgccgagttgaatcatgatccggatattgatgctattttggttcagttgccgttaccagcaggacttgatgaacaggcggttattgatgctatcgatcctgataaagatgttgacgggtttagtccggttagtgtagggcggttatgggccaatgaaccaactgttgtggcgtccacgccttatggcatcatggcgttgttggaagcttatgatattgatgttgcgggcaaacgggttgtgatcattggccgttcaaacattgtcggtcggccgctggctggtttaatggtcaatcacgatgccaccgtcacaattgcgcatagtaaaacccgtgatcttaaacagctggcaaaagaagctgatattttggtggttgctgttggagtgccgcattttgttggtgccgatgcggtgaaaccaggtgcagtggtcattgacgttggtatttcgcgtggagctgacggtaagctgcttggggatgttgacgaagctgcggtggcgccgattgccagcgccatcacgccagtaccaggtggtgtgggaccaatgacaattgcttcgctcatggcccagacagtgaccttggctaagaggcgggcaaatggttgatgccagtcaatatttaagcgtcacggcactcactcaatatctcaaacgcaaatttgatgcggacccttaccttgccaaagtctatctgacgggtgaaatttccaattatcgcaaacgtgtaggtaatcagtatttctcactcaaagacgatcacgcgaaaatcggtgcgctgatgtttcgtaatgccttcagcaaggttcaatttgaccttgaggaaggtatgaaagtcctagttgttgggcgggtcagtttatatgaacccagcggcgaatatcgtttaattgtcgaacatctcgaaccagatggtgtgggtgcgctttatcaagcttttgagcaactgaagaaaaagttggcggctgaagggctatttgaccgcaaccaacgaccactgccactctttcccaaacgggtggcagttgtgaccagcccaagtggtgccgtcattcaagatatcatgacgacggtcgcacgccgctatccgattttgcaattaacgctgttcccggcagttgtccaaggcgatcaagccgccgattcactggtgaaacgattaaaccagattaaaacaataggtggattcgatgctgtgatcatcggccgcggtggtggttcaattgaagatctttggccttttaacgaggaaaaagttgcgcgggcattggtcgacatgccgatgccggttgtcagctcagtggggcatgaaaccgatacaaccattaccgattttattgccgatcgacgggcggcaacgccaactgctgcggcggaaattgtaacgcccgtgacattgattgatgcgcttaatcgaatttctgaagatcaggtgcgactggtcaatgccatgcataatcggctcaaaaatgccgcaattcgagtgcagcgttctgcacaaagtgttgtgttgacgcaaccggatcgactttatgatcaatacgttcagcgagtcgatcaatttcaacaacggctacaacagagtatgcataatcgcctgcgcgaggctgatcatcgtttggcaatggcaacttcccaattggatggccggcaactgtttatccgattggttaatttgcagcggcaagtgactggggatcgtcatcgcttggatcaagcgatgcgcggtttggtgaaaactaagcgtcaggcatttgctagtgccgtgagtggccttgatcacctaagtccgttaaaaatcttgggccgcggatttgcttacgtgaccgatgaacaaggtcagatgctgaaaagtctaagtgactacgagctagatcaagatattcatattcacgtggctgatggacaagtcggcgcacacgtcaccacaaaggagaaaacacatggctgaacctacttttgaagagaaacttgcacaattggaaaacatcgtgaatcagcttgagcaaggcgatgtaccgctggaaaaggcattggatcaatttaaagccggtgttaaattgagtcaggaccttgagaaaacattaaaaactgcagaaaaaaccgttaccgaaatggtcagtgacgatgggacgacgcaaccattttcgccaaaggatgatcagcaatgagccctatgttagcaggatggcgcacagccgttgaacagacgttggacgagcaattagctgctgttgctaacccgcatttgcgagcggcaatggtttattccgtagaggcaggtggcaagcgcctgcgaccattgttgttgttgagtgtcgtggcgatgtatgacggtgtgattgctgatgcactgccggctgctgctgctttggaatatgtgcatacttattcattgattcacgatgatctgccggcaatggacgacgatgatctgcgtcgtgggaagccgaccaatcataagcagtttggcgaagccttagcgattttggctggcgatgccttgctgaccgatgcgtttgctattttaagccgccagtaccctgaaaaaggcgccgcatgtgtgcagattctggccgaagccgctggcagcaatggtatggttggtggccaggtgctcgatatggacggtgaaaacgagcaataccatctcgaaactttgaaacgcatgcatgaagctaagactggcgccttgatccaagctgcaatcgcgatgggcgggctgtttgtgaccattccggagactgaccaaacagcactggctgatttttcggccgcttttggcttaggatttcaaattaaagatgatattaacgatgtgaccaaaacaacggctgaacttggaaaaacggctgataaagatgtcattgagcataagaacacttttcccgagttattggggttggacggtgctatccaagctttgcaggtagaaattgcaaaagcagagacggcgttaaatgaattgacagttgacgcggcgccattggctgagattttggcggtgttgaaagcatgacaaaaatcaaaaaagaacgcgttgatgttttgctagttgaacaaggtttatttgaatctcgtgagcaagcaaagcgatcagtgatggctggcgaagtctatgatcagaacaatcagcgactcgacaaaccaggcgtaaaaattgctggcgatgctattttgcatgtgaaaggcaaaaaaatgccttatgtcagtcgcggtgggttgaagttagcgaaagccttgaaagtcttcaatattgacttgaaggacaaaaccgttttggatatcggggcctcgaccggcggcttcacagacgttgccttacaaaacggcgccaagatgagttatgcattagacgttggctataatcaattggcgtggaaactgcgtgaagatcctcgggtcaaagtaatggagcgggttaactttcggtatagtaagccggaagacttcactgatggtccagttgagtttgccatgacagatgtcagctttatttcattaaagcttattttgccgccgttaaaagcaattctgattcccggtggtcatgcggttgccctcattaagccgcaatttgaggcagggcctgctaatgttggcaaacacgggattgttcgcgatccgcaggtccaccgagacgtgctgaaaatgatcgttgatttcgcacttgaggctggatacgatgtcttgggattggattacagtccgatcaaaggcggcgaaggtaatattgaatttttaattcatctgcaaaatagtgcacaaacgcctgggaaaatggcgcctgatgtcgatattgaagaaactttgactgccgcttatggtgatttacatcggccataatgaatatttatgcaaaaacttggtatctgtctagttcgtgcgctatgctattggtaaagcttttgtttgactagttttgatcgaacaaagccatctatgacagaggtgagcacatgcgcaagcgcgaacgacaggcaaccattcaacgattgattcaagatgaaccaatcgaacgtcaggaagacttggttgcgcgattgaatgagctgcatattccggtcacgcaagcaaccatttcgcgtgatattaaggacatgcagttgatcaaagtgcctgctggtgaaggccattatcgttacagtatgccggcagaaaaacaattgccagccactgataaattgcggcgaacgctcatcaccgcgatgaagtggggtgaggccatggataattttattcatttggccttattgcctgggacagcggcagcagttgagactttaattgaacaactggatgatcagcgtatttttgcgaccatcagcggggatgcgtctattttgatcatctgccggtctgcaaaatatgcaacggcagtgttggctgaacttgaagcaatggtggggtgaagcaatgttacaagagttagcgattcatgatttcgccatcattgatcatctggcgctgagttttcagcccggtatgaccgctttgacaggtgaaacaggtgccggtaagtcgatcattatcgatgcagttggcttgttggcaggtggccgcggctcagtcgattttattcgtaccggcaccactaaggccagtttagaaggtctctttgatgcgcaagaaaatccggcaacagaggctaagctgcaagcatatggggtcatggatccagatcaaaatgacaccgtactgttgcagcgcgagatttttcgcactggccgtaatgtttgtcgtgtgaacgggcatctggtcaatacaacgaccttgaaggcgatcggcgaaacgctggttgatattcacgggcaaaatgaacaccaacagctcatgcatccagaaacgcatctagggttactggattcgtttgccggcgatgacttgctgaaattgcggcaacaatacgctgatgtttatcacgattatcaacggaccttgcgcgccgtgaagcaaaaacaggcaaatgagcaggaatgggcacaacgcttggatatgttgaaatttcaggtgggtgagattcaaagtgccaatctgcagccgcatgaagatacggatcttactgcagaacgtgaaaggcttgccaattttcaaaaggttaattcagcattgcaggagagctatgctttattgagtgatgaagaagtgaatgcgcttgatcaaatcggtcaggccatgtcgagtatgcaaagtattgctgatcttgatccgaattttgctgccattgctgacaatttgcaaagcgcctattacagcttgcaagatgtccaaaatgacttgtcgaaggaattggatgatcaggaatttgacgaaggtcggctggatgaagtcgaaaagcggcttgatttatttaatcagttaaagcgcaaatatggggaatcgcttgatgaagtgatcgcctatggcaagcgggccgcgactgaattgaaccaaatggaacaagcagaaacttcggttgaagatcttgatacgacattgaaggcatcccagaatcagttgcagaagctgggaacggctttgtcaaaacgccgccatgccgccgctaagcaattgacgaaagcgattcacgagcagttagcatcattgtatatggaaaaaacagttttttcggtacattttgctaaggcaaaggattttcgggctgatggactggatgaggttgaattttatattcaaacaaatcctggtgagtcagctaaaccgttagctaaaattgcctctggcggtgaattgtcgcggttgatgttagcgatgaagacgatttttgcgaaaacagaaggtgtgacggctatcatttttgatgaggtcgataccggcgtttccggtcgagtcgcgcaggcgattgccaataagattagcttgattgctaagtcttcgcaggtgttgtgcatcacccatttgcctcaggtggcggcgatggctgatcatgaatatgtcatcagtaaggcggttcataatggccgcactacgacgcaagttctgaaattaaccgatcaggcccgcgttgatgagattgcgcgaatgctagctggggagaaaatcactaagctgacagttgaacatgcggaagaattgttgaaaatggcagacgaattcaaacatggacgcatgggttaagtgactgaattgtctacgacagtacatctggtcaatgatttctttgctttgacggtatcagttttagtttccaataagtgatctatgccaaacgaaagacgcctgattttccatatttaggaaaatcaggcgtctttatatagcagctagaaagaaaccttaacgtcgttttagttggtggtgatgaatcccatctgaattaaatgccattcatgcaagcccaaaaattcggattcgatgatcagcagcctgcgatgaatggcatgatggtagcgcgcgacactgcgcaaccggccaacaccgatcatttaaatcgtttaatgtaggatacctccgcttcggtgatgatccgatagacgttactatggtatgctttgaccagataccgtttctcacccaatggccgagtaatgcgaccgataaatggtggccgatcttgatcaaagaacagcgccacttgatactggcgatgcatggcctgatcaaggaaaagatcaagctgatgggaaggcatttttgcagttggtgccgccaaatcgaagaattcacgataagatgcgacgagatgacgggtaacggtttgcagtgcagatgatttgttttccatgatcaagcctccgaacatttgtttgtaatttcattatacgaacaagtgttcaaagttgcaactagtttttttaaatcagtggatcacgccgtttggggggaacaagcgatggcaacaatagcagttgtttttggcggcggtgctgctcacggcgcataccaagccggcgtgtgggccgtattggggccgcgattacgtccgacatttgtgattgggtcgtcaattggcgccatcaatgctgccggaaccgcccgtatgctgcccgagtaagtaccacaatggtggcagcatttttccgaagcaaaagtgaatggaccgatctttttgcggcgtcattttgtgccagtattaggtcgaatgctgcaagcccccaaactcgattcgcgggcggtgttagcagtgacaaccagtgtcccagattttcaagcacatgtgacccgactggatgtgttgactgcacctgaggcgcgggagtggttgcttgcttcaagcgccatgccaggcgttttttcgccagttgagcgggccggggtgagttatgttgatggcggggttgttaatgacttgcctgttgacattgcgcggcaaattggtgctgattatgtcatcgcgattagcggcgaaggaattggccgcattggctctgatcatggcgatctctatcttaaacccagtgagcggctgcctggattgtttaattttcgagctgaagccatcgctaatatgattgctttggggcgccgtgatgctcagattgccctcaaacgggcgcacttttcaccatttcaccggtgatgcagttgaaatcagcctcgaaaaagtgcaaaatgttcagtaatacttaacgaaagaggttcacacatgcacaagcggggaatgctaattgttttgtccgggcccagtggtgtcggtaagggaacggttcggcaagcaatgctggatggtaattatcgagattttcaatattcaatttcaatgacgacacggcaaatgcggcctggtgaggttgatggtgtcgattattactttaggacgaaagcccagtttgagcacgaaattgcgacaggtggtatgctggagtatgcgaaatatgttgagaattactacggcacaccgttaaaatatgtgaacgaaactttggatgccggccgcgatgttctactggagatcgaggttaacggtgccatgcaggttcgcataaaatgtccaaacggtgtcttcatcttcttgacaccaccagatcttagcgagttgcgccaccggttgaaaggacgcggcacggatgatgatgtgaccattgataaacggattcgcaaagcagcttcggaaatcaccatgatggaaaattatgattatgccgtggtgaatgataaagttgatttagcagttaagcgcatcgaacgtattattgaaagcgagcacttgcgggtgccacgcgtcattgatcgttacaagggcatgttagcaagtgcagatttggcaagatagttgtctgtggctggctcacatagcgcagggctcatgcccatctattagaaaaaggagtttcatctcatgattatttatccttcgattgataaactattggaaaaggtgtcgtcccgttattcgctagccgtattggcagcaaaacgtgcccatgaattagaatctggtgatttgaagatgttgtcagattataagtctgataaaagtgttggcaaagcgcttgaagaagttgcggctggcgatgtcatcattgatcctaagtctaaaatgcttgagcgtgatgcagaaaaattggatcgcaaggatcaggaataagcgattgatcgttctggctgtctgatgacaatggcgtttaaagacggctggcaatacaggaggcagtggcgcttaaaagtgctcctgcctctttttagtgtgcgtttggtataatggtcctagcttgaagtgcgaaaggagtcgacatgaagaagcaacatattgccttgtttgtcactggcgggattgccgcttataaagtgccattactggtccgagccttaatcaaagcaggccatgatgtacgggttgcgatgaccaaaagtgcggaacgatttgtcacgccggagacgttggctatcgtcagcaaggcggctgtattgacagacgggcatgaatttgatcatcctgaacatgttgcccatgtggcattggcacattgggcggatcttggtgttgtggtaccggcaacggccaatacgttggctaaactggcgaacggccttgctgataatgttgtgacgacgacactgctggcaatgcaggcaccaaagttgttggtcccggccatgaacgaccagatgtggcaaaatccgcagacgcaaaagaatattgctagtttggtgactgaacaagactatctcgtgcttccacctgaaactggcttgttagcggaaggctatgccggtatcgggagaatgcctgagccggaacggattgccttattcatcgaaagtttagatgacccgcggttacggggtcgccgtatcatcgtttctgccggcggaaccaaagaacgacttgatcctgtccgctaccttacaaacgactcttcaggtaagatgggcacggcgattgcaaatgccgcggccggagccggtgccgaagtgacgctggttacaacgcgacagttaccagttgttcccggtgtgacagtcaaacaagtcgaaagtgcccaatccatggcagacacaattgatgccgaatttaccgaggcagacgcggttatcatggcagcggcagttgctgattatcggttgccaaccgtcagtgatcacaagttaaagaagactgatgcgacttctggactgacgctgaatttggttcagaatccggacattttggcatcacttggccgtaaaaaaacgcatcagatattgattgggtttgcggctgagaccaatgatcttttgaaaaatgcgcaacttaaattaactaagaaaaatgctgatatgattgtggccaatcacgttgatgcgactcacggattcaacactgatacgaatgctgtgacgttattgcggccagaacaggcaccagtgaccttgccggaaatgcccaagccaaaagtcgctgctgctttgattgagcaacttgcaacgatgttagcaaaacaaaaggggtgagcgcttggcaattgttgccaaggtgatcgtggatgtgcccacgatgcaaacagatcgaccgtttgattatcttgtacctgcgcgcttagaaggcgctttgcaggcgggaatgcgggtctgggtccagtttggcaaaggcgcgcgaaaagtgagcggcatggtcgtgtcagtctccgaccaaagcgactatgacggtcaattgaaaccattgctagatgtccttgatccggccccggttttggaccacgaattattaaagctatcgaagtggttggcgcaaacaacgtattctttttggattgcgtgcatgcagacgatgttgccaactatgttgaaaatcgatgcggtaaaagttgctgaaccggttaagctgacggctgatgaacaacaaaaattttttggaacggctgacagtctggcgatcggtagcttgaacgctgaacagcaagttgcagtgatgaaattggcgcaagcagataaagttgctatttcatatttaaaaaaggatcgtgctcgggttaaaaaaatcttttacttgatcccgcaattatcaccggagcaagcggctgccaagcgtgaacacgtgcgtaaaaacgccgccaagcaacttaaactgttaactttaattggtgaatgggctgctaacaatcagcatcctgctttgatgaccgttgaacatcaatatggcctgacaaagccggtgattaatcaggcagtcgaaaaaggctggctgaagcttgaaggccacgagacataccgcgatccttatccggaactgcagcatcaaccgttgacgaagccgttgccgctcacgccagaacaacagacgattgtgacgcaaattaacgctgccgttgccgaaagggatcctaaaacatttttgttagaaggggtcaccggctctggcaaaacagaagtctatttgcaggtgattgcacgagttttagccgcgggacagacagccttgatgcttgtgccggaaattgcgttgacgccgcaaatggtcaatcgcgtaaaaggccgttttgggacgcatgttgccgtgatgcactctggcttgtctgatggcgaaaagtatgatgaatggcgccgaattgcgcgcggcgaggctcaggtcgttgtcggcgcacgatcggcagcatttgcgccgttaaaaaacatcggcgttttcatcatggatgaagagcacgagaccagctacaaacaagattcggcgccacgctatcacgcccgtgacgttttgttaaaacgggcacagattcaccatgcaccggttgtgttgggctcagcaacaccttcattggagtcgcgcgctcgagcggaaaagggcgtttatacactgctgcggctgccgcatcggattaacgatcaaccattaccgccagtgcatattgttgatatgcgggaagcctttgcgcacggcgcgcaagaggacttttcgggcccgctgcttgacgccttgagaattcgactacagcgacaggaacaaagtgtgttgctcttgaatcggcgcggttattcaagttttgtgatgtgtcgcgattgcggctatgtggcaaaatgtccgaactgtgacattagtctgacgctgcacatggacacacacaccttgaaatgtcattattgcggccatgaggaaccgattccacatcgttgcccaaactgcggttctgataaaattcgctattacggtactggcacccagaaggtcgaggcgcagttgcagcagctgctgccagatgcccgaatcttgcgaatggatgttgataccactcggcgcaaaggtggccatgcgcggattttaaatgcgtttggtgaccatcaggccgatatcttactgggtacgcaaatgatcgcaaagggactggattttcccgatgtgactttagttggtgtcattaatgcggacacagcgctcggcttgccggattttcgggcgagtgagaagacctttcagttgcttacacaggtgagtggccgggctggtcgggcggacaaacccggtgaagtcttcgttcagaccttcaatccagatcattatgccattcaatacgccaaacggcaggactacgaaggctttttccggcaagagatggccattcggcatcgcggcaattatccgccatatttttattcaacgaaaatcgctgtgagccatgttgatgaaacacaggcggctaaggctatcttttctttggcaaaagaattacgtgagcatctatccgatcaggtcatcatgcttggcccgacaccaggaccgattgctcgtttgaaaaatcgctatatttaccaaatcgttctaaaatataaacacgagccggcgttagccgcaacccttcagcatattctggaggagacccagcaaagcagtcgtcacggctttttagtcgcgattgatccagaaccgttggcatttgtttaaacgacttaacctgttccatggcaaaataggcaccaacctaccagcaactcatcgtttggaggaaaaaatgacttcagtaatttttttaggtacacccgaatttgctgtcccgattcttgaaggactgattgcccagcattacgacattcttgccgtgatgacgcaacccgatcgtaaagttggccgcaagcagcggctggcggctagcccagttaaacaggcggcgcagaaacatgatatcccggttttgcaaccggaaaaattgagtggtagcccagagttgacgcaagccatcgccatggcaccagacttgattgtcacggcggcatatggccaatttttaccaacaaaatttttagaagcagccaaaattatcgctgtgaatgtgcacggttcgctgctgccaaaatatcgcggtggcgcgccgattcagtacagcattatgaatggcgattcagaaactggcgtcacgattatcgaaatggtgaagaaaatggatgctggtgatatgtttgcgcaggcaaaactgccattgacgcgtgctgatgatacgggaaccgtttttgccaaattgtcattgctcggtcgcgatttgttactagaaacgttgccgaagatcattgctggcacggccacccggacccctcaagatccagataaagtgaccttttcgccgaccattaccaaagagcaagagcatcttaatattcatctgccagccaaggcccttgatcaatggattcgggcgttgcgtcccgatgtcggcgggtatgtttatttaaatggtcaacggacgaagttgtgggcgattacgccgctatcagcaggatcaacgcttcctgctggcagtattgttgaacgggataagcatcgtttggtgatggttgccggccaacaaaccactttccgagtggatgaactacagccggctggcaaggctaaacaatcaattgccgactttttgaatggaccgggccaacaattggtctcaggacagcaggtgattactgatgaccccgaataatccgcgtttattagctgttgaaaccctgtcgcgagtcactgggcaaggtggctattcaaatctgacattggatcacgtgattaatagtcacaagttgacgccgcgtgatgctggcttgctgacaaacatcgtctatggtgtgatccagcatcagctgacgttggatttttatctggcacctttcatcaaaggccggaaactcgacaattggattcggtgtttgcttgatacagccgtttatcaactgcagtatcttgataaagtaccagcacgcgcggttttttttgatagtacagaaattgccaagaagcttggacatcaaggaatcgccaaatttgtgactggggttttgcgaaatgctcagcgaacaggttttcctgacccagccgcaatcgctgatcctgtgaagcgattgtccatcgaaagcagtacgccggtgtggcttgttgaaaaattgactgcacaactgggtgaaccgaaaacccgtgccattttgaatgtcatcaatgccccggcgcatgcttcactgcgcgtcaacacgacgaaaatcactgccgctgccttacttgcctcgctacagccggaattcccggatttgaaggaaagtcctttaacaccagttggccttattgcacctggtggccacttagcggggacatccgcatttgtcaaaggtgagtatacgatgcaagatgaaagttcgatgctggtggccccaagtttagatatccagcctggggatgctgttttggatgcttgtgccgctcctggtggtaagaccacccacattgcccagtatcttgatccgaagcaaggcggacaggtgacggcacttgatttgcacgccaacaaagtgcgtttgatcaataaaaacgctaaacgcttgggcttgacggatcgcatccatgcacaggtgctggatgcacgtaaggttgccacaacattttctgccaattcttttgacaaaattttggtggatgccccttgttccggattaggtttaattcgccgtaaaccggaaatcaagtacacaaaaacgcctgaagatccggcgcatttgcaacaaattcagctagcaatcttaaatagtgtggcaccaaccttaaaaatcggtggccgcctgacgtatagtacatgtacaatggtgaaagaagagaatcaagatgtggttgcacaatttttggcggctcatcctgagttcgagcaagtttcagtaccaaccttgaagccattgcacaaggcgcataacgcaccagcgctgcaactgtttccagatgattatgatacggacggatttttcattgccagtttgattcgtcgcaaatgaggggtatgtatggagttcgcttatcgcactgatattggtcgtcggcgaccaaataatcaagactatgtcggtatttttaaaaatcaatccgaagcgacgttggccttggtggcggatggcatgggcggccatcgtggtggtgatgttgctagtgaaatggcagtatcgcatttaggttatgcttttgagaaaacagatactgccgagattgagtccatcgtccgttggctcatttttgagttgcagcaggaaaatgatgtgattttgcaaaaagcgaaacaatatacagatctttctgggatgggcacaacggttgtggctgtgattatcagcggtacacgattcgtggtggcaaatattggtgattcacgtggctacctctatcgcaatggccatttagttcaaattactgaggatcatagtttggtcaatgagttggtcaaacatggagaactaacccctgaggaagccaaacgctttccgcagcgtaacgtgatcacgcgctcgcttggtgtcagcagtgatgttgatgctgatgtgacgatttacgatatggaatatgacgactatttgttgttgtgttctgatggcctcaccaacatggttgacaatgaagatatcgcggcagtgttgcgtcaggacatgccgattggcagcaaggctcaagaattgatcctcaaagcaaatgctgctggcggacctgacaacatcagtgccttgatcattcatcaggatcggagggagccacaatgattgagccggggacgattttaaatgagcgctacaagcttatcaaaacattaggcgaaggcgggatggccaacgtctatttggcacgtgacctgattcttgatcgcgatgtggcggttaaggttctccggcttgatttgcaaaatgaccccgatacagttcgccgctttcaacgagaagccatggcgaccagtgagctggttcatccaaatattgtgtcgatttatgacgttggtgaaagtcaaggtcagcaatttctggtcatggagtatgtcaaaggctctgatttaaagcactacattgtcgagcatttccccattccatatcagcgcgtggtcgacatgatggaacagatcctttctgccgttcagacggcgcatgatcacaatatcattcaccgtgatttgaaaccgcagaatattttgattgatccggatggcaatgctaagatcaccgattttgggattgcagtcgcgttatcggagaattcgatgacgatgaccaactcattattggggtcggtgcactatctatcaccagaacaggcgcgcggcagtatgccaacccgtcaaagtgatatttatgcgttaggcattattctttttgaaatgctgactggttctgtacctttcgaaggtgattcggcagttacgattgcgttaaagcattttcaagaagaaattccgtcggtgcgcgcgtttgatccgcatatcccgcaggcactggagaatgttgtttttaaggctacagccaaaaatccggctaatcgctataccagtgcggatgccatggctagcgacctcaagacagcgctgagtccggcacgggcacatgaagcaaagtatgtggttcctacagatgatctggatgagacacgaatcatgccagtcatccccaacggccccaaaccgccgcatgacgaaggaggagatgctgacagtccagcgagtcagccaagtccgaacgcacgacctaagaaaaaaagtcgccgctggtggattattggcatcgggatacttgtcgccatgctgctgatgattggtatcggcgcagtttttgccaatcagaaaagggatgtggacgtccccgatctacggggcatgaccacaacccaggcaaaaactgccttgaccagcgcaggcttaaaagttgggtcatacaagtacacttattccacgaaagttagcaaggatctggtgatcgattcagatccaaaacggcaggtgagtgttaaggaaggctcgacggtcaagctgattttaagccgcggtcagccgcaatttacgctagagaattatgttgggcaagattacacagacgtgaagtcagacttgcaaaaacgcggcgtaaccgtcaaagaaaaacaggtcagcaccaatgacgaaccgtcaggcaagatcgtgtcacaaagcattaaagcaggcaaaaaggtcattgcggacaaaacgacgatcacatttggtgtttccgttgcaatcaagccaaatacttttgcgcttcgtgatttgacgggttataccgaaaaaagtttgcgagattacgccaatgaagtcggacttaagattgtgatttctcaagcgcactctgataccgtcgatacaggcatggtaatcagtcaaacgccagctgctgggacacaggttaaaccaggcgacacagtcaatgtttcggtctctcaaggcccagatcctgaagagaccaaaacttggtcgaaaacaatttcaattccctatcaagcaccggccagttcgagtaccgcaagtgccagcaatagcagtggcagcactagtagcagtagtagtgctgcgcccgcacccaacggtattcaggtcttcatcgcagataagacacataacattagtaccattaatcggtcctttaacatcacggctgatgatcaaatcaccatcacgttgcaagttagcacgaaatacccaggcagctatcggattgtccgggacggtaccgtgattgcgcaggaggataacattactcaatgagtgaagacttaactggaagaattattaaacagatcagcgggtattacgacatcgctgtgaatgggacaacttaccgaactcgcgggcgcggcagtttgcgcaacgacaaaattacgccgctggtgggcgactttgctgcttttcaaccgggagaaggggatgatgaaggctatttgctgaaggtattaccgcgtcataatgcgttggtgcgcccaccggttgccaacgttgatcaagccgttttgatcacttccgccgtggagccggacttttctaagaacctattggatcgttttctggtttatcttgagggccacgatattcacgcggagatttatctgaccaagaccgacttaactaagcctcagcgattaacgaagattcgtcaagatttagccggctatacaaaaataggctatccggtttttgcacctgacaagccctttgatccgacaatcctcgcgcaagtacaagcgagctttgccgataaattgaccattttcactggacaaaccggtgctggtaagtctactttgttgaatcatcttgtgccaggattggacttggcaacagcggccattagtcatgcgttaaatcgtggccggcacacgacccgcaccactgatctttatccgattcacggtggcttagttgctgatacacctggtttttcatcgcttggtttactggacgtcaccttagatgatttgcgtgaccgttttcctgagtttgcggcgttagcacccaattgcaaattccgcggctgtcagcacgttagcgagccacattgtgccgttaaggcggcactggcggctggcgatatcatgcaaagccgttatgataactacttacagtttcgtgaagagttaagcggcaagcgcccagtttacaagaagaagtaacttagattagacaaaatgcggacgtcaagctgattaatggccggatgaacgcaacatatggaggagatcgttatgaaaattgccccatcgattttaagtgctgattttgctcatcttgcgcgggatgtcgaaaaagttgaaaaagccggtgctgatttactgcatgttgatgttatggacggtcattttgtatcaaatctgactttcggtccgctggtcgtccaagcgttacgtccggttaccagtctgccattggaggttcacttgatggtcagtgacccagcggcttgggtggcagattttgctgaagctggggcggatacgattttggttcacgaagaagccacggatcatctttatggcgttttgcagcatgtgatcgagaaaggcgttcgcgctggggttgtgatcaatccgggcacaccattgagcagtcttgaagaagttctcccgttggttgatcaagtgctggttatgacagttaatcccggttttggtggtcaaaaatttttgacgccgatggtggacaaggttgatcgattatatcagctgcgtaaagctcggaaactgcattttgacattgaagtcgatggcggtatcaacaatcaaaccgtgaaggcggcagctgatgccgggacagatatttttgttgcaggttcgtatgtttttgggtccaaaaatgtcggtgacgcgatgaatagcttgcgtgaggcagttaaatgacgcacgtcaacatcatggcaggcggtcctcaggcatgcttaccagccgcttgggaacaattgcccggtgtatggatcggcgttgatcgcggcacattgcgactcgtacgtgcagggattcatcctgaactggcagtgggcgactttgattccttaacgcttgaagaattgcggctagttcgtggacatgtccagaagctgcaacaggtgccttctgaaaaagatgacacggatacagagttggctgttaaagcggcacttcaggcatcttcatccggcgacgtcaccttggttggcgggactggtggacgactagatcattttttgtctaatcttttcttaccgcttcaaccgcgctttttagcagatattgaacgccttcatttatttgatgtgcaaaattgggttgattattatagccccggtgagcatgaaattaaaccgctgccagtttatcggtacgttgcagttgtcaatctcaccccagttgccgatttgaccattgtcggagcgaaatatcctttaaaaccatggcgagcgggctatccttatgcgtgggcttccaatgagtttcttggcaagcagcccttcaccgtgaggtggacgactggtcaggtggcaattatttatagtcgtgatcggcgcgggcaaaaattggataattaggcattgttttcttcctgatttgctttaatgaactaccgatctgagaagtcagcatatcaagatcctgaaaaagtgcgtaccagtcccaactggccggagattgcggcgtttggcatggcaaggaaattttagaccaaggctttcccaaattagttggcgtccaacgaatcacagattgtatgagtgatattaggtcaaccgcttaaaatccgggtacgctccggtttctaatcgctcctgctcgcgctcaacaaaaaaaggtcctgacaatgaaggatgcatcacattcattgtcaggacctttttaaatgttatgggatcaaacccgggtcagtttacctgatttaagggcacgtgcagaaacccatacccgctttggtttaccatcgacaaggatacgaaccttgtgcaggttggctttccattggcgccggcttgaattcaaagcgtgagaacgcttgttgccaaacgtggtatgacgaccagtaataatatctttagccacaatatgacctcctttttttcaaggtcaccctcgaatttttcactcaactaacttatcataggcccgcggttaatgcaagaatttttgcaaagtaaaattacttgacaggtcaaaataaacgcgtgatcagagtctaagaaaattgggtgggtaagtacaaatagtccgatattctttggaaaatgttactgttaacgattgtctcataaaggtagcgacaagaccagaaactgggtcttgggcgcaatggccaaaaaccggacatcacacccaaggccgcttacactccggtttctaatcgggctgattcacgctctgctcgcagtcatcgcttagctatgctaaactagctggtagaattgtacgcgatgtgaaaatcatcgcgaatggcttaggaggaaacagcatggcggtcaaaatcaaaaccaaatacggaatcatcgacatttctaacagtgtcattgcgacggtggttggcggtgcggcgacgtccatctatggtatcgtcggcatggctagccgtaatcagattcgcgataatctcaatgacattttgaaacgcgaaaattattcgcgcggtgttgtcgttcgtcagacagataatggcgtgaaaatcgaagtcaacattatcgtcagttatggcactaaaatttcagaagtttgccgaaatgtccaagacaaagtaaaatacaacctcgaaacgatgttgggggtcacgactgatgaagtgaccgtcatcgtccaaggcgtcaaggtattaggcgactgacgtacacgcaccggttgttaacggtgtgacatattgaagttcttcgaggaggatgttccgtggcagtaaccgaaattaccgcgactaaattccaggatatgatccgggtagccgcacatcgcatcaataaaaatgctgattttgtgaattcattaaacgtttttccagttccggatggtgatactggcactaatatgaacctgacttttcaaactggcgcaaaagcggtgttggagtctaatgatgagtcagttggtgacttagccaagcatcttggcaaaggtttgctgatgggcgcgcgaggcaattctggcgtcattagctcgcaacttttccgtggctttgcaaaaagcgtggcgcataagaaaagtctgacggctcaggacctagccgatgcgtttgcacatggcgtcgagacggcctataaagccgtcatgaagccggttgaaggcacgatcctgacagtcgcccgtgaagcggctaaagctggcttaaaagcggctaatggctctgatgatgctttagttgttatgcaggcagttgtgaaaggtgctaaacgtgccttagccaaaacacctgatcttttggccgtcttgaaagaagtcggcgtggttgattctggtggacaaggacttgtttttatttacgagggtttccaagaaggcttgtccggtaaaattagttcagatgttcatgacgtcactgacgaagaaatgaacgaaatgattaatgctgtgcatcatcaaagtgctcaagtacagcttgatccagccgatatcgtatacggttactgtaccgaaatgatggtcgaacttggtgatggccaaaacctcaaacattttgactacgaaccgttccgtaactatttgaatacactcggtgactcgaccttggttatttctgatgaagaagtggtcaaggtgcacgttcatactgagcatccggggactgttttccgttatggtcagcaatttggttcattgatgaaaatcaaagttgataacatgcgcttgcaacaggaaagcattattgaacgtgaaggcgcattggatcaacaagtggcccaaaagccgttagctgaaatgggtgtcgttgcgattgcggctggtcaaggactaggagaactcttcaagagtcttggcgtgacgcatgtgctcaatggcggtcagaccatgaatccaagcacaaacgatattttggatgcggttaaagcagcgcatgccaagcacgtgatcgtcttgcctaacaatggcaatatcttcatggccgcggaagcagcggcaaaagcggcgactgacgttgaagttgcagtggtcaaaagtaagacgatcaaccaaggaatgaccgcgatgctagggtacagtcctgatgcagatctagccactaatcaaagtgaaatgactgcccaactaccgaatgtgatcagcgggtcaatcacccgagccatccgtgatacgacaatcaacggtttggcgatcaaagatcatgactggatggggattatcgacggtacgatcacagtgactgataaggatcgcgaagcagcagggattgcgatgattgataaaatgatcaatgacgatagtgaaattgtgaccatcatcgtgggtgcggatgctaatcaaacggaagcaaaggcgattgccgatgctgtcggtaagcaatatccggatttggaatttgaaatccatcaaggtgatcaaccggtttatccttatttcgtctcagttgagtaggcttaaacagctatcgcgtacaggtgtcccgcatgcggggcacctttttgcgaaatttatataaaagcgtgcgattggcgtcattaggccagatggtcagtaacacactcattagtggtttgctatattctgataaaggaggtgccttgatggctttgactgatcccgttactgttctacctggtgttggtccgaaacgtgaagctgggctggcaagccttggtattcacaccattagagatctcctattttattttccttaccgctacgatgatttgaaagtgaaggatcttgccgaggcagccgatcaggaaaaattgacggtcaaggggatcgttgtgactgatccggttattagtcgatttgggccgcatcgtagtcgcgttaacgtgaagctccaaattgaacgtagcgtgattctggtgacgttttttaatcaaccatggttaaaagatcgttttcagatgggtgatgaagcagcaatctttggaaaatgggatgccaagcgtcgtagtctgaccggcatgaaaattctcgcgacacagtcgcaggatcaaccgtcgatggcggcgatttacaccgtcaacaaaaatgtccgcatggggacgttactcgacttgatcaaagctgcctggaaacgcgatcagcaaaatatcaacgatttggtacctgccagcattcgcgagcattatcgcttaatgagtgatgctcagttggttcatggcatgcattttcctgatacgccagcagaagcaaaggcggctcgccgtactggggttttccgggagtttttccttttccaattgcaaattcaggcgttaaaacaactgaatgccaacagcagcaacgggttggcgattccttatgacaatcaggccttgcgcgcgctaatagcgacattgccgtttgcgctcacgaatgctcaaaaacgcgtggtaaacgaaatttgtgccgatatgcggcggccaaatcatatgaatcgactgctacaaggcgatgttgggagcggtaaaacggttgttgccgccattgttctgtatgcggcggtgaccgctggttttcaggcggctttaatggtgccgactgaagtgttagctgagcagcattttgccaaattgacaaagttgttcaaagattttccagtcaaattaggtttgttgactggctcgacgtcaaccaaaaggcgtcgcgagctcctgagtgagttgcgtgatggccgcctgaatctcatcatcggcacgcacgcgttgattcaaaaaggggtcgactttcatgcgctcggtctggttgttattgatgaacagcatcgatttggggttaatcagcgcaagatccttcaagaaaaaggacaaaagccggatttgttgtcaatgacagcgacgcctattccccgaacactggccattacagcctatggggaaatggatgtctccacgattgatgaattacctgcgggtcgcaagccgatcgcgaccacgtggctgcgcaaaaatcagattgaccaagtttatcgaatcattcgtgagcaggtgcagtcaggcagtcaggtgtttgcgatcacccctttgattgccgaatccgaaaaaattgatttgcaaaatgccgagcagctttttattgatatgcaaaaagcggtcggcaatcttggccctgttgcgttattgcatggacagatgaagccggacgagaaggatcggattatgcgtgcttttagcggtgggaagatcgcggttctggtttcgaccaccgtcgttgaagttggagtggacgtgcctaatgccactgtcatggcaatttttgatgctgatcgctttggactttctcaactgcatcagttgcgcgggcgtgtcggacgtgggcaaaaggcagcacagtgtctgcttatcgctgatcccaaaaatgagcaaggaattgcccgcatggaaattatgaccaagaccaacgacgggttcttacttgcccaaaaagatttggaaatgcgcggttcaggtgatatttttggagataagcaatctggtttaccagagttcaaagtcgctgatccagtgggcgattttccaaccctagaagctgcgcaaaagattgtggcccagatttttaaaaccgatccacatttgctgcattctgaccatcagccgcttgccgcttacttggcggaaagccggcagatgctcggtagtttggattaaaacttgaaaggaacgaattgaatgaaaattgcgattgatgccatgggtggcgacaacgccccagaagttgtcattgccggggtcgaaaaagctagagatgccaacaaagaattgacatttcttttgtacggggatgaagcaaaaattaaaccgcttattcatcatgatgaacggttaacaatcattcatactccggaaaaaattaacagcgacgatgaacccgttcgtgctatccgccgcaaaaaacaggcttccatggtcttagccgctcaagccgttaaacaaggcgaggcagacgcgatggtttcactcggctcaactggagctttgttggcggcaggcttgtttattatcggccgcattcgtgccattgaacgccctggtttgttaccaaccttgccgacagttgacggcaaaggctttgtgatgctggacgtcggtgccaacgctgaaaatcgaccgtatcatctgttacaatatgccatcatgggcagttactatgctaaagatgttcgcggcgttgaaaacccccgagttggtttgctgaacaatggcactgaagccaacaaaggcgacaaaatgcatcaagaggctcatgatttattagctgcggctccggggattaattttgttggtaacgttgagtctagtgatatcctaaacggtcctgccgatgttgtggtgacggacggtttcaccggtaacgcaacgcttaaggcaattgaaggcactgtgcggacggtcatgcacatgctgaaaggagccatctatgaaggtggcctttccggcaaattaggcggtttgttcctgaagggtaatctcaagtcgatggcctcaacctttgatatttcgtcatacggcggcgcggtcttgctggggctcaaggcacctttaatcaaggctcatggtgcagcagatgcagagaccgtttattatactttgctgcaaaccgccaaaatggttcaaaatggcaccgttgcgaaagttgccgattattttgatgcccatccagaagttgccgaagcgaaaaccgctgagaaagcgtagacattccagtggcaaacaagtacactaaattggaagatgaatggaggagcaacatgagtgaagacgaaatttatcaaaaaattgccggcctaattcaggaccattttcaactaagtcccgataaaatcagcccgacacttaactttcaaaaggatcttgatgcggattcaattgacatcgttgaatttgttttagagttagaagatgccttcggagcagaaatccccgatgacgacgccgaaaacatcaaaacagttcaagatgccgttgattacatcaacgcccatcagaagtgacaaaaagccgaccagaaatggacggctttttttaagagtttgcttggttagaaaccatcgtgttgtagaccttgatcttgagcgtgatgagcgcacttgggcactgtctctgagacgctgacggataaggtcttgggatggcgtttgtctttcagcgaaccgaagatgttggccacagataagaagttgcaacggtcgacacatcaaaagattattcttttcgaaatattcgctgctacgaactcattgagcgcccacagttcgctaaatttcggcgaccagagcccaaaatgatgccatcaaattttcgcttttgacatggcaaaacagctttagaacgcatttttcgcttgcataaccgctataatttctttatacttagagacaattatttcaaaaatctcatcttgttttaatcttgcgtcgaggacgcaaaggaggagttcgcttggataaacctgaagatttgctgctggatgtgcaacatctgcacacgggattcagactcggagacgactattatgatgcggtcgatgatgtcagcatcacgttacgaaaagatgagatcttagctattgttggcgaatcgggttctggtaaaagtactttggcaaccagtattatcggccttcatgatccgcgcaatacgaaggtcactggcgatattttgtacaacaatcttaatcttgttggcttgaatgaggccctttttgaccgaattcgtggtaaagatattggcatgatctttcaagatccattggctgctttgaacccattgatgcggattggtgagcagattgaagaaacactggtctatcacactaagatgaacaaagaagagcgtgaaagtcgcgtcttggaattactgaaccaagttggtattcccaaccctgagcgaacggcacgttcatatccgcacgaattgtcaggcggtatgcggcagcggattgtgattgccattgcgattgcctgcaaaccaccgattatcatcgctgacgaaccaacaactgctttggatgtgacgattcaggcccaaatcctggatctgttggaagacatccaacgggaaatgcattctggcattattttaattacgcatgatcttggtgttgttgctgaaacggctgatcgtgtggcagttatgtatgcgggccaaattgttgaaagtggttcggtaatggatgttttcaagcatccaacgcacccatacacgcgcagtttacttcgctccatgccacagacagattcagatgacgacgaattacatgtcattcaaggcgttgtgccatcattgaagaatatgcagatagaaggttgtcggtttgcggctcggattccttggattcctgcatcagcccatgaagagcatccgatcatgcacgaagttggccctgatcactttgttcagtgtacctgctacaaggacttctatttcccggatgacgaacaagcagctgaaaaaggtgagtaaattatggcaatgattgaggttagaaatctaaaaattcattatccgattcgctcagggttttttaatcgagtgacggaccatgttttggcagtcgatgggatcgactttgatattgaacaaggtgaaacatatgggttaattggcgaatccggttcaggaaaatccaccacaggcaaagcaatcgtgggtttggaaccggtcacgtccggctcgattatgtatcaagggcaggatattaccaaacgcagtgtgcggaaacatatgcagtacaacaaagacgttcaaatgatttttcaggactctttatctagtttgaatccacgaaagcgaattgaggatattattgctgaaccaattcgcaactttcagaatcttactggggatgaagaacgtcggcgcgtccaagaactgctcgatattgttggcatgccaagcgatgctttgtacaagtatccgcatgagttttccggcggccagcgtcagcgaatcggggttgctcgtgctatggcaacgaacccgaagctcattatcgctgatgaaccagtctctgcgttggacttgtcggttcaggcgcaggtgctgaacttcatgaagcggattcaagaggaatacaatatttcttatctgtttatttcccatgacttaggtgttgtgaagcacatgtgtaagaacatggcgatcatgcatcgcggccgttttgttgaaatcggctcgcgtgaagatatctataaccatccacagcacatctacacacagcgactgctttctgcgattcctgacatcaaccctgatgatcggaagaagaataaagagcatcgtcgtgaagtcgaacgtgtttttaaagaagaagaatcaaaatattattctaaagaaggccgcgttttggatctccagaagatttccgacacacattttgttgcgctgccagattcaacgatgaagggagtgcatgattaatgtggaaaacaattctgcgacgggtcttaatcatgatcccgcaattgatcttgttaagcgtcctggttttcatgctatcaaagatgatgcctggggatccattgactggtaatttctcgcaaggtcaaagtgctgcgcagatggcagcattacgccagcaatatggtttgaatgatccttggtatattcagtacttcaaatgggttggcaatatgttccacggtgatttgggccagagctttgtttataaacgttctgttaccggtctgattggcgaacgcgccgtgaacactttctggttggccttaatgtcaacggttattctgtacgttatcgctattccagccgggattattgccggccgttacgaaggcaccaagcgggattcagctatctctgttggctctttcattttgatggcggtaccgccattcgtcttttatctattgggtttaattttcttcgggttcttcctgcagtggttcccaaccggtggtagtgtgtcatccacttataatccgggcacgttagggtatttctgggaccgtatttatcacatgattctgccagccttggttgctgggattatcaccacaccaagcacgattcagtatttgcgaactggtgttattgataatacgagacaagattttgtccggactgcccgttcaaaaggggttccggatcgcgtcatcttcaacaaacatattttgcgtaattccttattgccgattgcggcgtttatggggaaccaaattaccatgttactgggtggatcggttattctggaaacagtgttcagttatcccggaatggggcaactgtttgtttcttctatgaccagtcgtgactatccagttgtcatctctctggtgttgctatttggtttcctgacgttgttagggaatttgctgtcagatatcatcatgagtatcgtggatccgcggatccggatcgagtagaaggtggggaaaacttatgcaaaataatgcaaatgaggtggcagcaaccaccaaagttgaacaatcaccttctaacttcaaggtgattttgaatgaatttcgcaaagataaagttgctgtcgtctcgttaatcctagcagtgttcatcatcctcgctgcattcattggctcaatgatgttcaatgtcggtggtgcaacagaggttaatatcatggatcgttacatggcaccaggtacaggtggctatattcttggtactgacgaaggcggccgcgacatgttcaaatatctgtttttcgcagctcgaaattcaattacaattgggatttctgttgcgttgatcattgaatttgtgggagtcgtgctaggtacggtttctggttactttggtggttggattgatgccgtgatcatgcgactggttgatttctggatgatcattccatcattgctggtaatcatcgtgttggtaacagttattccacagtacaatgtcatcacaatcattttgattatggctgccttttactggatgacgactactcgactgatgcgctcgctcgtcctttctgaagcacgcagcgagtatgtgatggcatcgaaaacatcagggacgtctaacttcaagatcatgttcgccggcgtcttgccaaatatcagttcattaatcatcactgatttgaccttgactatcgcaagttctattgggattgaaacagcactgtcattcttgggctttggcttaccgatggaaacacctagtctagggacgcttatcggttttgcttcaaacccagatttaatctttgatcgttggtgggtttggttcccagccgtgttggtcttattgacgctgtccctgtcgatcaactttgttggtcaggcattacggcgtgcggctgattcacgacaacgtcgcgggtgagtttgacgcttattttctgaaaattactggagagacacttagagaaatcgaagtgtctctccttttttgaagaaaaaaaagtaaaaattgtgcccaaatattggtttttttgttctaattatgctatcatttaactcacatgaagcgttgcttcgtttacatattgcgatgacgacgcggaagggggaagaagtatgaaaaagcgttctgtgctcggaatgatcacactcgctaccgccttatcaatcaccttggtagcctgtggtagcaagagttcaaactccagctcaagcacgtccaataaggctgtgaagttaccgatctcttataacaacaccaagaaggcgattaagggtggtaatcttaacgtcggtgtcgttgatgactcaccatttaagggggttttcaacgaagagttgtatacagatgccttcgatagtgactatatgtacccggctgctgaaagtctttttggctttaacagcacctttaagttcaataactcaggtgcggccacattgaagcaggataacaatgccaaaacaatcacggtgacggttaagccaaatgttaagtggtctgatgggcagccggttgttgcacgtgacttagtttatgcatacgagatcattgcgaataaggcttcaaagagtcagcgttatactgaatctttgcaaaatattgaagggttgaccgaatatcacgaaggcaaggctgactcgatttctgggttgacaatgcctaagggcgataatggtaatactttggttattcattttaaagaaatgaagccttccttcaatacgtcaggtaatggttacttcttggaaagtgccgcaccatatcattatctgcatgatgttgcttttgataagctggaatctagcgataagattcgcaagaagccactcttctttggaccttatcagatgagcaagattgttgctggccaaagcgttcaatatacgccaaacaagtattactggaacggtacgccaaagctggataagattacctttgaaaatgtatcttcagcatccagtacttcagccttgaagaatcataaatacgaccttgtttatgaaatgggcactgatacttggaacgattggaagagtgtcaaagggtatgaaaatctcggccgccaaggtttgatttatacttacattggcttcaaacttggcaagtgggacaaaagtaagagcgaaaacgtttataatccgaaagccaagatggctaacaagagtttgcgtcaggcaatgggttatgcacttaacaacgatgaagttgcttccaagttctacaacggcactcgttcacgtgcaacaacattaattcctcctgtatttggtaaagctcatgctaatattgatggttataaccttaatattaagaaagctaatagcttactggacaaggcaggctacaagaagggcaaagatggttaccggacagatccagatggcaagaagctaaccattaattttgctaccatggctggcggctcaactgctcaaccaattgcgcaagattacatccagcaatggaagaagattggcttgcgtgtcaagttaaccacaggtcgactgatggaattcaattccttctatgataaggttcaaaaggatgataagagtattgatgtttatcaagctgcatggcagctgtcatccgatccgtcaccaatggatctttattctcagaaggcaccgtttaactacacgcgttttgcttcagctaaaaacacgcaactgttaaacgatattgatggccaaaaggcgatgagtcaaagctatcgtgacaatgccttcaagaagtggcaagaatatgctaatgatgaggcctttgtcatcccaacgctgtatcgtcaacagattttcccagttaacaagcgtgtgaagaacgcgagtgtcgactatgcatcatcacagaacttgaattgggctaagatcgctgttacaagtaatacgacagctaaagattaatcacgcctgattcgaagagacacctgcaatcgcaggtgtctttttttgtgcgctcttgtataattagaaggtaataaaaaaagagcgcgtgaatgcgtccggtttagcaacggcgtgtcagctgcttagaagtgatagccagcgcctgataggtacttctaaacttatgacccaagccgttcacgagctcatgcatgcattttcgaggaggatttttaatggttgcctcagagtttgtgagtgaattgcgtcaacgttatgggatcgagtttcatgatctcagtcttttggatgaggcgtttacgcattcctcatatgtgaatgaacataaagaattaggtttaaaagacaatgaacgattggaatttttaggcgatgctgtcttggaattgacagtttcagattatttgtatcgcaagtttcccgacaaacccgaaggcgatctcacccgaattcgggcagcggctgttcagacagcggccttctcggctttttcaaaagaagcgcatttcgaccggtatattaaacttggtaaaggtgaggaaaaggctggggcgcggaaacgcttaacgctgctagaagatttatttgaggccttcaatggcgccttataccttgatcaaggccgcgatgccaacattcggtttgctgagcagatcattttcccgaaaattgatgcgggagagttttcagccgatcaagaccacaaaacggctttacaggaagttttgcagcaaaatggtgatgtggcgattgtttatcacttattagatgagcagggaccagcccatgagcggcagttccacgttgatgtcgaagtcgatggccgggttttgggtaccggttttggcaagaataagaaagcggctgagcaagctgctgcaaaagctgcattagccagcttgaaacggtaagtagaattggggtcatcatgcaattaaagcgtttaatcattaatggcttcaaatcatttgcagacaaaactgagattgattttgtgtcgggtttaactgggattgtcggacctaatggcagtggcaaaagtaatatcactgaggccatccgctgggccttaggcgaacaaagtgctaaaagcttgcgcggcgaacggatgggcgatgtgatttttgcaggcactgatacgcgaccagcgcttaatcgtgcatctgtcacgatgacttttgataatcatgatggttatctgaaaaatcaacctgatgaagtttctgtcactcggcgactttatcgagatgggacatctgaatttttattaaatggtcaagatgttcggctgaaagatatcgtggatttgttcatggattccggcttagggcgtgaaagcttttcgttcatttctcaaggtcgggttgaagcgatatttaatagtaaaccagaagaacgccggggcattattgaagaagccgctggcgtttataaatataaacaacagaaaaccaaggcagaacgagaactcgccaataacgatgataatctggcgcggatcaacgatattatcgtggaattgaagcatcaggtggaaccattacgtgagcaggcttcgttggataaggactatcaacaacaatccggcgagtatcatcagattcatcaaaccttattagccttagagatcgaacaactagcgactgaacaggagaaaacccaaagtgaggctaaggtcatcaaggaaaccatcgccgctttgacggcgaaggttaaagatttggaagatcagtcggagcagttaagtgccgtagatcgacagtttgagaaccagcttaatcagttgaatgaccaggtcttgagccggtcgatgaagcttgagaatcttagcggagaagccaacctatctagtgaacgttctgctaatgctgaaaccacgttggccgatttaaaggaacgactggcgcgtgctcaacaagcgttaacggaagcaaatcagcgactgaaggaacttaagacaaaaacaactgctgccgccgaaaaagagcaagcaattaagcaagaattggcccagcaaaagcaggcaaaccaggatccagccaaactgaatcaacaagtggaagtagcccagaatcattatattgatctgttaaaatcacaggccgataacaaaaatgctcaggctgctttacaaaaagatcaacagttagccgccagccaaaatgcagcgcatgatcgtcggatttacgaactaagtaaacatgcacaggatcaggaagccaaggtcactgcattattgacgcaacagcaacagttgcaagcagaggttgatgaacagcaaacagccgttgagcaggccaaaactgatcgtgatctattgcagcaacaacgggcggcccaacagcaagcttatcaagacgagctggccacttatcagcgcagtcgggcgcgatatgaaacgttatccgaactgaatgatgattatgctggcttttacaatggggttcgggtggttttaaagcataaggatcaacttcccggagtgattggtgcggtcgcagaattacttgaggttccaactgcctatcaacaggcgtttgacttagccttgggtagcaacttacaggccattgtgacccgtgacgaagcggctgcacaacgcgccattagcctgctcaagcaacaacgagcaggtagggcgactttcctgccggctgccgttatgcggccaagagagctgcccagtgcggttctacagttggttgaaggtgctgaaggctttttaggcactgggttgcaattagcccaatatcctgcagatttggcacacgtcatggcgaacttactcggcagcgttttgatggtggataccttgccacatgccatcgcgattgccaataccacccaccatcgttatcgaattgtcacaacagctggcgacattttaaatccggggggttcgttgactgggggccaagtcaagcagggacgccaagcatcgccgcttgctcgcagtcaagaggcccggcatttaaaggtccaactgcaaacgcttgttgaaacattaaaggcaaagcaagctgatctgactgctttgacgaaaaaagaaaacgtggcccaggcagcttggcaaacggcttcccaacaggcacaggcattaaccgcaaagttgacaacaattacgagtcagcacacagcccaagcggaaaccttgcgtcaggcgcaacgtcagctggcagcggcgcaacaagcagatacggcgcaggcagatcttagtgccaaattaactgagttgcagcaccaaggtaaaaaattggttcaagatattgctgaagcacaagcaactattgaaaatgctaaggcggctgttgcggcggcaacggcatccagcacccagcatgcagcaacggttaatgcgttgaagaccaagctagcagtcactaccaatgatttgcagaccttgaatgaccagcaacggcaatggcagacgcaagcacgcgatgcgcaagcccaagcgaccgatttgcaacaacgaattgagcacattactgcgacggccgaagaaactgctgcagaaaaggccagtcgtaccgctacgatcgcgaatttgcaaactgaattaaagcagctcaaggcggatcaaaccaaattaacacaacaaaaggcggaaaatcgtagtaagctgagtcaaatatcggcgcgtattacgaccacttatgagcagcaacaccaagctatggcaacttctgagcagcaagcggttgctttgaatcgagttaaactaggtttggatgctcggttgaatactttagccgaggattatcagttgacctacgaggccgctaaggaagcagtgacagccgatcacgcgccaattcctgaattgaaaagtaaactcaagcttttaaagcgtggcattgatgagttgggaccggtgaacctcaacgcaattgatcagtttaaggaagtcaatgaacgctacgaatttctcaacaagcagcaagatgatcttctagaggctaagcagcagttagaagaaacgatgcacgaattggatgaaacggtcaaaacaagatttaaggatatgtttgatcagaccaatagtgcttttgaagcaattttcccgcaaatgtttggcggcggtcatgcacatttgagcctcacgaatccggatgatttgctcgcaacagggatcgagatttccgctcagccgcctggcaaaaaactgactcggctttcccttctatccggtggcgaacgggcgctaacggcgattgttctgttatttgcaattttaaaagtgcgtccggtaccattctccatcctcgatgaagttgaagcttcgttagatgatgttaatgtcaatcgatttggtgaattcttacggcattatgctagcgccacacaatttattgtcatcactcaccggcatggcacgatggttgcagcgaatgtattgtatggtgtcacgatgcaagaatcaggtgttagccgaattatggctgttagtctggatcaatcacagaaagaagcgatcaattaatgggactttttgatgcgatcaaaaaggcgtttaccggtgatgaaccggaaacgcctgaagaaaataaatatgatgagggcctagaaaaaagccgcagcagttttggtgaaaaactcaatgcactgtttgctaattttcgtagtgtcgacgaagacttttttgacaatcttgaagagatgctgattgagtctgatgtcggctttgaaacggcagttaagcttagtgacgacctgcgtgaagaagttaagcttaaaaatgccaaagaccctaaggccgtttcccgtgtgattgtggagaagctggtggatatgtatggcgatgctggtaaggatgaagacaatgccctacattttgctgaatcagggccaagcgtgttcctgtttgtcggcgtcaacggtgctggtaagacaacaacggtcggcaagcttgcccaccagctaaaggaagaaggcaagcgggttctgctagttgctgccgatacattccgtgctggcgccatccagcaattgcaagaatggggtcgccgggttgatgtacctgtcgttgccacgaaagaaggcggcgatccggccgcggtggtttttgatggcgtcaaacgcgccaaggatgagcaatttgatgttgtgctcgttgatacagctggccgattgcaaaacaaggtcaactggatgaatgagcttaacaaaatcaagcgggtcattgttcgcgaattgccggatgcaccacaggaagtcttgctggttctggatgcgacaaccggtcaaaatgcacttaatcaggctaaggagtttaatcaaacaactaaaatcactggaattgttttgacaaaacttgacggttcagggaaaggcggaattgtgttggcaatccgcaatgaactgcatgtaccggtcaaacttgtcggccttggtgaaaagatggacgacttacaagcttttgatccaaccaaatttgtggccggactatttaagggtttgattaaggtcgaagcttaattaaaatgatgaataacgaaaaagcgccatgctggcgaacaaccagtacgacgctttttttatgacattaagccgcttgcactttcttctcccggccaaggatgacctgtaggacaatcaagacaaggtaaccgatgagcagataggtgaaccatgcagatggctgcaccttacttgcaaaccagtattgttgccatgccgtattactcatgatccaagcgaataaccagcctagaaggccaagaatcgcattaatgatagcaaagaaccacaaattgccgttttcatggttgctcaggtaaacacatgagaagaccaaactccacagtccccaagcagcgagagcggcaaacacggcccagtaaataaaggttgagaccatattcttccctccaatttttcacatgttcagtgtaccacgaaactaggggaaactggaagagcgcgaacaggcgcggttagaaaccggagcataagtggtcttgaagctaaatggctgggttttggccatttagcttcaaggtccttatgtacaggtttctacggatgcaaatgtgtttttgaagcaattgcaagaaagcaatcttttcttcgaccctatttcttggctgttatccaccgatagtcgaagctggctttctacgctagcatttagctccgtggccatcaacctaattttttaagtaattgaccattttcagcgataccggtatccttatacaaggaccatgttcaagcggccggggaaactgagttgccggcaatcatgggattaaaggaatgacatgatggaaatcgaaaaaaattatcgcatgaactcgctgtttgagttttacgggccgttattgacggacaagcagcatgcctatctggcattatattacggtgatgattactcactcggcgagattgcaaccgagtttaacgtctcgcgtcaggccgtgtatgacaacattcgacgcaccgaggctagcttggaagagtatgaaaagaagttgcatcttttcgccaactatcaagcgcaaaatgaagctgtagatacgttagtgagttatgcacgtacacattatccagacgacaaggcattaagtaccttattagaacgagtcgcagatcaaaccgcgaaatagcagggggaaattatggcatttgaaggattatcagagcgactgcagaaggctttcagcggactgcggcgtaagggtaaggtcagtgaaagcgatattcgcgatgcaatgcgcgaaattcgtttagctttgttggaagccgacgtcaattttgatgttgtcaaaacatttattaaaaacgtccgcaccaaggcgcttggcgctgaagtgcttgaaagtttaaccccatcacagcagatcattaaaatcgtcaatgacgagttggtcaagacgatgggcgaggcggcagtgccactgaacaaggcaccacatattccgactgtcatcatgatggctggtttgcaaggggccgggaaaaccacaactgtcggtaagttgtccaagtatctgatggacaatgacagtgcgcggccattattgatcgctgctgacgtttaccggccagcagcgattgatcagttgcagactatcggcaaacagctcaacgtgccagttttcgaaatgggaaccgacgttgatccggtcgaaattgttcgccaagggttggcgactgccaaagaaaataagaatgattatgtactgatcgataccgccggccgattgcaaattgacgaaaagctcatgaacgagctgaaaaacatcaaggaactagcccatcctaacgacattttgcttgtcgttgatgccatgactgggcaagccgcggttgatattgctaaaggcttcaatgagcagctagatatcaccggtgttgtcctgaccaaactggacggggatactcgtggcggtgccgcactgtccattcgtgccgtcactggcaagccgatcaagttcattggtcaaggtgaaaagatggatgcgctggatgtcttctatcctgatcgcatggccaaccgaattctgggcatgggcgacatgctcaccttgattgacaaggcacagaagaattacgatgaaaaacaagccatggaaatggctgaaaaaattcgcgagaattcttttgacttcaatgattttctggatcaaatggatcagattagcaaaatgggtccgctggaagatatcatgaaaatgatcccaggaatggcgaacaacaaagccttggccaatgtcaaaatggatccgaaagacattgcccacatgaaggcgatagtttactcgatgacaccgcaagaacgcgaagatccagatctcctcaatccaagtcgacggcggcggttggctgcaggttctggccggccagtggttgaagtcaatcggatgattaagcagtttaatcaaagcaagcaaatgatgaaccagatgagcaaaggtaacatgaagggcctcgacggtctcatgggcggcggtgtttctggcaaacttggcaaaatggcgatgaactcaatggtccgcaaacaaaagaagaacaagaaacgtcggctgaaaaatgccaagcgtttccattcctaaaaatcaattttttcctgaccaaccaattaggaacaagaccgttgccaaacgacacattttacctgtgtaaagaaaaaaggctttacagcttaaaatatttttgctatgctatcaaggttgataaatgagcaggaggtggacttagtggcagttaaaattcgtttaaagcggatgggttcaaagcgtaagcctttctaccggatcgttgtagcagactcacgctccccgcgtgacggtcgtttcatcgaagccgtgggctattacaacccgttgactaatccagtcgatttgaaattaaatgaagaagatattttgaactggcttcaaaaaggcgcacaaccttcagatactgtacgtaacttgcttggtagcaagggcatcatgcagaagtatcacgaagcgcgctttgccaagaaataaaggcggttatcaatggtggatatcggcagcttgattcaagcaatcgtcaccccgttggttacacaaccagaagccgtcaaggtgactgcgcatgaaacaggtgattacatggcctttgatttggctgtggcacctgaagatgtcggccgcgtgatcggcaaacaaggtcgggttgcgcaagcgatccgaaccattgtatatagtgtcaaaagcccgtacaacaagcgggtgcggctcaatattttggatgcatcgcatgcagaataaaaagactgacgcataccgcgtcggtctttttattttgaaagagcgttcgctggcccggttagaaagcggagcataagtggccttgagcctaaatggctgggttttggcatttaagttcaaagtccttatgtggaggtttctgcgactgtgagcgcgtttagaggaggaagaacatgccagattattatgacatcggcaccattgtgaacacgcacggtattcgtggcgaagtacgcgtccttgtcacgacagatttcccggccgatcgttttaaagttggtaacactgtttatgtggcaacatcaccaaaaactgccttaacgattcaatccgtgcgagaacacaaggggctcactttgctgacctttaaggattacaccgatattaatcaagtcctgccatttaaaggcaagaaactacaagttaccgagacagcgttacaaccgctggacgagggaagttactattacaaagacattatcggcttaacggttattgatgaacaaggccagacgctcggcaaagtcaatgaaatcttaagcccgggtcccaatgacgtgtgggttattcctcgtagcggtaaaagcgatattttactgcctttcctaaaatccgttgtccagtccatcgacttagatcagaaagtggcgcatgtgatcgtgccggaagggttgattgacgatgcagattgatgttttaagtctttttccgaatatgtttgagccgttgcgcgaaagcatgatcggcaaggcgattgaacgcgagctacttaattttgatgtggtggattatcgcagctatagtcatgacaagcatcatcatgttgatgacacgccatatggtggcggtgcaggcatgttgttgaaaccagaaccgctatttgaggcgatggatggcgtcaacgagcgtcaccccggtccaaagcgagtcattttaatggacccagctggtaagaagttcaaccatcaagccgctcgagagttatcgcaagaagatcatctcgtcttcatctgtggccactacgaaggctacgatgaacgcatccgcacgcttgtcaccgatgaatattcattaggcgattacgttctcactggtggtgaactccctgctatggtcatgattgacgctattgtccgtctcctgccaggcgttctcggcaatgatgaaagtgcccacaccgatagcttcgagaacggtctcctcgagtatccgcaatacacccggcctccagaataccgggggatgaaagtgcccgaagtcctccaaaatggcaatcaccaacttatcgctcgctggcgccaaaaggaaagccttcgccgcacctatcttcgccgtccagatctcttgaaaaccattacgctcgatcaaactgctcaaaaactcttgcgagaagttaaaacagaagaagctactaaggcggcagaagcaagattgaagaatcaatcctgaacgctagcataccgtaaagattttcacctttacacgtccaaccagtcatggtaaacttattgactgtgatacgacgtcacacatcaacgacattccgctggtcgggatgattatgaatgtcggcaaaggagaaatacccatgaacccattgattcaagaaattaccaagaaacagttacgcgatgacattccagacttccgtcctggtgataacgtccgtgtccatgccaagatcgttgaaggcgaacgcgaacgtatccagctcttcgaaggcgttgttatcaagcgtcacggcgttggcatttccgctacttatacagtacgtaagatctcaaacggcgttggtgtggaacggacattcccgttacattcaccacgtgttgaaaagatcgaagttacccgtcacggccaagttcgtcgggcaaagctctactacctgcgcgcattacgtgggaaagcagctcgtatccgcgaaaagcgtcgttaatactggaaaaaggccggcaaacggtctttttttttgagcgtgagccagcccgcttagaaaccggtgtgtaaatggcctcggtcgtgatggccggcttttggtcattcaactgatgtccttacatgcaggtttctgggctggcaagcgcgttatggcgaagcatgagtaggatggaaaactcgtacacgcaaaaaagaagcacccacagactcgaggtgaaggctgatggatgatcagcttgtctacatcgtctactatgcggatcagtcggcaccgactgagttgttgaaagccttctcgtcagaacgacgagccgcagaatatgttgcgatgttaaagaatgcgccttatcctaagcatgaggcggcgaattatcgttacgccgcagtgcaactcaactgatgcacgccactgaaattgtaggaggtagcatgatggcagaacaaccaaaagaacgactggatcgtatcaatgaattagctaaaaaagatcgcagtgttggtttgacacccgaagagaaaatcgagcgtcaacaattgcgcgaggcttatttaaaggactttcgtgccggattgcgagatcaaatcgagcatacgcaggtctttgataaaaaaggcaaggagctcactagcaaaaaagttcagaagattcaacgtgaacacggttggcgaaaagattagtcttttcaacgtcaacctgctttagtacaatgaagaatgaaacttgaaggaggccgcacattgttaatcacagtacttgtggggatcattgccttactggtcggcttggcaggcggtttcttcggggcacgggcttacatgaagaagtattttcaggataatccgcctgtgaacgaagaaatgctgcgcacgatgatgatgcagatgggtcaaaaaccatctgctaagaaactgaaccagatgatggcgcaaatgaaacaagcccaacgtaacgctaagtaattgctaagaaagcgcgatgacaggaatcactttgtcatcgcgctttcgtgtcccagtgcgtttgtgctatgatgagagaacgttaattattttgagatgctgatggggaaaccatgagcaaaagggttaaggagcagtgtcgtgggaatctttagaaaattaggttggtattttaaacaagaatggcgccggtatttgctcggcgttacttttttgctgctcgtggccttggtgaatttgattccgccaaaagttattggggatcttgttgatgcgatgagcaaatctcggttaaccagcagtcacttggcgtggatgctggggttattgctgttttccggggtcgcccagtatttattccggtttggctggcgtaatgcgatctggggtggcgctgcgaagcttgaacgaacgttacgtacgcggctattttggcactttatgaaaatggacgccacgttttatcaaaaacaccgtactggggatttgatggcgcatgcgaccaatgacctgaacgcggtgcaaaacgttgccggggccggtattttaaccttgttcgactccatgattactggcggcaccaccatcattgcgatggtgttggtcgttgactggcggttgacgattgttgccattttgccaatgccattgttggcggtgatggcacgaaaactaggcacccgcttgcatgcggctttttctgaatcgcaggcggctttttcacgtttgaatgataaaacgcaggaaagtgtcagcggcattaaagtcattaaaacatttggccaggaagccgaagatacggcagattttaatcaaattgtcgaccataccgtgcaaattaatcggcgcgtgaatatgatcgatgccttatttgatccaacaacaagtctgatcatgggcttaacctatgtcatcacgatcatctatggcggctggcaggtcgttcatggacaaatcacgattggtcaactggtttcctttgtgacgtatgtgtcagcattagtgtggccgatgtttgcgattggccgattgtttaacattctagaacgtgggaatgccagttatgatcgggtcgatgaactgttgcaggaaaagtcgacgatccttgaagccaaagacgcgattacgacaccagcgcatggcgatattcgttatcaaatcaataaatttagttatccggatgatcaacaggtcgctttaagccgtgtccattttacgctgcctgaaggtcatacgctagggattgtcggcaaggtcggcgccgggaaaagcactatttttaagttgcttttacgcgagtttgataactacgatggcgtgattgagtttggcggccataatatcaaagattattcactggacgccttgttagattcgatcggttatgtgccacaggacaacttcttattctcgacaacagttgccgataacattcgcttttcagcgttcgaaaggggacaacaggatgttgagcaagcggctaaagaaagtgctgttcacgaggacattaaaaagtttgcggctggctatgacacgctggtgggtgaaaaaggagtcagtctgtcaggcggtcaaaagcaacggctgtctatcgcacgagcagtgatcaacgcgcctgaactcttgattctcgatgatgccttgtctgcagtggatgctaaaaccgaagaagaaattttagccaacatgaagcaggatcgtgcccataagacgacaatcattgctgctcatcgtctcagctcagtgatgcatgcggatgagattctcgtccttgaaaatggtcaggtgattgagcgcgggactcatgaacaattaattaccaagcatggctggtatgccgaaatgtgggcaaaacaagaaatggaagcagcggaagaaggtgaatcacttggcaagtaagggttatgagagtgcttggtcgaaaagtattccgattcgacaacaactcaaaattatgaagcggctgatggggtacacgagaccgtataagcggcagtttattggcgccattgtggcggctgcgttgcttgcaggcatgaacgttttgctaccattcattctccaacagttcatggatcgttatttggccaatcaaagtgcaacggttcagattctgctgctgtttgcagcactctatgcatttggcacgctcgttaaagctgttttccaattttttcagacatttttattcaacatgggcgcagagcgcggcttagaagatgctcgccgtcagctgtttgccaaactgcacacgttaggtatgcggtattttgatcaaacgccagctggttcgattgtgtcgcgtgtcaccaatgacacaatgacattttccgatttctggaacgtcattttagctgttatcgtcgggttattctcagttattagcagttttgccatcatgtttgcggccaatccaaagatagccttgatggtcgctgcctttctgcccattttgctcatagtggtctggtattacagcacgtacagttccaaggtttatcggcacatgcgtgaaaaactgtcagagttgaatacccaactgaacgaatctattgaaggcatcggcatcattcagcagtttcgtcaggaaaatcgcattagtcaagaattcgaagcgacgaatgaggaatatctggactcacgtaaggcgatgattcgcgtcaattctttgttgctgtcatcagtgattaacttgttatattcctttgcgttgattgcggttttatgggcttttggattgatttcgatgcatagttacgtggaagctggactgatctatgcgttcacgacttacacggcaaacttctttaatccgatggttaatatgatggataacctctcgtttttgcaggatggcgttgttgcgggtagccggatttttcgaattctcgacagtcaagagtatgcgccagcgcagcatcctgatgctcatgcgctgatccaacaaggcaaaatcgaattcctgcacgtcagttttgcttatgatggcaagcacgatattttgcatgatatcagcttcgttgccaatccgggggaaaccgtggccttggtcgggcacaccggttccggaaaaagctcgattatcaacgttatgatgcggttctacgagtttggtgaagggcagattttaattgatgacgtggacattcgcgactatcccatgccagaattgcggaaaaaattaggattagtattgcaggattcattcatgttctatggcgatatcagtagcaacattcgcttgttcaatgacagtatcaccgatgagcaagtgaaacaggcggctgagtttgtgcaagctgatcgctttatcgataaactaccaggcacctatcatgccaaggttattgaaggtggcactgagttttccagcggcgaacgacaactgatttcctttgcccgcacagtggtgactgacccgaaaattctcgtactggacgaagcgacggccaacattgatacggaaacagagtccgttattcaagaaggcttgcgtcggattcggcaagggcgaacgacaattgcaattgcccatcggctatcaacgattcaagatgccaacctgattttagttttgaatgcaggtcgaattgttgaacgcggcacgcacgacgaattgttatccaagcgtggccgatactatgaaatgtatcatctgcaaattggtgatcatgccgaataaatgcaaatcattaaaaagatccccagtaccatgtacaggcaattgcgcttgcatacggtaccggggatctttttcaatataaatcgaattgacatgattactcattggttttgtttttttgatcaatggctatatccttattggcctgatcctgtgttgcctttaacaattcaagttgctggcgggtttcagtgagttgattgaccatttcacccagaacctcaacggtgagtcgttggctctcaaataagttggggttgtcatctgaaataatgtgatccaactttgagtgtaacagtcggatttcttcttctgattttagattgacatgataatcatttttcgcttctaagcgatcatattccgccgctcgattttggctcatcataatgagtggtgcttgcaaagcagcgatcatgctcagaaataagttaagcaaaatgaaaggaaatggatcgaatttcgccccgaaaatgccaaccgtattcaggatcatccacacaatcataaaaccagaaaaaatgataatgaatggccaagatccggcatatttagcaaccgcatcggcaattcgctcgccaaaagtaatcgtcgcttccatgttgtcgtaaacattggtcagctgaaagttgtctttgaccaaagcctgcgacatttttcgattgattttatcatgcgcacgcgcatcttgccgttgttggcgccgcatgcgttctagccgataagtcagaaggtgaggattgcagatgaaactgttcttagtcgccttcggatagtcgtttctgatgatattggccaacttaggctccaaatcgcttaagaaaagaccatcgctaatcgcatagactttaccgtcaaccaagcaggttgcagtttgaggattgatcaagacttattttcctttcttaattcagcagattcattcaattcttttctcggcaacatgaccatggcggatgccatagctgaagtagattacaagtccgaaggcaaaccagatcagactcataatccaagtttcgacacttaactgggtcatcaatagcagacaaaacagaaaagaaataatcggcgtcactggatacccaggaaccttgaaaccttcgttgttaaaggcttgatgtcggcgcaatgggatgatgccaattgagacgaaggcaaaagcaattaaggtgccgatattgacgaggttgactagttgcgtgagtggcacaaggccgcccatgatcgcaatgatcaaaaccacagtccacaacgcattttcaggcagatggcctttaacgtgaccaaaccaaaggggtaacagtccgtcacggccaatcgcataaatcaaccttgatgagctgtagatcatggtgaccatcatggtgaacatgccagccaaggcgcctaccgaaatgataccgccaacgctacgcagatgcacggcgctcaaggcaaaagcaactggatcggccacatctaatttggtgaatggtaccatgccggtcaaaacaatcgcgactaacacatacaaaatggtggcaatgactaaagtgccgatgatgccgcgtggtagcgtatgttgcggatttttgacctctggtgctgaagcagacacggcgtcaaagccaagataggcaaagaaaaccatcgcagcaccggcaagtacaccttttgcaccaaatggcaaatatggatgccagttagctggctgaacgtaaaaaaagccaacgacaataaaaatggcaataatgagtaacttcactaataccattaaacgattaatcgccatggaggattgcataccgcgtgacaacatgacaccaatgataagaacaacaatgaccgcaatcagattcacataagtgccgtgactcggcgaaaacggaccggcaatggctgctggcaaggtgatgtgaaagccttgtagaagactagcgaaatacgcagaaaaactggttgaaaccgcggcaactgccagcatatattccaaaataagtgcccagccaataatccatccaaagacttgaccaaacacgagattgccgtaagcataagccgagccggcaactggcagagccgatgcgaattcggcataacacatagccgctagcgagcagacgatggcagccaaaataaaagcaatcgtgatcgctggtccgctggtagtcgccgctactgttccgggaagaataaagattcccgtacctatgacggcgccaatacctaacgcgatcaggtcacgcgttgttaaactgcgtgtcagtaaatgatcagcattgagtgcggcctgaacatcaggttttcgggtcatctgtttccaaagattcatgaatcaagctcactttctgtattgaataaaaaggaaaaaggttcgactagcgaaccttaaacttctccgtgttctttttcttccagatatttcttcttgtcaggcacatacttgtactctggattgatcgcgtaatcgagcgcgttaaagttttcctgcagcttgtcactaaaagcggcaagggcttcgtcggtcagcttacctttaggcggttcaacaggtgcaccgaagcgcacaatcgcaggcttacgtttaaataatgaccaaaaagaaccaggtccttgataaacagctgggacgatgggggctttggctagctttgcaatgagaatcgcgccgcccttcatatcagctgaatagcgagagccagttgggaaaatcatgagcgctttgtgttcgtcttttaacgcacgaaccggtactttaatcgcgctaggaccgggatgggcccgatcaactggaaaggcgcccactttgactaacagccagcgcattaaaggattcttgaataattcacttttgaccataaatgaaaaatgatgcggccacgaagccagtgctagaaaaacgggatcgagccacgtacggtgcggcgcaaccaaaacaaacggcccttcaggtagctgctgtttgttctgagtttgggcgtggccattgatgagccagattaaaccggcaatgatataacgcagaaaactataaaacatggcttattcttccttcatggataaactttgtggtaaattataccattgtatagcgcacttcggaggaaaaaggtgttcgtgatgtcattattaccaggcgaacgggttgatgttctggccagtcgcaacattaaaatcattcagagttcagccgttttttcattctcactggatgcggttcttttggccaacttcgcccaggtcaagcggcacagccggctggtcgatctggccgccgggaacggtgctgtcggactttttttggcaagggacacggaccagcaggtgaccatggttgagttacagccgcgactagctgatatggcgaggcgaagtgtcgcgctgaatcaacttcaaaatgtgactgttcaagtcggtgatttagctgatgccacccaaatggttgccaaagattcagtcgacatcgtcacctgcaatccaccttattttaaagtaagttcgcaaagtatcactaatccaaatgatcatttagccttggctcggcacgaattaacgactgattttgccaccgtagcacgcgtcagcgcggatttactgaaatatcaaggcaaagctttttatgttcatcggcctgaacgactggccgaactgctgacgactttgacagtggtcggcttggcgccgaaacggttgcagttcattcatccgcgggaagatcgcgaggcgaatatggtattaatcgaagccatcaaggccggtcgaccaaacgggattcgaattatcccaccattgatcgttcacgaagcggatggcacatactcgtcatcggtgaggaggttgctgaatggcgactaaaacgtattacttttacgtgttgttatgcgcagatggcagtttttatggcggcttcaccgatgatgtcaaagcgcgtgtggccacgcataatgcagggaaaggcgctaaatacaccgcccaacgacttccggtccgcttgttgtactacgaagcctttgcggacaagcacgatgctttatcagcagaatggcatttcaaacatcagagccggcatcgtaaggaagtctttttggaagatcatcaggttgattggcggtaaacaggattgatgtcaattaaatgatttaacgaatgatgcaatggtcaactggtgctcaggttctagaatagaaagcagagagtttgcggagccagctcggactaccggagactacccaccaagaatagaactgaagcaaagactaccttcttgcggttgcttcaaaaacgcgttctcaggcgcagaaacctgatcacgctccgaaacgcgatcaccaccccagaaaccggggtggttcacgctcttgtcaaagtcaagaaaagtctgtataatcttataagtgcgatatgcacaaaccacattgacgattgatcgtgagtggggtgcttcgattgaagtccacctgcgaggagacgccgtcaagaggaataaaaccataatggaggaacaaacgcatggcagtattaagcatgaaacagcttcttgaagctggtgtacattttggtcatcagacccgtcgttggaaccctaagatgaagccgtatatctttacggaacgtaatggcatctacatcatcgatctgcaaaagaccgttaagatgatcgacgacgcttacaattttgttaaagaagaagctcaaaacggtggtgtcttcttgttcgttgggaccaagaaacaggcacaagacgcaattgctgaagaagcaactcgtgccggtcaatactatgtcaaccatcgttggttgggtggtactttgactaactggaacacgatccagactcggatcaagcgtctcaaggatatcaagaagatggccacagatggcacctttgatgttcttcctaagaaggaagtttctcttcttaagaagcaacaagataagcttgagaagttcctgggcggtatcgaagacatgcctcgcattccagacgtgttgttcatcgttgacccacgcaaggaaaagattgctgttcaggaagcacaaaaactgaacattccgatcgttgcgatggttgatactaacaccgaccctgacgacattgacgtgatcattccttctaacgacgatgctatccgtgccgttcgtctgattacttctaagatggcagatgctatcattgaaggcaatcagggtgaagatcaagacgacgctcaggaacaacaagtagctgccgacaaaaaggctgattccatggaagatattgtggaagccgttgaaggcgacaacaaaagtgcaaaataattaattaaacaataggctgtctgagggtttcgcatactgcaagatctgcaggcagccttttttaaatcaaggaggatcagatccatggctcaaattactgctgcacaagttaaggaattacgcgatcggacacaagtcggcatgatggatgctaaaaaggcattggttgcggctgatggcgatatggacaaagctattgatgttttgcgtgaaaagggcttggccaaggctgctaaaaagagcggcaatattgccgctgaaggtttagccgaaattgcggttaacggtaataccgcagcaattatcgaagttaactccgaaacagactttgttgcttcaaatgatcagttcaaggactatgttaataatgttgctgcagcgattgcggctaataagccagccgaccttgaagctgctaaggcaaccaagatgagtgatggccagacagttgacgaaggtgcaattgccttaaccacagttatcggcgaaaagatcagcctgcgtcgtttccaagttgttgaaaagacagacaacgaacactttggcaagtatctgcacaatggtggccaaatcgcagccttgaccgttatcgaaggcgcagatgacgacactgccaaagatgtcgcgatgcatgttgctgccatcaatcctgaatatttggatcggaccaaggtaccggcagaagaattgaagcatcaaaccgatatctttacagaagaaaccaaaaacgaaggcaagccagaaaagatcgtgccacgtatcgttgaaggccgtgttaacaaatggctcggcgaaatttcccttgtggaccaagaattcgtcaaggatcctgaccaaaccgttgctaagtacgttgctgcaaaaggcggcaaggtgaagggcttcgttcgttatgaagtcggcgaaggtattgaaaagaaacaagaaaactttgctgatgaagtaatggatcagattaagggttaattgcttgaagggacactgtcaactcggcagcgtccctttttacttatcttgaaaaattaaaaacgtccgttcttttccgcgctatacaccgtgtgactgcgtgtttttggggtaccctgatccgtggtgagggaaaataacggtccgcaattctcaatttcaaatcagcttctttccgcagaaaccctgcgactatggtaaaatagtgccagcaaccaacggaggtataggatacatggtcaaatataaccggatcgtattaaaaatcagcggtgaagcgctggcaggtgaggctggcttcggcatcaagccagcggtcattgcgacgatcggaaagcaaattaaagaagtgcacgaacttggggttcaaattgccattgtttgtggcggcggcaacatctggcgcggcgaaacaggcgccgaaatgggaatggaacgtgcgcaggccgattacatgggcatgttggcaacggtcatgaatgcattagcattgcaggacaacttggaaagtcaaggcgttccgactcgcgttcaaacatccattgaaatgcggcaaattgccgaaccatatattcggcgcaaggcaatccgtcatttagaaaaaggtcgcgtggttatttttgctggtggtaccgggaatccgtactttagcacggacacaaccgctgccttacgcgccgcagaaattggcgctgatgtcattctgatggcgaaaaacaatgttgatggggtttactctgctgatccgaataaggatacgcatgcagtgaagtacgaaagtctgacccacatggacattatcaataaggatctcaaagtcatggattcaacagccagcaccttgtccatggacaacgacatcgatttggtcgtctttaacctcaatgagccaggcaacatcaaacgcgtggttgaaggccagaagattggcacaacaatcgaagggagaagctaatggcaaatcaaatcattgatcaagcaaaagtaaatatgggtaaaactgaagaatcgttgcaacgcgaactcggcaatattcgagcaggccgagcaaacgccagtctgttgaatcagattacggtggaatattatggtgcaccgacaccgctcaaccaaatggcggccattacgattccagagccgcgtgttctgcaagtgagcccatatgacaagtcctcattaaagaacatcgaaaccgcgcttaatgccagtgatctaggcatcaacccagcaaacgatggcgatgtcattcggttggtcattccacaattaaccggcgaacggcgtaaagaaattgcctaagaagtcggcaaatactctgaaagcgccaaaatcgcggtccgcaacattcgccgtgaaggtctcgacaaactcaagcgccaagaaaaagacggcgacatcaccgaagacgacttgcatcgcttagaaaaagacatgcaaaaggctactgatgacgccaccaagcgcatcgatgaaatcgctgcagctaaagaaaaagaaattactgaagtttaatttcagcgaccaacaaaaaggctgggacataattttcagccaaacaataaaaaggaacaattttcgatttgaaaaattgttcctttttggtttctcatgaaatatttactgcgattttaaagaccgtagtgccaaggcggagcaatcataggccagatggggctcagccgtgcaaacaacacagcgacgggctgtggagctgatgttgttaggcgacttcgagaccggtttttgggctcgaagcgccgtctccgctctagctccgcgtcgccaccccagctggccggaaattgcggagtttggcacggcaagcatattttatgcctagaaccttccgacgattaatcagcatttaatggtcacaagtcttgcgaggaaattatggctcacccttttcctataccctaatggcacccgttgtccagatccgtgttactaataaaatatccccacttatacccgcgctagttcgcgctctgcctctttttctgctacaatcgttaaagacatttggtgcaaggacaccatcgacgttatgaggaggcaccgattttggccacatccaaggcttctaaagttaaacttgatcccgcgcgaattcccgctcatattgcgatcatcatggacggcaatggccggtgggcgaaacgccgctttttaccgcgtgttgccggtcataaacaaggcatgcaaaatgtcaaaacgatcaccaaagctgccagtcgcttaggggttaaagttttgaccttgtatgctttttcaacggaaaactggaagcggccgggttcagaggtcaattacctcatgcgcctgccggttgattttttcaatgacttcatgcctgacttgatcaaggaaaatgttaaagttgaggtgatgggagaactggacgacttgccaccgcaaacgcgtcaagcaagcgaaaaagccatggctgacaccgccaataataccggcatgattcttaactttgcattgaattatggcggacgtgacgagcttgtccatgcagcacaaaagctcgctaaacaagttcaggaaggcgagttatctccggatgatattgatgaccgtcactttgccaatgcgttgatgaccggatttcttggcgacctagctgatccggacttattgattcgcaccagcggcgaactgcgaatttcaaatttcttgctttggcagattgcttacagtgagttggtattcgtggatgattattggccagacttttcgcctgcagctctagaagcagcgattgctgaatatcaggcacgggatcgccgatttggcggattaaaaaaataaaacagctattttttggtaatggaggatttattacgatgaaacaacgggtcattacggcagtcgttgccttggctatctttataccgattttgattgctggtggcggttggattgatattgccggtgcagttttagcagtgatcgctttgtcagaagtgtttatcatgcggaaacgaattctggtttcggctgattatctaatcgctgctcttggtgtgctggtggtagttctgcctaacagttttttccgctggctgcctgcttttcttggacgaatcgatttaatatatattgcggtagcgctgttgctattcctgaccgtcacgaccaagaataaaactacctttgacgacattggtgtgtcagtattgtccttcttttatattggcactgggtttcattatctgattagtgttcgtaatgatgctggcttggacaccttgatgtttgcgttgctgattgtgtggctgacggacactggggcttatatgattggccgtaagttgggccgtcataagttgtggccggctatcagtcctaataaaaccatcgaaggcagtcttggcgggattgcactggcgttgatcaccgccgccatctatctgatgttcttcccgcagtactataccttctggccgatgatggggatcgccctatttttgtccgttatcggtcagattggggatctaatcgaatctgctttgaaacgcttctatggcgtcaaagattccggcaagattcttccagggcacggtgggattctcgaccgttttgacagtttgttgctggttttgccgatgctgcatctgtttggcattgtctaaccattaaggagattttatgaccactatcatcgcctttatcgttatcttctgcattcttgtggtagttcacgagtttggccatttttactttgcaaaacgcagcggcattctagtccgggaattttcgatcggtatgggcccgaagctgtgggcgtcgcacaagaacaatacgacctacacgctgcggttgctaccacttggcggatacgtccgcatggctggctggcaagatgaggaggacgagattaagcccgggacgatgctgagcctgattcttaacgatcaaggcaaggttgtccggatcaatgccagtgacaaaacgactttggccggtgggatgccggttcaagtgagccgcgtcgatttggtcaaagatctggtgattgaaggttatccgaacggggacgaaacaaccttgcaaacttggcaggttgaccacgatgcgacgatcattgaagaagacggaaccgaggttcagatcgcgccagaagacgttcagtttcaaaacgccccggtttggcgccggttattggtcaacttcgccggtccgatgaataacttcttactcgcgattctagcttttatgatttacggtctgttttttggtgttcaggtgctcaataccaaccaaatcggaacagttgtgccaggttatccagccgcagaagctggtcttaagtccaatgcgacggtgcaaacgattgacggtcaaaaaatgtcatcattcacggatctttcaaagatcgtcagtaaaaatgccggtaaatcagtgacatttaccgtgaaggaaaacggtaaaagcaagaacatcgtgatcaagccaaataaagaaggcaagatcggggttgaagcacacatcgataagtccccagcaaacgccattccttttggcttttctcaaacttggaatttggctgtccgcacttgggacgtgctcaaatccatggtgaccggcggtttttcactcaataaactggctggcccggttggtatttataccatgacgagtcaaagtgccaaagggggtattcaaggcttgctattctttatgggttacttgagtctcggcttagggattaccaatttgttgccgattccagtgcttgatggtggtaaaattcttttgaacctgatcgaaattattcgccgtaagccattaaaaccggaaacggaaggcgttgtgaccatgattggcttgggcctgatggttctattaatgctagcggtcacaatcaacgatatcatgcgctacttttaaaatattctagctttggaggctgacatgaaacaatcacggatgtttattcccacagaaaaagaagtaccgagctcagcggaggccaagtcgcataagatgatgttgcggtctggctttgtgcgtcagattcaagcaggcgtttatgcttatttaccacttgcggaacgcgttttagcacggattgaagccattattgacgatgaaatgaccaaaatcgatgctgttaaaatgaaaatgcctgtcctcttgccagctgaattatgggaagaatccggacgttatgaaacttacggtcctaatttatttaaattgaagaatcgtcaggaccggaaaatgatcttaggcccgacgcacgaagaaaccttcaccgatttggtccgtaatgaattaaaatcctacaagcggatgccattggtgttgtatcaaattcaggataagtttcgtgatgaagatcgtccgcgttatggtgttttacgtggtcgggaattcatcatgcaagatgcttattcctttactagtaatggccaggatttggataccatttatcggcagatggaacatgcttataccaatatctttgatcggttaggcttgcgctatcggtcgatcatcggtgacggcggtgccatgggtggtaaggattcaaaagaattttccgcgattgctgatattggtgaagatacgattgtttattcagatagttctgactatgcagcgaaccttgaaatggcaaccagcatggcgttgccaaaacaaggggtcgaagaacaggcagcgctcgaacctgttgatactaaggatgccaaaacgatcgctgaagtcgctgaattcttgaaggtaccagaaaagaaattgatcaaggctgtccttttcatggctgatggcgcaccggtattggccttggttcgtggtgactatgaagtcaatccgactaagttaaagaatttgttgaatgctgactttcttgatatggcgacacctgaacaagtgcagaccgtgatgcacgcagaagtcggtaatattgggccggtaaatgtcgataaagacgtgcggatcattgccgacaatagtctaagcgacctgactaatcttgtcgcaggggctaataaagcgcacacgcatttgcttaacgtcaattttgatcgtgatgttaccccggaaacctatgccgatattcgatttgtgactgaaggtgaagtttctccggatggccaaggtgtcctgaagtttacacgcgggattgaaattggccacatcttcaaattaggaacccgatacacggaaactatgggagctaattttcttgacgagaatggccgcagtcaaccgatcatcatgggttcatatgggattggtgtttcccgtttgctttctgcgattgcggaacagcaagccgatgaacatgggctagtttggccaaccacgattgccccgtttgatattcatctcattccagttaatctgaagcgcgaagaacaaaagtcactgacggcttcgattgaaacaatgctagaagatgcaggttacagcgttttggttgatgatcgtaacgaacgcccaggggttaagttcgcagattctgatttgattggtgtaccattacgtgtcacggtcggtaaaaaagcggttgacgagattgttgaactgaaactgcgtaaaaccggcgagacaatcgaagttaaaaaagaagaattgatcagctcaatcaagattctgatgggtcagctgaataagcaagaacaagataattgatagactgaggagacgactgaagcagctgctttggtcgtttcctgccatctaagaggggggcacaatttggctttatcccaacatgagatgtttgaaaaattattggatcaactcgacttggcggcagatgtccgacaagatccttcgttgaccagcggcacggtacaaaacgtgaccattcatgaacaatctcggcgttatgatttcactttggggtttgacgcgatcctgccatttcagattttcaatgcaattgcgaccaagttgccgttagtgtttcaacagattgctgcgactgatttatcggtggaggtaacccagccaaccattactgacgagttattagctcaatattggcagtacgtcgtgacccatgccgaaattgggacaggaattgttcgcgagttatgtgaaaaacaagtgccaacacttgagaatgatcgtgctgtgatcaaaaccgaaaatgagcaaattcggcaatacttgattcagcaagggctcggtaagctcgaagaaacttatcgtcaggttggcttctctggcttacggatgcaagccgaagttgatgaggaacaagcagcccaatcgatggcggcttttcaggctcaaagagctgaagaaaccgctaaaatggccaaggctgctgcggaagtagtgaaccagcaagcggctaaacaaaaacaagttcaaactgacggcccagttcaaatggggcggcagatgaaaatgaccgatgccccgcaacaaatggtgaccatcacgcaagaggaacgttcagtgacggttgaaggctatgtttttgatgttgaggttcgggaactgcggtctaagcggcagttactaattttcaaagtgactgactatagctccagcttcattgcaaaaaaattcagcaatggtccagaagatgaagccatgtttgcgcggattcaaaaaggtcagtggctacgcgtgcgaggcagtgttcaagaggacaactattcccgtgagctgacgattaatgcacaggatattcaaactgtctcccatccggacccaaccgatgatgctgaaggtgagaaacgcgttgaattacatctgcacaccaatatgagtcaaatggacgctatgaatccaattagcgactatgtgaagcgggctaaagagtgggggcataaggcgattgctgtcactgaccatgcaggtttgcaggcttatccagaggcacattcagccgctgtcaaagccggtttaaaaatgctttatggcgtcgagataaacttagttgatgatggcacgccggttgcttaccgagcagatgagccgcgtgatttagccagtgctgaatatgtggtttttgacgttgaaaccactggcttatcagcggtttacgacaaagtgattgaattggctgccgtcaaaatgaaagacggcaaagtgattgatcaattcgaagaaatgatcgatccgggtttcccactttctgaactgacaattaatttgacacatatcactgatgacatggtgcatggatcaaagtctgaagtcgacgttttcaaattgtttcagcagttttgcgatggtgccattatggtgggtcataatgtgactttcgatgttggctttttggataatggttacgagcggcatggattggcagacattgacaatccggtcatcgatactttggaattgtcgcggatgctgcatccagaacggaagaatcacaaactcgataccttggcgaagcagtacaaagtcagcctagaacatcatcatcgcgctaatgccgatgccgaggcaactggttatctgctttatgctttggaaaaagaagcggccaagatgtatggcatgacgaccctcaatcagttgaacgatcgggttggggcgggggatgcctataaagctgcacggccaagtcacgcgattgtttttgcgaaaacacaagcgggattgaaaaaccttttcaaattagtatcgttgtctaatgttaagtacttctatcgggtcccacgggtgccacgcagtcagctgcaaaaactgcgtgaaggcttgttagtcggttcggcttgttccagcggcgaagttttcacagcaatgatgcaaaaaggcgaagcggaggcccgcgccaaagcgtcattctatgattatctagaagtgcaaccattacctgtctatcaacctttgatcgaggctggtttgatcaaaggcgaggcacatctaaaagatattattcaaaaaatcatcaaaatcggatcggaactggaaaaaccagtcgtagcgacaggcgacgcccattatttggatcaacatgacgcgatttatcgacagattctgattcatagtcaaggcggagccaatccactcaatcgccacagtttgccagatgtgcattttcgttcgacaagtgagatgctgaccgattttagttggcttggggaagagaaggtccacgagctggtagttgataattctaacttgattgccaactgggttgacgatgatattacgccggtgaaggataagctttacacacctgaagtacctggggtggaagaaaatctgaaacatgacgtgatgaccacggcgcatgaattgtatggcgaccctttaccagacattgtggcgcagcgactcgataaagaactaaaaagtatcatcggtaacgggttctctgttatttacaacatcgcgcaacggctggttttgaagtccaataaagacggatacttggttggctctcgaggatcagttgggtccagtctagccgcaacgatggccggcattactgaggttaatcctctgccgccgcattatcgttgtcctaactgtcaatacagcgaattcttcactcatggcgaaatcgggtccggttttgatttgccagataaacaatgccctaaatgcggcgctgatttgcataaagatggccacgatattccgtttgaaactttcttaggcttccacggtgataaagtgccggatattgatctgaatttctcgggtgactatcagccaattgcacataactatatcaaagtcatgttcggtgaggatcatagtttccgtgctgggaccattggcacggttgcagacaaaacggcgtatggttatgttaaagcgtatgaacgtgacacgggacagcaactgcgcggtgccgagattgatcggctggcgcaaggtgacacgggggttaaacgtaccactgggcaacacccggcaggtattttgatcgtgcccgctgacatggatatttatgatttcacaccgattcagtacccagccgatgatcaaaatgctgcctggatgaccacgcactttgatttccattccatccatgacaatattttgaaaatggacgtgctggggcatgatgacccgacgatgatccggatgctgcaagatttgtccggggttgagccaaaatcaatcccaacggacgatcctggcgtcatggcgcttttttccggcaccaagagtctgggtgtcacgccggaacagattaactcgaaaatggggacgttaggcattccggaatttgggacgcgttttgttcgcggaatgcttgaggaaaccaagccaacaactttcagcgaactgttacagatttccggtttgtctcacgggaccgatgtttggttaggtaacgctgaagaactgattaagcaaggcattgtcacgcttaaagaagttattggttgtcgtgacaacattatgatggacttgattcactggggcatggaagattcaatggcctttaacatcatggaacatgtgcgtaaaggtcgcggtattccagatgactggcaaaaggcaatgcgtgaaaacgagaacgtgcctgattggtatatcgagtcctgcttaaagatcaagtacatgtttccgaaagcacatgcgaccgcctatatcttaatggcgttacgaattgcttggttcaaggtccattacccgttgatctattacacggcatatttctcggttcgagctgaagactttgatcttgccgccatgagtcatggcaaggaagcagtcaaagcggccatgaaggagattaccgataagggcatggatgcctctaccaaggaaaagcagttgttgacggttttggaaatcgccaatgaatgtctcgaacgcggctttaagattaaaatgattgatgtcacgaagtcggattcgcacaatttcttgattcaggatgatcacacgattctggcaccattccgtgctgttccgggcctgggcgataacgttgccaagcaaatcgtggccgctcgtgaagaaaaaccattcctgtccaaggaagatctggctaatcgtggtaaggtttcgaaaacgttgattgattatatgacaacaaaccatgtcttggatgacttgccagacgaaaaccaattatcgctatttgacggtttattctaggcttaatgcggtttcatgcaaactgtcatgaatgtttagaaaaatgcgatgaattggcttacaggcttactagcacaaaggtctgctagtttgcaagtagtaacaatctatggtattgtatcaatagtaatgtaaggttctggcggtgagtgagcagcgatgctcactctttttattggcgaacgtcaccatgttcgcatctggagacgtcagaagtgttagtcttgaatgagaaagtaaaggaggcggtggcttgagtacgcaatcggttgttgaaaccgtgaccgctttggtcaaaccgattttggacgaccatcatttttgcctcacggatgtcgagtttgtgaaggaaggcggcgggtggtacctgcgtgtgtatattgacaagacaggcggcattacactggacgaatgtgtgatggtcagtgaagccttgtcagaaaagctagatgccatggatcccgatccaatcccgcagcaatatttccttgaggtttcaagtcctggtgcagaacggcccttgaaacatgaaactgattatgaacaagcagttggcgactatatccatgtctctttattcaagaaactggacggcaagaaggtttttgaagggactttaaaggagctattgcctgaccagttgacattgacggtcaaagataatagccgcaagttcgatcaggtcattgaccggcagttgatcgcttcagcgcggttggcgatcgagttctagtggaggtaagaaaagcatgtcaaaggaaatgatccaagcacttgacgctcttgagcaagaaaagggtgtcaaaaaagaggtcgtgattgaagctttggaagccgctttggtttccgcttacaagcgcaattacaaccaagcgcaaaatgtggacgtcgaatttgatcctaagcaaggcgacattcacatttatgcggtgaaggaagttactgacgaagttttcgattcacggctggaagtcagcttgaaagaagcgctggcgattaacaaggcttatgaaatcggtgaccaaatcaaatttgaggtcacaccaaaagacttcgggcgtatcgctgcacaaactgctaagcaggttattatgcagcgggttcgtgaagctgagcgcagtattgtttatgacgaatattcacagtatgaagatgagattcttcaaggggtcgttgaacgccgagataatcggttcatctacgtcaacttgggtaaaatcgaagcggtcttaggccgtcaagatcagatgcctaacgagaagtatgaagcccatgatcgcatcaaggtttatgtgaccaaggttgaaaacacgagcaagggtccgcaagttttcgttagtcgaacacatccgggtctggttaagcggttgtttgaacaggaagtgccagaaatttttgacggcacagtagaaattgtcaacattgctcgtgaagcgggcgatcggactaaaatcgctgtgcgatcaaccaatgacgctgttgatgctgtcggcacgactgttggtccgcgtggtgcgcgcgttcaagccgtcgttaacgagctttcaggtgagaacatggatgttgtgcaatgggaggaagacccagcggattacattgccaacgccttgaatccggctcaggttatcgcggttcaattcaatgatgaggccaatgatcgttccgctactgtgattgtgccggattaccagttgtccttggcaattggtaagaagggacaaaatgcgcgacttgctgccaagctgaccggctataagattgacatcaagcctgaatctgaagttgaatttgttgatgatgatgaattgtctgaagcagaggctgaagcggctgctgaaactaacgacaacgcagatgcagcaactgacgctgagacaacgcgtgacagtgatgccgctgcagcagatgatgccgacgacgccaaaaccgcctcagatgcaccagattcagctgatcaagcgcctgtaacgccgagtgcaaccgatcatccggcgcaagcttaaggaggcgagccatgaaaaagcgtaagattccaatgcgcaaggacttgctaagcaatcagatgatgccgaaaaaagaactggttcgcatcgtgaagaacaaagaaaatgttgtcgccatcgatcctaccggcaaagctgctggtcgcggtgcctatgtggcacttgatccagccgctgtgaaagcagcaaagggtaagaagctgattgacgcagcatttggaatcacgattgaaccaaccttttatgatgacctattcgcgtatgtcgatcatcaaaaggctcgtcaagaactattcggcaagtgacgatgcaaaaacaagccgtattgaatttattgggtttggcccgccgcgccagtcgcttagtcaccggagataatctggtcttaggagcgattcgctcgcgtgaagctaaattggtttatgttgccaatgatgctagtgccaacacccgcaagaagttttcggataaaagcagctattatgaagttcctttggttacagagttttccaaaatggaactatcgcaggccatcggcagtgatcgctcgatcattgccgttgtggatgcgggcttcgctaagaagatgcaacagctgctcacctaaattgcagggagcgtgaagaaatgggcaaaaaacgcgtttatgaatttgccaaagaaatgcacgtcgataataaagacgtcatcgatatcgcgaagaacttgggtatcgaagtaaaaaatcacatgtcctcgatcgatcaagatcaggaagctaagatcaaaggtatgttaagcaagcagtcagctggcaaagcaccgtcatcacaggcagcaaagacacctgctaaagcagccaagacgagttcagcggcacacaaagaggctgctaagaagccagtcgctgccagtgccaagtcaaacgatcatgctgatgctgctgagcattcgcaaaaaaacgcaaaacctgctgctaagcaagaaaacaagccggcgcggtcaaataagacctctgacggcaaaatcatcttgagcaagtcaacaattttgcgaccacgcagcacacaaacggcgcataccaacacgaatcacaatcgtggcggcaatacagccagcgctaacaatacggctaatggccggaattcaaatcgctcaaacaacaataataacaaccgttctgcgaacaatgctaatcgttccggtaacaataatcggtctaacgaacgtaaccgtagtgaccgcaatcgtcggttcgataaccaacgcgtcacagggccaatgccgcgtgctggccgtcccacggcagctaatggcaatccccgtcctgtggcaggcaacggtggcaagtttgttaaaccagcgtctgaacgtcagcagccaaaacgtcaggaagcggtcaaaccggcaaatgcagcgagtaaacggtctgagcaacctcggacggaacggccgcgcactgagcagccagctgcaacaaccaatcaacgctttacgaaaccggctccagttccagcggcggcagcaccaaaaccggcaagtgccggcagccaagacaatcgcaatagtcggcgtggcggcgggaacagtaattttggccgcagcaacagttatgggaatcgtaacgggtttaaccgtaacaaccggcgcaacaagaagaacaagcgccggcaacaaagcgcaccgaagaaggaaatgccgcagcgtaaagagcggccattaccagaaacactgatttatgaagttgggatgaatgcgcaggatcttggtaagattttgcatcgcgaaccagctgaattgattaagaagctcttcatgttgggtgtgatggttaaccaaaaccaaagcctcgacaaagataccatcgaattgttggctaccgattacgggattgacgcccaagaaaaggttcacgaagatatttccgacttggacaaagtgttcgaagaagaaaacaagaaccaagacaacttacagccacggccgccagttgttactatcatgggtcacgttgatcatgggaagacaaccttgctcgataagctgcgtcacacacatgtgactgaaggcgaagccggcgggattacccagcatatcggtgcttatcaagttaaactgcgtgatcggttaattacgttcttggatacacctgggcatgcggccttcactaacatgcgggcgcgtggtgcggacatcaccgacattgttgtgctggtggttgccgctgatgatggtgtgatgccgcagacgattgaagcgattcatcatgcgcaggcagccaaggcaccgatcatcgttgcagttaacaagatcgataagccaggcgctaacccagaccacgtcatggaacaattgacggaatatgggttgattcctgaagactggggcggcgacacgattttcgtcaaaatctcagctaaatttggcaagaacatcgatgaattgttggaaatgattttacttgaagccgatgtgctcgaactcaaagctaaccctgatcaaaaagcggttggtactgtgatcgaagcacgtttggataagggtaagggtcctgttgctaccgtactggttcaacaaggtacgctgcatacaggtgatccaatcgttgtcgggaatactttcggccgcgtccgtgccatgactaatgatcatggccggcgggtcaaagatgctttgccatcaatgcctgttgaaatcactggtatcaacgatgtgccacaatcggctgacaagtttgttgtctttgccgatgaacgcaccgcgcgtgctgctggtgaagaacgggccaagcgggcacaggaagaagaacgtaagaacaccaaccatgtcacgttggataatctttttgaaacaatgaaggaaggtcagctgaaagaagttgacgtcatcatcaaggccgatgtgcaaggctcagttgaagcgttggctggcagtcttgagaaaatcgaagttaagggtgttcgggtgaatattattcatcaggccgttggcgcgattaacgaaagtgacgttacccttgcagccgcaagtaacgcgatcatcattggctttaacgttcgcccaactgcgctggcaaaagcccaagcagaacaagacgatgttgatattcggttgcatagtgtcatttacaaggcgatcgaagaagtcgaagctgcgatgaagggtatgctggaaccaacatatgaagaaaaggtgatcggaacagtgactgttcgcgaaacaattccggtttctaaggttggtaccgttgtcggtggttatgtcgattccggctatattacacgcgacgctggtgtccgtctcgttcgcgatggcatcgtcaagtacgaaggtaaactcggctccctgcgtcgctttaaagacgatgtcaaggaagtccgtcaaggctttgaacttggcctgaccattgagaactacaacgacattaaagtcgatgatcaaattgaagccttcacaatggaacaggttccagtgaagtaactaacccaaacgtatctcaggatttaatgataccgactgttttgaaggaggtaggcagatatgaaacatcgtatcggtcgagttgagactcagatccaacgtgaagttgacgatatcttgttgaaagatgtcaacgatccgcgggttaaaggcgtgacgattaccggagtcaaactgaccggtgatctgcaacatgccaccattttctacagcattctcgatgatgcacctgacaaagtcgaagcagcccaaaccggtctggacaaggccagtggactcattcgccgcgaagtcgggcagcgtatccggttattcaaagtaccggaaatcgagtttgctcaagacaaatccgttcaatacggcgcacgcattgatcaactgatcaatgaagtacgacggaagaatcttgaataagcaccatttaaaagaaggatctgactgctgctagtggtcaggtctttttttatcatcgataactgatactgtgtcagcaataggaggattgtgtatccggtttgaattttgaaatcgaatgcggagccggctcgtagctgcggtgttcaaggagccttacagagacagtccaaagtcgcggtgcaaaaaaagatttgtggttcttacctcatatcccctagacaatcttttgaatctaaaccgtaatagaaccatcaattcaaaccttcagactttaccgcccaacagctttaggtttttaagcatgcacggtataataataatcattgagaaaggaaggatcacgatcaagttactaggtgccttatacggaccattcttctcagcgcataattggcaactggcattttctgttagcggcctcgtgaccattttcagcttgatcttgctagaatgcatgctatcagtcgacaacgctgtcgtgctcgctgcacaaaccgagcagctcaaggtcgaatcagaacgaaaaaaagctctgatgtacggtatgggtggtgcatacatattccgcttcattgctatcggactaggtacttacttattgcaattctggccgatcaaagcgattggtgcggcgtatcttgtctggatgagtgcgagttatttttatgaagtgcgccatccaaaaaatcagagaggggcgcatggaaaacgacctcacgggctttgggggacagtcattcaaattgagagtctcgatatcgtattttcggttgattcaattttggcggccttggcagtgtccagcaatccggtgattgttttgattggcggttgtctcggtatctttgctatgcggctggtggcgcaggtcatcaccacctttattgatcgtgttccggaacttgaaaccgcagcttatattcttgtaggtctcattgccattaagctaggtctcagtctgccaatgattgatgtgaaaacgccagactggcttttttcggtcctagtggtgcttgttttcatctgggccggctggcgacatgtcgagcatgaaaaacatcatcatagtatttataaaaaatcaaaaccatgaaaggaactgccatgaacgggattttgccgttatataaacccactggcatgaccagtgctgatgcggtgtatcatgcccgcaagattcttggtatcaaaaaaattggccattccggtacccttgatcccaatgtggacggcgtgctgccgctggcgattggtgcaggcactaaagcggtgccgcaattaatggccagtgggaaagtctacaccggagaaatcacgttaggttttgcgacgacaaccgaggatttggatggggaagttgttgataaaacgcctttaacgcagccgtttacagctgatcagttggatgctgcattgactgcgtggacaggaaacatcacacagattccgccgatgttttcggcggtcaaagtcaatggtcaccggctttacgaatatgcgcgcgccggtgaaactgtgaagcggccagaacgacaggccacggtgtcacagtttacacgtaccgatgaaccggttttttcagccactgatggcacccagcgttttcggtttgaggtccatgtttctaaaggaacctacattagaacactagcagtggatgttggcaaaacgctgggagttgctgcggtgatgagtcaattgacgcgagtaaaaagcggcgggtttacgttgaagcaggcggttagcattgagcaattgaaggcgcatgccgcggcaggtactttagccgatgtgattcaaccgattgatattgcttttgccgatctgcctcaagttgatttgaccgtagaacaatttgaggcaatcagtcatggccgctttttatcgctcgatcagcagactccgcgcgttcgtctgcattttgcaggcgttcttaaggctatctatcgccgagaagacgatcagtatcggccagatttaatgtttttagctaatgaaaagaatgtgtgaaaatttatgaaaacaattgatattcagccgccattgcaggtgtccgcggccccgccacagcccatcgtcttgaccttgggcttctttgacggcgtccatcgcggccatcaagcggtgattaaaaccggcaagaagatcgctttagcaaaaaagataccgttggcggtgatgacgttcaatattcatccagccgtcgtttatcatggggtttccgaaaccgatattcggtatttatccactcgtgaagagaaaatcaaaattatgcagtcactgggcgtggactatttgtatgtggttcactttaccccagatttcgctgcgctgacgccgcaagcatttgtcgatcagtatttggtcggtctgaaggcggatacggtagttgcaggttttgactatacttatggcaagcgggatgttgcatctatggctttgttgccaaaatatgctcgtggccggtttgatgtcatcagcgtgccggaactcgctgaggatggtcaaaaggtcagttcaacccgaatccggcatgcactcgattccagtgaaattgatacggccaatgattttctgggttatacctatacaactgctggtaaggtggttcatggtgaggcgcgtggccgtttgcttggcttcccaacaatcaatttggagacacttggccaacagcgattaccaggcattggtatttatgcagtgaaggtcaaagttggcaccacttggtatttaggcatggcctccattggccgtaatgttacgtttggcgccgatcgagacgtgacacttgagattaatttacttgattttgatcaaatgatttatggcgaaaacgttcaagttcgctggtatcactatttacgcggtgaagtgaaatttgctggtgctgatgccctgattgatcaattgaaaaaagatgaaactgccgtccgagactattttgccgcaaagaagggttaatatggcaggtgcttatcttcatataccattttgtgaacatatttgttactactgcgatttcaacaaagttttcatcgaaggccagccagttgatgattatgtggccatgctgctaaaagaaatgcggatggtgatggccgaacatcctgaagaaaaaattcagacggtttatgtcggtggtggcacgcccagcacgctgacaccgacacaattggctacgttgtgtcagggtattcatgatatcctacattttgatcaaggggagtttacttttgaagccaaccccaatgacttgctcacgaccgaaaagttgcaagtgctacatgattatggtgtcaaccgtttgtcgattggcgtgcaatcgtttaatgatgatgtattacgccgaatcggccggatacatcgagcaaaagatgtttacactgccattgctaacgcccgtcaagtcgggtttgataatatttcgattgatttgatttttcgactacctgatcaaagccgcgatgactttctgaccagtttgcaaaaggcgttggcactggatctgccgcattactcaacgtattccctaattttggaacgtaaaacgatcttctataatctgatgcgacagggcaagttgcgcttgccgacccaagacgtcgaggccgatatgtatcaggatgcgatcgatctcatggaagcgcatggccgacatcaatatgaaattagtaattttgcaaaagacgggtaccagtgtgagcataacttgctttattggcgcaatgacaagtactttggcttcggtgctggcgcgtttgggtatcttggtcgtgatcgctaccacaactatggtcctattaagcagtatttaacaccattacatgctgaccacttgccggtccttgaacatcatttggtgccacagtcagaacagatcgaagaagaaatgtttctaggcttgcggacgatgcagggggtcagtgaagcgcggttttatgatcgctaccacatgacagttgacgccatttatggtgaaactgtgccggaactggtcagtcaaggtttggttgtgcgccaagatggctacattcgcctgaccaacaaaggcaagttccttggcaacgaagtttttcaacgtttcttgattgatgagccgcttgtttaagtgctaaaagaaacggctgtgttgctaaaatgcacttgccataattttcactagaaacgttcacaatctagcaatcgtaccttgactttgctaacctcgcttggtatattattcattgtattagcactcatataaaacgagtgctaaaggtgaggtgagaaaatgttgaagaaacggcaattgctcgtcttaaaagagatcatccggttgtttactgaaagtggccagccggtgggctcaaagacgttaatgcaagagctgccggttcacgtcagttctgcgacgatccgcaacgacatggcagcgctggaagatgccggtctgatcaccaagacccatagcagttcaggtcgagttccttcgacacaaggctatcgctactatcttgatcatctcgttgaacccgtgcgcgtctctcgccatgatttggcaacgatcaagcaggagcttggccagcgttacagcaaaatggacgaaattgtggcacaaagcgcgcagattctatcaaatctgacgagctacaccgccattagtctcggtccggaagtcaacaatattaagctcactgggttccgactcgtaccactaggtaaccatcaagtcatggccattttggtcacgaataatggtaatgtcgaaaatcaggtgtccaccgtcccgccgtccatttcttccgatgaacttgaaaaagccatcagaattgtgaatgatcagctggtcgggttgccattggttcaggtagcacagcggctgaggacggatgtcccgtccatgctaatgcagtatttgaccagcccagacggtttccttgatatttttggcaatgtcttaaagtcagctgcctctgaacgtttttatgttggtgggcggttgaacttgatggattaccttggcgattcggatattcacgagctgaaaaagatcatgtcgttgatcgatgcggatcacggcgatctgactgagttgctgggcggcccgatccgccaaacaccggttcaagtgcgactgggtccagagttaaaacctattgatctagcgaacctcagcttgatcactgctagttatgatgttggtggtcacggtaccggtatgatcgccctcttgggaccgacgcaaatgccgtactccaagatgatcggcctgctcgacgtttttcgcgaagagctggctaaacggttgacagactactatgccaactttgatcaataatcatgttagcaaatagcatcagttggtgtttttaagccaactgatgcgtttaaagaatagcgtgaactgacacgttcagaaatcggcgcacaaatgcaatggtcttttttggcattgtgcatgtgttccttatggacaggcttttacgtcaggaaacgcgttaaaggaggataccatggcagaacaaaaagcaaagcatgcagcaaacgccgcaaagaaagctgaaaagtatgctgatacgaaagagacttcgttaaaagaagatattttacaagaaagtatcgcggatcttaacgaacaactttcgaacagtaaacatgacggcgagcagttgaagcaagaacgcgacgactttgaagataaatacctgcgtgccgctgcagaaattcaaaatatgaatgctcgcttcgagaaagagcagcaaaagctgttgaaatatgatgggcaaaagttggctaaagccattttgccagttgttgataatctcgagcgggcgcttgcaaccgaggccaaagatgacagtgcagtttccctgaagaaaggtgttcaaatggtttacgaccatctggaacgcgctttgaaggaaaacggcatcactgccattgatggtgccggggacaagttcgatcccaatacccagcaagccgttcaaacggtcgcagcggatgatcaacatccagctgacacagtcgcgcaggtattacagaaggggtattacctcaaggatcgtgtgttgcgtcctgctatggttgtcgttgcaaaataattaatctgaaaataaagaaggtataaactatgagtaaagttattggtattgatttagggactaccaactcagctgttgcggttctggaaggcaatcagccaaaaattatcaccaaccctgaaggcaatcggaccacgccatctgttgttgcgtttaaagatggtgaaatccaagtcggtgaagtggccaagcgccaagcgatcactaacccagacacgattgtttccattaagcgccatatgggtgaagctaactacaaagtcaaggttggcgataaggaatacacccctcaggaaatttctgcgatgattttgcaatacatcaagaagttctctgaagattatcttggcgaaccagttaaggacgccgttatcaccgtaccggcttactttaatgatagccaacggcaggccaccaaggatgccggcaagattgctggtttgaatgttcagcggattatcaacgaaccaaccgcttctgccttggcttatggcttggacaaaggcgacaaggacgaaaagattctggtttatgaccttggcggtgggacatttgatgtttccattctgcaattaggcgacggggtctttgaagtgctgtcgaccaatggtgatacccatttgggcggtgatgattttgataacaagatcatcgactggttagttgctgaatttaagaaagacaacaatattgatttgtccaaggataaaatggcgatgcaacggctgaaggatgccgctgaaaaggctaagaaggatctgtccggggttacccagacacagatcagcttgccatttatctctgctggccctaatggcccgttgcatttggaacgtaccttgacgcgggcacagtttgacgaaatgaccgctgacctggttgccaagaccaagataccagtcgaaaatgctttgaaggatgccaagttgaccaacgctgacatcgacaaggttattttaaatggtggttcaactcggacaccagcagttcaggaagcagttaaacagtggaccggcaaggacccagaccacagcattaacccagacgaagcggttgcgcttggtgctgccattcaaggcggggtcatctctggtgatgtcaaggatgttgtgctgttggatgtaacgccgctgtctcttgggattgaaaccatgggcggtgtcttcaccaaactgattgatcgtaataccacaatcccaacctcaaagagtcaagtcttctctactgcagcagatagtcaaccagccgttgatatccatgtacttcaaggggaacggccaatggcggctgacgataagacacttggtcgcttcgagttgacggatattccgccagcaccacgtggcgtacctcagatcgaagttaaattcgatattgataagaacggcattgttcaggtttctgcgaaggatcttggcaccggcaagtcacaaaacatcaccatcaagagttctagcggtttgtccgatgaagaaattgaacggatgaagaaggaagccgaagaaaacgccgatgccgacgaaaagcgtaaagaagaagtcgacttaaagaatgacgtcgatcagctgctcttccaaaccgataagacattgaaagatgttgacggtaaggtacctgaagaagacatcaagaaggtcaaggatgctcaggaagccttgaagaaggctcaacaagaaaacaacttggacgacatgaagcaaaaacgggatgacttgaacaaactggttcaggatatgaccgtgaagttgtacgaaaatgcccagaagaatcagcaggcgcaaggcggcccagccagcggtgcagcaactgatgcaggcgcagctcaaggcagcgatgataaaaagtctgacgatgacaccattaatggtgactacaaggatgtttccgacgacgataagaagtaacatgttgtatcatgagcaagaagccgaagccgcggcgcggttttggctttttgtttgaattatgctatgctgaacaggcattttcagtcatgatctgaatcgaggaggaactatggcggatcagaaagattattatgagacactcggtgtaagccgagatgccgatgatgacaccattcgtaaagcgttccgcaagctttcgaagaaataccatccggatctcaaccatgcaccaggggctgagcagaagttcaaagacattaatgaagcctatcaggttttgtctgatccccaaaaacgggcggcctatgaccagtatggttctgctgatggtccgcaagggtttggcggcgctggtgctggtcaaggcggatttagtgactttggcggcggacaaggcggttttggcggatttgacgatatcttcagtcaattctttggcggtgccggcggtggtgcgcaagctaatccatccgcaccgcgccaaggggccgatttgcaataccgcatggatctaacgtttgaggaagctatttttggtaaagacactaaaatttcctatgatcgtgaagccgtttgtcacacctgcaatggcagcggcgctaaacctggtaccagtccagtgacctgtcataagtgtcacggtagtgggtatattcaggttcaacgcaataccgcatttggcgccatgatgacgcggcaggtttgcgatgtctgcggcggcacaggtaaggaaatcaaggaaaagtgcccgacttgtcatggcactggccacgaacaggaacgtcacaccatcgatgtgaaagtaccggctggtgttgaagatggccagcaaatgcgactacagcaggctggtgaagctggaaccaacggcggcccttatggtgatctctatattgttttccgagtcgcaccaagcaaaaagtatcaacgtgacggttcagaaatctatctgaccattccgttgagctttgcccaggcagccttaggtgacgagatcaaagtcgacaccgttcatggtgcagttgaattgaaaattcctgctggcacccaaagccagacgaagttcagacttcgcggcaaaggggcaccacgcctacgaggcaacggcactggtgatcagattgtcaccgttgaagtgcagacgccaaagcatttgaatgagaagcaaaagtcagccttaatgcagttcgcagccgctagtggcgaggatgtcaccccgcacaatggcacgctgttcgatcgggttaaggaagcttttaaaggcggtaagtaagcaaatagggtgcggtgctaggcaaagactttcttgccgtgccaaactccgcaatctccggccagatggggctggaacgcggtgacggcgcttcgagcccaaaaaccggtctcgaagtcgcctaacaacatcagcgagaaaaattgtgttttcgtttttataagtgtcaacttgacaggggatagtaccgttaagaagcgctcgttcatcttggtgcctgaagccggcgcaatataacgtgtgtggtacgggtcactgacaacgaacatttgaacaactgaatagatgccgttaaacataccgtcactcagatacttttttatctgacgaaaagcatccatgtatgaatgatccgcattcttgagttcgatatgaattaacggtagtccattgatcaaaagtgaaacatcaaaccgacgattctgatagtcagcaaacactttgggcatttcgatctgattaacaacctcgtaggaagaagtaccaccagctacatcttcccgacgaacaacttctagtcgaactgttcccagcgtggcatcttcacgttgcacttgaactttggccacaccattttcgccagccaaccacttagcggcattttaaaacgtaccaaattgaagctgattctgaatttgacgaaactcttgttctgttagcggatgtccgtccaacacagcaacattattttgttcgattttctgccgaaagttacgccacaaatcctcctctgtctttagctccggacgatacgtccattgtgaaatgcccctcgttaactgttcgattaatcgtttttcaaacgtagattcaagtgttgcacccattctcgactcctcctgttgtcattgcaaaacccgttagtcgtatttcttcagatcctgcaagccactgacgaaccattcatactcctcgattcgcatcttcaaaactgcattaatattcatccaaagcagcccgcaagaccgagatgctttttgaaccttaacgctgcgttccagcgtatagataactttcttcattatgaagcatattacgggcaacgtccatacagagggactcaactgactgactgatttaatatgtacttctgacagaaaatcaggatacgttcgtcaccgattcgcactaaattgaagttgagtaacgaatagagcaaatattgtgttagagtttacatttgttttcgggacaattctgtagcgaaatctgactacatttaaaaacgtaaacaaaaagcagtgccacttcacgctaatcatgaagtaacactgctttttcaccgcgtaagaatcattcagattctgtaatatcgagcaacttttgctcgcgggccactatcaatttgctctaaaagtctctttgcctcttctttagtcagaaacgaacgccgatacactgccttcatccactcagagtccggcatcttcttacttataaaccattgatcgacatttggggctaagaaaacgctatatcctttttcaccaaagcgtccatctgtctctttagcaataatggcgtgcaaaataagatgttcgattagatccgcatataccagtctgtctttacgatgcatactaaacggatattgataatgtcgaataaatcttagatcactcaggttttctgcacgattctcgtcaacatggtgcgtatagagtccttctgaagttctggcatacttgcctttgctaatagacttgatttcaccgtttagaaaacgctgataagatttttcattaaaatagttgtctttcaccggtccatatttattgagtaaataggcaactgcttcagaataggtcatgttgatcatattcatgtactctgcatatcttatttcgtgatctgcttctgtcatgacgcgtacctcctatcgtttagaaaaaggctcaatcaatcttgaaaataaaagctcccttttgtgccagcccataggcggactgcgagtctcccttactgcataacttcagattgattgtatcataggcattgcctaacaatcgaaagttagaccgtactttaagttggcaacaccctttttccaaaatgtgctacagtaagttcctgaacacatcacatcaaaccaactttggagcgtgttaaaacattggctaaagaaacacatcacgtcgtcatccccgacgccatcatggaagatcttgatattaaagatggcgagcaagttgaagttactttaaaagataaggaagccgtgattcggcctaaacggacggatacagggacgcagacgatttcgctacggttcttcctgattccaacggttttggctgggatcgcgtttttggcctactttatctattttcagattttgcaggtgccgatgacggggaagaactcgatcgctcagatggtcattgtgctgggcgaattgagtgggattgctacgtttgcggttgcttacattcagaatcatcgtcagattcatggtcgggatcatcggcgccggtattggcgaatttttccaacgatgctgttgtcctttgcaattattcttgcgtttgtgacatcagtgtttttctgggtgattggctatatgtttgaaggcgtcagttttgatatttacacagcgactgggttgttcctgctgtttatcagtattgtgaactacctgatgatttattcggccttgtcgatttcaacctccttcatcacaaccctgtttctttcgaccttcgttggcggcgtcattggcgcgattgtgacgaacagttcgcgccagtggtggcaacataacgtcagttttcttggcacgaacaaggctttgaatgcgtggcaatttaatctcaccatcgctgtgtcggccttgctgtggatcgcgctggtggattatctcttcgtgccactgatggcgcatcgcaaaaatgattggcggttgatcacaatgcggatcatgttgacggttgcggcgattgccttgctgggcgtcggccttttcccgaacaatcgcggcctcatgcatatcttgcatacacaaagtgcttggttcctgaattatttcatcatcggcatgatcattgcggttcgttggctgttgccaggcgtttcgcgcgaatttctaagcaccagttacatcatcggcggcatcatcattttcgccgcgatcctcttccagttcgtccactacttgtcactgacagcgtttgagatgatcgcgttcgccctcgcgatgtcatggatcatgttgctactgcaaaacattcaccggctttaccaaaaagacgagtccacgtttgtcgtgacagtgatgacagacaaggtaaacactgactagctttgatcaactgttgtttcttggcacgctctattaattcagcgctcagtttctcatagccttgttaactaaggacgttttcaaaaaagtagaccgactagtcgaaagccactacagttggcaacttgtcactctggctcccatctagcattgaaaataccccaagtactaacagacgcttcaatcatctgtcggtactaggggtatttttaaaaattgggggcaatttgggggcaattttcagtacttttcggtaattatagccggtttcgaggaaatttggtggcaatttgggggcaatttttagctacgcaggttaagacatcactcactgtataacggaaaattgttagctttttcataggtagtttagcgtcaattttaaagatcccagtgccaaagcggagcaatcgtaggccagatggggctcagccgtgcaaacaacacagcgacggttagaccactatcaagaattcgttatcatcgttgcacttgacttgaaaattgagggttaaaatataactaataaaaagtaaggagggccatcatgattcataattctaccattgattaccagctcaaccatcgatccatccgggcatttaagccccaaaacctcagtgatgaccaactgaccactctgtatgaggccgctcgtcatgcctcaaccagtatgtttatgcagcaattcagtattctgcacgtcactgatcccgccaagcgagccgcaatccgacgcctcggcagacaaccttatatcggtcaaaatggcgacttgttaatttttctagtcgacctctaccgtaatcagaagatccgccaggccgcgggtaaggatgacggtcgtctgcacactacagacatcttccaacaagccgttgaggacacagttcaggctgttcagaatactctgctcgctgccgaaagcatggatctgggcggtgtaatcctcggttccatcaaaaataacccaatcgagttgatcaaagtccttgacctgccgaagatgactttcccactgctgggccttcaggtcggcattcccgaccaggcgcctcagctcaagcctcggctgccgctggatactctagtgatggaaaataactatcatcgcgcttttaaggccagtgacctcaaagactatgaccaggtcgtcagccaatattatgatctccgtgacgccaatcgccggatcgactccttcaccaagcagatcgccggcgccaagctcgacaaccacgaaacaacgcgggacaagctcgccgctgcccttcagcaacagggattggccctggactggaaataaactcaaacacctcactaccgttggtttgacatgctaacggtagtgaggtgttttttagtaatcgagcttaatcgcccaacacgagccgacatcctactgatatagcaaaagggttctggtgcaaattttcctcgctgacttgattttagtatagtggctgcttaaaaattctataattcaggcagttaagctaatatatgcattacttcttctggattgccaaactgtaaaacaccaccttggccattaatgagggcaatcaacccgttatcggcgtgcatagttgccgtaataactggctcaacaggatacgtcccgccattgtgtaccgtgatggtatcagaatagtatgcagcatctgctgggttaggcgaccatgtggagtaagtggtgccttcctctagtttggccttaagatattgataggtgccaacatccgttttttggaaggcccacgcaagtgtcacctcaatctgagctgccccggtcgtccctgggtcaggccatgtgcagacaatcgtgctgcgctgatttgctcccatttgtgtggtcataggaaacccatccaaatgtatccgattgccattgatgtcattcgcccatatttggaaactaacattaaaatcggcctgtccaagcaagactgttgcagcataattttgaccaacaacgggattgttgtatgatcctatctctttgatattccagcccgaccctgttactgatactgggtcggcacttgtccctgtcaacaaattcactggcacgtccttgtatggcatgttgtcaaacgtctgtgtggctactgagtgggcgatgccatcgggaacagtgaacgttatggtaagcgtattgtgaagataggcctcgtctaaagtaatctgtccagttgaaatggcattgtaatatatatctggctcatcagcgaaaataagtttagctggttttgaagtagtcagggcatctgcaagaagcctgcgctttttattgacatcagttcgaacgatagcagtcaccgtgatagtgccttcatctgctctaacgtatgagaacatcttcccatcagagcggccaacttggtcaagctgtgggacacgattttgcccaacgtttctagtgacaagcagaatgccatcaatccactttgaaatgttaatatcattaaaagttattgccattgtcataacagttgtgtcactcctttccgacgaagacgaatgctactgtttcgattgatctcgatttgtattggcttggccaattcgcgggccatgctcctgccattcagtgatacatcggtttgaacattaattacttttggttgtgctgtgccggtactaaagctattgatagcgttttggacatcaggaactgaattaatcgcctgaatctgcgatgatttaaatcctttaagtgccttggcaaagatactagaagaactagtcttggcacgttcagctatcgctgccatgagcaactgatcagcattatcttttgtaacattgacaacatactcagtaccgtcctcaccgaccacagccggtgtggctttatcaaatcttccaccataggctaagcgtcggctgccctgaggaccagagtgtagccaatcagtctttgcatgaccccaaatgacggtgttaccaatactattttgccaatctgagttattaaaaaaggccagcaactggtcataagggctcatgatattagtatgcccaggcatcgcataatgcataaaggtaccaggagtatattgcaatattcctcgcgcttcgttgccgcctgagttaatatcgtggatttgttgaacaatgttgcggccaccgctttcagactgaatggtagcctgaagcatgcggataaagctgcctgatgggctcaatcccatctcttttgcggctttccaaatcaattctgggttgtagtttccaccagacgtttcatcctctttggctttcttgaatagagatgtaaatacgtttgaaaatccgtctttaattcctttaagagtcccgccaccaaaatcagaccgcattgacgaccatttttgaccatcattgcttgcaagtttcttaataccagtcttgccttcaatccaactccaagcgccagatacacccttatcaatgaaattcatagcactaccgaacgcatgcgcaatctctgagccaactccagaagcgatttttttagcaccatcaaataaatcagagatagtaccaaaaataccggtagcatggtggggcaatgcattagtcatcttcaagaattcctctgattggttgtgaggcaaaatgcttgttccggctggtaagaaagttgtttccataccgtgaacgcccagtggaaaaataccaagactaggatgatgggccaactcaaatccctcttcaccaacaacggcaagctgatcttctcgtgtaccaccagtaccaatggcgtaacggttccagtggcgagaaggccttttgccccaaagctttcctacccaattccatgcatcaatcagatggttccaaacaccagcaacgccatctaagaatcgattccaagtgctcttaacatcacctgtttcagtgtttaccgcactcttatgttctccagcctgttttgtggcttcggaaacgacttcatcatgttgctttctggcatggctgacagtgccgtcgcgttgcttcttagcagcactgattgtatcgttacgctgattcttggcatctccgacaattttttcatactgagactttgagatagagtgattgacatagtattccgtttcagcggcagaagtcgttgccttgtatttcttgttagcagcatcctttgcttcgttgtaagttttgttagcggcagtgacgacagcattagtctgctttgccgaagtagagatgacttcctttagttctttctggcccatcttgtgcttgtcttctgacagtttctgcaaaaggtctttttccttgcccgcactcacttttaagctttgataagtgttggcatctgcttgcgactgtaaagtcttcatgtttttaagatggcctttttgcagtttttgaagatctttatcctcttggcctttgagcttctttttagctgccgcaactttgcgcgcagttgtggcgtcaaatccggcgagctcttccttagtagcacctgctttgacaagcttttcgcgttgagcggcacgatctttcaaaatcttgttgacagcattggtactcttcttttcgtacttgctctcgatatcgttacgttgtttgaagtatttttcgctctccttttgcatgtcagcatatgatttcttcatttgggcggctttagtggcatcgttcttcttctctttagccagagcttcatcagcttgtttttgagtaatagaaccatttttgaccagcaagtccaagtcttttttggacttgctttctttgtttttatagtatttgtcaacgttttttgacatgttagcatatgctttggtcatatcagcttcgattttgccagcctgtttaccagtggcactgccaagcatgatggtgtcgcccatgatcttgtccatgtcaccttgataggactttacaaatgacttcacgccaccatgtaacttttcggttgcttttgtcataccgttgctaagtttcggatggaaagtggattcaacacctttttgaacctctttgccaatcttcttaccaacactagaaccggctacacctccagcggcagctcctaaaccagcaccaatagcagtgcctatagggcctgcaaatgtaccgacagcggctcctgcagcagcgccaccagcccaagtgccgagagcaccaccagcagcactaccggcatttctaccgatagttttcttggtagaccctgccaattctcctaatgaggagagaatactaatggcagtgccaattccagctaatcctttggctgctccagcggcttttgaaaatttggacgtgaaactggatgcgccacttaaatcttcaagcgcgtcctctccaattttggcagtaccaccagagaaaatacgtctgaataaaccgcctcgtttgctggaattaacagccacgctttcggcgtcttcgactgcagtaccagttgctccccttttaccaaaacttggcaggctgattccgctaccggaaccgtcaccaaagatcttggttgcaatgcctagctccatgattgcttttctagcttcgtttactgacttaatccaaccggtaatttttttgatggcaaagaacgccaaccaaactttggttagattttcgatatcgtctttatgcgaaacaatgtttttcaaaataccgtcaatcttattgagagggtccttaaccttattgcttttatcatctactagccctaaagccttggcaatatcaataacaacgtcatacgcagttttgaataccgtgccaccgataatttggccaattttaaaaatattttttgcaatatctgtcacggtatcgaagtgcgcgttaatataatcaatcggtttagtaattcctttagccaaattatcgaaattgatattactgatcgaatcagtaagcaagctgacggttttgattccagactgggatactgattgaaatgcccctatcaaacggttagtaatcgtttctttgagaccgtcaaccgcttgcccaaccgtcttgtattgtgtggccatcttttgaaagcccggtgcattgcccgctttctcaatagcgtcaaaaaactctcccgtcgtgactttgccatcttgtattttagcaatcagttcagaagtactcatgcccatctttcgagacacggcagccataccagccggtgattgttcgagcatgatttgaaagtcttgccactgaacctttggtttagcagccatttgagtcgcttgctgcgacagacttttcatcgcctgcgcaggatctgccgaagcagcagctaagccgccgaatccttttaccaagatatcggtacttttagtaccaacagcagctaactggctgtaggtcgtagccatgtcggacgcagagtagatggtctgctgcgcatactcctgcagttcctttctggtcgcagcaatttgtttatcaggcatgttaaggttctgcatgttagcatcaaatgtctgccatgatgcacttgcttcattaagatcaccgatcaaaccggtaatagtactttgagccattatgaaaccgttgcttaacaaattcccgatcatggtgccagctataatatcccgtaaacctctgaaatgtcggccagtatcgtctgcttcactgctgatgtgacgtaaaggcgcagatgcgtgatcattagcctttacagtggtttcttttttgcccggaatatcctgttgtttcttctcaatcttctcaaggggaacggtagcttcatctttgaccttgatttcgctcttaacttctttaggcagcgacttaatcaatttatcaaaatcaatagctttgccgtcttctaccttggtcagcaattcaacccgctgttctttaggaagctttttcaaaatagtattgaaattcttaatgccggcatctttagcttctgcgatgagtttagtcttgacttcttttggaaaactagccagagtccgcttagccttatttgtgttctctttgatggcattatccatcttatcgccagcttggctaccaaagtcctttagaattttgtcagcttgctcggtatcactaatgagctgatccttgccctttagagcaacttcaatcgagatcgttccatctgctgccattgtgtgttccccctttcattatttgtttgcgctggacgcccatgcagcaaagaaatcagctgcctctgcggagtgctttgcattacggtatttatccaagatgtagtaattctgcaaatcaaccaagttaatcaaatccttgccttcaagtccctgacgagatcgttgccgaatatcaatgatgcgcatgaaataagacgaacccggtaagccatccaacatagcacggaacttgtgccaatgtagctttcctagttcgtcttctaagtcgatgccataaaacgctcgtatgcttgaccaaatagcaggcgcatcttgaacgtaagagaaaaactcctcttgtgctccgcctgttactgatggttcttcatcggttgctggctgcatttccgagtcatgatatggttgctggccgatgtactgattaatccactgaagtgcctttaaccggtcttctggcgcgacctcattagcattaacgaacatatgccaaccaatgacgcccttttgagcatcggtcttgtcctcacgatcaagcagttcgaaccatcgcaacacgttatcaaacgccaaattcacacgatatttcttgtcttcacactgccagtaccacgctagcggttgagttaggctaatcattgtcctcattcccgtcaaatgcaggatattcagcgtcttgagcgtccttaattgccttttcagatgcccgcttgactaggccaaggacaaacatgaggccgtctgtgctttggtctaaatcgctgtacagcttatcggctttttctttgccgattgtctgtacaaagaagtccatggcgatttcatgttctttattgagagcctcacgtacgaaattaagctgatcttcaaccggctttttgtcgatgtcatcattttccttgtcatcattagtcaactgcttagcatatgcgttggccttgacccaagcatcactcaaagcgtgctgcattttatctgagaaacggaacgtgtacgtctcacccttataggtaaagtcctgcttagttgctagtacgtcatctaaattaattacgttgctcatgatttcctcctaatggccgcctgggatttacccatactgttgatttctttggcgaccctgtctttttaagcggcagtgactgttactgccgtgcttgcagttttactgccatcgtgtgtcgttgcggtaatggtagcagagccttcagaaacgccagttactacgccactaccgttgacagtagcgaccgatattttactggattcatagctaacagccttgtcagtcacgcctaaagcgacacaaagtaccattaatcatacaaggaggactcgttgtgaaacctgcaaaaactaagtttagtgatgtccctgatggcagtattcatcaatatgatcagattttgaaatattttaatgatcaaccagccgatcaaacgaaaccgcgtggtaatcggatcacatttgtcacaactggcattatcggttttgatggcggtcaaacaacgatgctgcatctaggtacgctgctggccaacgccggttacgatgtctactatttaagctatgtcccacaaagccaagacgaaatgattcagaatgctgaatttaattatcccggttacaaaggaacctgtctgccaatgggcgaacttgagtcccatcgttccgatatttgggtcgccacgttatgggaatccgtttatgtgatcaagaacaaaccggggtacaaaatgtattttgttcaagattacgaaccgtatttctatccatatggcgatcgctatcagatggcgcgacgaacttacagtctaggtctgcacatggtatcgcttggtccatggtgtgctcacatgatcaccatgcattgcaaggttcacagtcctattgatgtgattaactttcctgtcgatgtcgcacgatatccattcaaggaacgcgacatgggaccttatgaacaaaaaaaacaaatcaagcttgctgtttataccaagtggagcagcccgcggcgcgcacccatcaacattcagattgtcctcgaaaattgccgccagttactgcgcgccaagggaatcgatctcaaaattcaatacttcggtaccgaccgcagcaaacgcttcatcaatggtgaaaaccttggtaagctgactcccccggaattaaatcgactttaccaaagtgctgatttcggtatcgcgccatctatgaccaatttttcgcttgtcccttatgaaatgatgagcactggcctgccactcattgattttaaggaaggcacaggaagctacttcttaaaagacgggacctattttgccagtcatcttgatgaacgagatctggccaaaacgcttgcaaatgcttgtgccaaccctgacacgatcagcaaccaagtccaaaatggtcaagccttccttaaaacgatcggctgggatcgaactgaaaaagacatgctggcgatcattgcaaacctgtagcgatagctaactagctaccgcttttttaatggaaggaaggtgtggtgatatgtaatgcgactgacagcaaaacagaagaagttcgttgattcttatattgctgatagcaatgccaccaaagcggcactagaagcaggatacagcaaaagaacggctaggtttgtcggtgcagaaaacctaacaaaacctaacattaaagctgccatcgatgaacgtatgaaacgcatcgaatctgacaagattgccaaggctgctgaggtgcttcaatacttcaccacagtgcttcgtggagaggcaaaagagacaattatagttagcactccagacggtgcagatgctgttgaaaacgatcctagcatcaaagaccgcatggcagcaggacgcgaattgttaaagcgttaccctggtaatgatgagctgctcaatgctcagttaacgaagattattactgatattgagaaaactaaggccgacgttcgcaagtctgaagctgaggctgacatcatggaagccaaggccagcgcctatcgcacgccagaaggccaatatggaggactgaacaagcttttagccgcaattgatgaaagcattccaaaggacggtgatgtcaatgacaaccccgattgatcaattcaaagggaaacagttagacatcatcaactggtggcgccgctatccagacaagcagactatcattgctgatggtgccgtgcgttctggaaagacgtttgcgatgtcgatcagctatgttctgtggagcatgattatgtttgaccgcgagcaatttggcattgccggcaaaaccattggatcattgcgtcgaaatgttatcaggccactcaaacaaacattgcaacaagtgggattctcggttgtggatcggcgttcagaaaacatgctggaaatcagccttgatggaagaaccaacctctactatttattcggcggtaaagatgaaagcagccaagatctgattcaagggatcacacttgccggaatgttctttgatgaagcagctctcatgccacagtcgtttgtcaatcaagcgacagcgcgtgtttccgttactggcggcaaatactggttcaatatgaacccagagggcccgtatcactggttcaagactgactggattgatcaagcagacgataaacgcgcattgcgtctccactttgtgatgacagacaatccgagcctgagcgatgaagttattgacaggtacgaacatatgtactctggagtgttctaccagcgatacattctgggacaatgggttctggctgatgggattgtctacgacaacttcaataaagacgagatggtcagcaatccaagccagcagccaagccgatactatgtcagtgttgactatggcacacagaaccccacagctttcttgctttggggtaaatgcgggtctgtttggtattgtctcaaagagtactactacgatggacggcatagcagcagacagaagacagatgatgaatacgctcgggattttagccaatttgtcggtgacatacgctgtgaagtgattgttgacccttcagcggcttcattcattgccaagttgagagaaagccggtatcgagttattaaagctgataacgatgtgctaaacggcattagagaaacgcaaacagctatgaactctggtgagatcaagttcacacctgggctaactaatctgttcaaagagttcgcgtcttatgtgtgggatgacaaggccagtcaaaagggtgaagacaaagtggttaaggcacatgaccacgcaatggacgccatgagatattttgtcatgcaggtaatcaaacggagaaatacagctcgcacgttcaagaacacaagcaaatacttctaaggaggtggccatcatattaacagttcaaggtaaaggctcaatcacagacggagatgtgtttattttcccgactgatgaagagctaactggcgatgacatcaatgcgtttattactgccaatgatgatctagctaaaaacaagtaccttccagcaaagaaaatgtacctcggtcaccatcagattattgatgatgcgaaaaaggaccatgggccagacaatcgtcttgttggcaacttggctcactatatcgtggatacctacaatgggttttacattggcattccaccaaagatcacgctcgataacacacaggaaaacgccgtgttacaagagtggcacgatacgaacagcgttcaggacaaattaagcgagatcagcaagcaagcatccatttacggacgggcgcttgcttttttgtaccaggacgaagacagcaagacgtgtattgcgtacagctcgcctatcaattcattcattgtctatgacgacacggtagcacacaaagccattgcgtttgtcatgtattggcatgatgaagacaagacgttgaccggaaaggtatacctgagagacggcatatacgctcttgatatgacacgccttgaagggacagacggatttaacccatttaacgaagtaccggcagttgagtttttcatgaacaccgagcgacaaggcatctttgagaacgttgaaacgctcatcaatgctttagacaaggtgctaagccagaaggcgaaccagaatgagtattttgacaatgcgtacctggttctcaagggtctgaaactcgatgaggacgatgacggcaaccccaaactcgatcttaatggtaaccaaatcatctatgcgccagacgctgattctgctcaaggcgtagctgaatttctgaccaaacctgatggcgatgccattcaagaacacctcattgaccgtctcatcagcatgatctatcagattagcatggtcgcaaatctgaacgacgaagcattcagcggcaatagctctggtgttgcattgcaatacaaattgctaccgatgcgcaatctagcggccaatcaggaccgtaagttcactcagtcactacggtcgctttacaagattgcattcagtgttgggacaatccttccagaaagtaaatctgatgactggcaaaagcttaacttcgcattctcgcgaaatcttccggagaacattaccgacgaagcagacgcggcttctaaactcaaagggcttgtatcagatcaaaccatgctgagtaccttatcgtttgtcgatgatcctaaggctgaaattaaacgtattgctgacgagactgcccagaaagcaaaggacgctgctactaacagcccatcaagtccagacttccagaaattcatgaatggtgacgatgccagcggtacagatgctaagactgttcagcaagtaagccttaatggatctcagatcacgtctatgatttcaatcgtgcagcaggttgcctcacatgctttgccaagagaatcagctattcaaatgcttacttccgcgtttccctttgatgaggagaaagctgccgagattctgggagatgccggcaaaggatttgaactgaccccagacggcaagccttcgactgatggagggagcaatgatgacaacaacgactcagcaacagatagcgagtaatttcgcatactggaataagcgaacggccgctgaacggaaatggattgtcgagaaccttaagaatgacgaggcgttcaatgcccgaattcaggaatattttgacaaagctttaaccaacattcaaaaggatattgattcagagcttgccaagtatgccgcatatagcaatgacagtatggccggtgcgcgtcaagcagtgatggctaccgatattaaagcttatcaagcggaagcaaagtcgattgttgatgatgctagaaagatgtacaacggcgaaccgctcaaatattccgactttagcaaggatgtcaatgatcgtctcaagctatacaacgctaccatgcgcattaaccgtttagaaatgctcaagagtgagattggtcaagaaatgcttgatgcacacatgaaagtgaacgccgatctaatctcaaaattgagcgatgattatcaatccgagatcaaacggcaagccggaatacttggagagacggtatctaagggcggctacactgatttagccaagctgctctccaaacgagagggagattacaccttctcacaacgcatttggatcaaccaagacattctaaaggctgaactggatgaactgctgacatccgccaccattcaaggacagagcccactaaagattgctcgcaagttacgcggtcaagtggcagaaacggtgaacaatcaccgctatgtgacagaacgaattgcacgtactgagtcggcccgtattcagacacaggcacaattagatagcttcaataagtttggctatgactattgcaaatgggtggctgaaccaagcgcgtgtgatgtatgcaaggagatttcagaaggtggtagaactggtagaggcatttatcgtgtagacgatgtgccagatattccagttcaccccaattgccgatgctccattgcggcttatatgccagacgatgattaggaggaattaccatgagcaatgaagatttgaaaacacgtgaaggcatcaagaaacggctgcttgacttggcagcagaagctaatggcatcaaagattatcagctaggagcgcttatcctgaccgcatacaatcgatgcgatgaaaatgtgaccattcagaatggcaatttatatgtcaacggcaaactgatgataatcgacaatgcgacacttgccaatgtgcatgggctagacgacatcaagcaagaatacagtttctaatctaggaggaaatgcaatgaaatatcgtaagaagccggttgaaattgaagctgttcagttcgattatgagaaatgggtttatatgagacacacagcctatcccatggttaatggcgatgtcgcaccagacggtgggatgatggcaactaatcctgttatcaaaactcttgaaggtgacatgaaggtttcggatggtgattacatcattaaaggtgttcacggagaattctatccgtgcaagcctgacatctttgaagaaacatacgaaccatcaatcggattgcccattgatatttctaaagcaaagtgtatttcaatttcgactcaagaacttgccgaaatactgggcaaaccgatcaaacgcgagattgataaacaatccagacgtgaacgacgccgtaaaggatttttataagccgcagctagcggctatttttatgccatcaagtccaagcgtgatcgactctaaaagctccggtaaattaagacgcaagcctgatccgtctaaaaagctgtggaaggagttctgaacatgattcccaagattttaatgcctatgaatttgcaatttttcgctgaagatactggtgctgacggtagtcaaaagaaccagcaaaacggcgaatctcaaagtgagaatgacaccaacgctcaagactcggaaaatggccaagacaattctgatgaaagctctgatcagcatacctacaccgatgagcaggtcaacgatattgttaaaaagcgccttgctcgtgccgagaaggagaagcaagctgctgttgacgaggctgcaaagctggccaagatgaatgctgaccagaagaaggactatgagctagaaaaggctcaaaaagagcgagacgaactcaagtcacagcttgccacctacgagatgggcaaacaggctcgatcgatgtttgaggacgccaaattgacagtcactgaggacgatttgcagcacgttgtaacgccagaggcagaatctactgaggcgaatgtaaagtggctcattgcgcatgatcaggcagtggctgaaggtgttcgtcaagagttgcttaagggaaacacacccaaaacgcatggttcaaaggtggagactccgggcgcggcatttgctaaacaacggaatcagcagggccaagttgttaacgatccatggaaacaaaaataaggaggtacttttatgtacgcaggtaaaaaggtaaccgcatctgaggtcaacttcttggatagcgagaaattcgtttcattcactcaccaagccgacagttcaaccgatggtgtcgtaaaaggagtattgccagcaggttctatctatccaaagaacgatgcaacggcaatcggtgtgaccattaatgatgttgatgtcagtgagggttctcaaccggtaggcgtcatcgttgaaggatatgtgaacgctgctcgcttgccagtcaaaccgtccagtaatgctatcactgcgctgaaagaaattaaattcagccacgtttctgactaaggaggattaacttatgccagctattttagatttgtttaatcaaaagacggtacttgattacgttcaaaaccgccagtacccgcaattgcttggggacaccttgttcccatcaaccaaaattaatcagttggattttgaatttcttcgtggtgggtctaagacgcctatcgtggcatctatttctgcattcgatacggaagcggagattggcagtcgtgaagcgagcattcaggccgctgaactcggctacatcaaacgcaagatgcagcttaaggaaaaggacctgatcgcattacgcaatccgcgcacaccggctgaacagagctacctgaccagccttgtgtacaacgacttggatgttttggttcaaggcgtttatgcacgcgttgaaaaaatgcgcatggaggctttggcaactgggaagatcgccattaatgagaacaatctcaacttcgatgttgattaccatgttccaagtgaacaccaagttactgcaactacttcttgggatgcaaatggtgctgatccgattaaggacttgcaagactggtttgcactgctcgactacgtgccaacgcgaatcttgacttcttccaaggtacagactgccttgatccggagtaaagcatttgctgactacttcaagacagcaggcctgttgcctagtgttggcagtctcaatgcggttatgcagtcgttcggcttgccaactattgtcacgtatgatgccaagtaccgtaagcagggagccaaaggtatctataccgttgaacggtacttcccggaagacactttggtagcctttggtgatgaccagctcgggcaaaccgtttatggtcctacccctgaagagtcccgactgatttcaactccgggtgttcaacagggcactgttggcaatgtgtttaccaccgtttacgagactacgcaagatccaattgcaacgtgggaaaaggcggcagccaccgcgcttccgagctttccagaagccgagaatgtcttgcaagccaaagtgctcgttccaggcaaaacaactactaccaccacttcgcacgcttaattaattgatgcaagtcgcctatcgaaataggacagtacgggaaaccgggcggctgattggaggacagaatgaaactcatcttgtgtcaacccgctattcagagattcgaatgggaattagaagtctgcctaactaatctgcaaagtgtcgggtttggcatgaaagatgtcgttttgctcttcactgtgaatgattataaggtgccagaaacgcttgccagcaaatatggagtagaagtacacacgtataccgacaagcgctcagacggtcaatatattccgtctgtgaagccttggctgtggtggcagtatctagctgaggaccccgaacgcgaaaaagaggactatttctacttcgatagcgatgtgatcttccgtaaacggccagactttcgcaagctgaaagcaaagcctgatcgctggctgtgtagcaacacgcttagctatatcagcgttgactatatcaagcagtgcaaacacggagaagaaatcttgaaacgcatggctgacattgtcggggttacggtagcttcgcttgagacgatcaaccacaattctggcggtgctcagtggctcatcagtcacccgtcggctaaatactggcggaaggtgtatgccgacagcaaccgactgtggcaatacctgcaaacggtcgacagcaatatccagaaatggaccgctgaaatgtggtcgcagttatggaatatgatgtacttcaacatcgggcccgtcatcagtgatgagctcgatttttgttgggctaccgatccagtcaagcggtggaatgaaaccaagatcatgcacaatgctggtgttaccggtgatatgcatgatcttttctttaagggcaagtacaccgatcgagtcccgtttggtgaagaccttagcttcgttgataagttgaagtgctcatacaagtacgctcaagcaataaaggcggtgaagtgatggcagaaagcgatccaataaaacttgcagatttgaagacgatgatggaaatcaaaactgatacacaggatgatgtgcttaacctcattatcaaaaatacgacgcaagccttgcgatttaagctcggtttgcgaacggatgaggcctttcctagtgagttgacctacattgccctagaagtatgcgtcagacgctacaacaggcgtaagaacgaaggcatgacgtcatacgagcaagaaggccagtcgttcacgttcaaatctaatgacttcgatgattttgctgacgacatcaacgactggaaagaagccaacgggaagaatgccaagtctcttgggaccgttagcttcatttctggctatccaaagaggtgatcgtatgcggttagatcatgaggttacattctggcttgaggatgaagaatataatccgcaaacgcatcaatacggtgatgttaaaaagatggccactgcagttgctagcgtcaccgacatgggaacagacaagagcgttcagctattcggaaactatgctcaaaaggcaaaggtgatccgattagttgagccagtcaccgtcaattggagctatttaacgattgacgatgaagcgactcattatgccctcaatactgaccgtgtcccgcttcaaaacgccactttgattgtgggtgagacgaaatgaacaaagctagcattagctacaatatgcagataaaaggcatggacaaattggtagcgggtctgcttaagcgagcaaagatggacgttgtcaagcaaatcgtcaagcagcagacagcacagctccagactcgttctcagcaaatgaccggcaccgtgtatgctcatcctactggtgctacaaagcgtggcatcaagttatcgcttgaagatggcggcctaacgggcatagttggcatgtcaatggaatacaacccatacaccgaaaatggaactcgattcatgcgggcacgtcctgtattgaagcctgcgttcctttatcagaaagtgcagtttattaatcagcttaaacaagcagcaaagtaggtgattcaaatcacatcaccagagcaagagctctacgactacttctatgcgttttcgcaatcatctgggtacaaaacttacgaccatttgcccatgcagcaggagaacgccccatatcccttcgtcattgttggcgatattcaagttgttcctactgcaacaaagacgtcacttaacggcaatgtgctaatcaccatcgacatctggggcgacaaaaaacagcgtttcaccgtatctgatatggcagagcgcttttttcgtgccgcgattggacaagtgctaaccgatgactaccgattctatggacgtgtagaagatcagtcaaaagagttcacacaagaccaaagtgtccctgacacggttctcaaccgagccacgctgatactcaatctaaatattttataggaggccatcacatggcaaatgaattaaaagtgctagaaggcatggacgttgttgccttggctcgcaaacatagcgatcaagcaaaggtcggcggccaaattatcccttggcagacttcgctgtcctttgatccgtctgttgacagtgattccactgttaccaaggacggcaatgtagcaactcgtagttccgcaagcaccgatcttgaagtcgaattcctgaacaacacggctgcaattgcagacgtaatgtacgattcactgtttgacggcgaattgctcgacttttggattctctaccgcaagcgtaagaattccgctggcaagtattacgcatggtacatgcaggtaacggtgcaagaagacagcagcgacaatgaccctgatgatcactctactcgcgatgtcacattctcagttaatggcacgcctaaacgcggatggacaactctcgatgacgaaactcaggaacaggtcgattacgtattccttggggttggcaaggtcactagcattgatagtaccggcggtggtgtcaagtgggattctgataaagacccaggtacgaacgaaacaacagcaacaacgaccaccaccacttcgcacgcttaattaattgatgcaagtcgcctaagaaagtcacagtacgggtgaaacccgggcggctttaaaagaaaggattttaaatatgcaattgaccattaacggtaaagaatatgagcttaactttggcgtccgctttgttcgtgaaatggataagaatatgggtgccgtcatgcatggtattaactttggcatgggtgttgcaaaggcactagctggtctgaatgcatacgatgctgccgttttagcagacaccatttattcagccaccgtggcatctaagaaacgcccgtcagctaacgaagtcgatgactttattgacagcaacacggaattagactctttatttaagcaagttgcaaatgaaatgaacagtgctaacgcagtaaaagcagtagcaaaaaacatgaaggcctagatgaggacgaaagcgttcaaaagagtagtgaagaaacgtatcacgaaattttgttaaacgcatttgcctatctaggcttttctgatatttggaaaattgagcgcatgacgcttgttgaatacgaactgcgcatggaagcctatcagcttaagcaagtcgacagacagaacgaaattgcacagcaagcatggctgaaccagcaagtgcaggcaacaaccgggagcaagaatcctaagccaaagtatcagacctttgatgatttctttgataagaaagcagctattgataacgtgcgatcaaattatgagcccaattatgaagtgtcacagatgagcacaaccgagctcaaatatactagagctcaagtgtttgcaaaacggatggccgaatttcagcgtttgaagcgcgaaggcaaaatcattccattatcagaaagaaaggagggagcacatggctgacagttttagtgttgaagcgattttatccgccgttgaccgcaacttttcggggactttcaagaatgttgcgagttctgcgtcaaagatcggcgatagctttgaaaagtcgacaaagccagcgggaaattttgtatcaaccgttagcaaaattgctggagctataggtcttgtcaaagtggtaggggctattggcaatggcgtgagaagcatggtaggagaactagacgaatcaagcaaagcttggcagacgtttgaggggaatatgaagtttctgggtaagacgcctgcgcagatttcctcaattgaaaagtcgttgcaatcatatgctcagaagaccatttacagttcatctgacatggcttctgcctatgcgcagttttcatcagtaggcgtgaaaggagttggccgccttgttaaaggtatgggtggcctagctgctgccactgatgatcccaagcaagccatgaagacattgatggagcaaggcacacaaatggctgctaagccaatggtgcagtgggctgattttcgtctaatgcttgaacagactccggcaggcatggcagccgttgctaaagcaatgggcatgagtaccaaagaactggttcagaatgttcaaaacggcaaagtaagcacgcagcagttctttgatggtatcgaaaaggcaggcaacagcaaggctttccagaaaatggccacgagttacaagacagtcggcgaggcaatggacggccttcaggaaacactggcaaacaagcttcagcctgcatggcaggcaatgtctaaagtcgctatcggagttattagcggaatcattgataagattggcgcaattaattttgattctgttatatcatcaatcggtaagttcttttctccgttttcggcattgattttgaatataaagacacaactaagcagtttggggaagggcgactcgatgagcggactcagttccgttctccaaggagtcgggtccgttttacaaaccatttggagcctagttggtagcttagtcaatgttgcatttgtcaatctaattagtatcgctcaaaaggtcggagatgcttttaattcggcattcggtaatgggcaaatgtcgggaatatttaacggaatcaaacaagctgttacagatttcggagtagcagcaatggaagcgatgactaccgttgggaactttattgctaatttaccgtggaaagcaatttttgacggtgttaaggtcgctctaagcggagtggtagctgttttgaagccaattgcagctattgttaaagcagcgtttgctaacgacattgttaaatcatttgctgtggcgatccttggagctgtcggagccttcaaagtaattggattagccatcggcggattttcaagcgttctcggtgttttttctaaaatgattggccctattagaggcgctatatccgttatcactaacttcgggactatcgtaaaaacggctggtggtgtatggaaagcgtttggattgatcttaggcatgaatccgtgggtacttttgattgctgggattgcagcagtggttgctggtctggtgtactttttcacccaaacaaagaccggccaaaaactatggtcgggatttgtttcgtggttgcaaggagcttggcaaggacttgtcggggctgcgcaagcggtttggaacgcaatatcgggtgcatttacctctgcaattagcggcattcagacagcttggagcggcattacaggtttcttcagcaatctatggactgggattacgacaacggcatcagctgcttggacagcattcacaaccactctctcagctatctggcaaggtgctgttactgcagcaacggcagtttggaacgcgctatccacattcttcacgactctgtggaatggaatagttgcggtagccactgctgtatggtcaacttttggcggttccctgacgacaatttggaatgggattgtccaagttgctaccggtgtttggaacatgcttaaagcagttattatgggtcccattcttattgtcattgatttgcttactgcaaattggacacagctaggcgctgatctccagctgatctggaatagcattgtttcagccgctggacagatctggaatggccttgttacgtatttctccggtatttggagccttattcaaacttatgcaatcactgtttggaatactttagtttcagctttagaggggctttggaatggtgcagtatctgccgcttccgctatttggagtgcgctttcgtcatttttcagtggattatggagcggcattgtgtctaccactgaaggcgtatggaacagtgttgtttcattcttatcaggactatggagcggaacagtcagcacagccaagggaatttggaacgcacttcccggattcttttccggattgtggaacagaattacatcatttttttcatcagcttggagcaacataaagtctattgtgattggagctgctactggcatttttaatggtgctaaggctgtatggtctggttttactggcatggtaagtggaatcgttaatggcatcaaaggagcattcaatgaccttcgtaattttagcctggctgacgctggccgtgccatcatggatggcttctttaatggcctcaaatcagcttgggggaagatcacggattttgttggtggaattgcttcttggattcgcaagcataaaggcccaatccgttacgatgccaagctgctcatacctgctggtaacgccatcatgaacggcttaaatgcagggcttactgacaagttctcaaatgtccaaaagaatgtttcgagcatggcacaagctattgctgacagtgctgcagtgacgatgccggaagtgaacacttctccctttgatgcatcattgcagtcgctcaataacagtgttcagggcgcaaccttgtcttcaaatcttgatgtcaactacactcgcaagcaaacgattgaggttcctctgtacattgacggccgagaggttgctcgcgcaaccgcaaacccaatgcaaacagagctcagtcgcatgacacgaatgagcaatcgacgaaaggggctattttaactttgtatgatttcagagaaacaacgcccttcaagggttctgatgataatcagcgaccagcagaggcgatgctaatagatggccagtacattgaagacttgattccgggttatagcacgcttcaagtcagtggcagagaactactaagtcagtcaatcgaaaaacaaacgattggcaagtcagatggtgagtttatccagtatgttcggaacccttctcgtgagattgttgtcggctacaggcttgcagcagcggacaatctttcgttccggcaagcattctataagctcaacagcatccttcatggcgatagtcatcaggtttctttcaacgatgacccatcaaaatattggattgctactttttctgatattgacgatgttcctaaaggccggaatgcgatcacttcctcatttactttgtttgttcccgatggcattgcgcactcggtagccacgcagacggctgacaacatgccatacaaggacatgccaatgaattttgtcatagcttcacacgccagtggatccaacactacatcaccagatgtatatcccattcatatgcaactgtcagaagacttgtcaggccagacaataactaccgttgccaaggtagtcgtgactaactatcaaggaaagataaacaattcaaattctcaatcttacattgacgtaaaagacggtaactatacctgggactggtgggggttaattaaccaaattaatgttactggtaatggtgtttatacatcagcgccaagaactagaaccaaagcggcactactaagaggaacagacaatcatattgatgttgaaatgtacaatctgaatgccactattgaagtttggatcaagcttgaaaaaggcaatacagcaacagactggtcgcctaacccagcggatcctgaatactataccaacaccatcacagttcacaatggtggcacttatcctgttgagccagttattacggcaactatgcatgctgataacggcttaattgccctcattaatggccaaggtggtgttttacagttcggtaatccagaagaagagcgatagctaactagctaccgcttttttaatggaaggaaggtgtggtgatatgtgatgaaacacaagatgacggccaaacagcagaagtttgtcgaccaatacatcaagttcgggaacgcaaaacaagctgcactagaggccggatatagccctaagacggcgaaacagatgggagtagagaacctatctaaaccttacttaaaagcggctattgacgagcgtatgaaggcaatggaagacgatacaatcgctaaagccaccgaagtcctggagtatttcactactgtgctacgcgggaccgcgcgtgaaactgtggccgttgcgactattgacggtgtagagcaggtggataaccctccgagcatcaaagaccgcatggcagcaggacgagaattgctcaaacgctaccctgataatgatgagctgctcaatgctcagctaacgaagattattactgatattgagaaaactaaggctgacgttcgcaagtccaaagctgaggctgacatcatggaagctaaggccaagttgcttgctgatgcagattcgcaagacaggacggtgattgtcgatgacgtcccagaagatgattaagctaagcaagatggtgcaaccacatttctattcgttttggcggtcaaaggcaccatatctgatactgaacggcggccgtggctcgtttaagtcatcgacagttagtctgaagctactcatgatgcttaaaaggcaagcacagcaaggacataaagccaatgtcatcatcattcgagagaatacggttaacttgcgtgattcggtttacagccagatcagttgggcaattgacatgctcaaaatgacagacgagtttgtgttcaatgtatcgcctatgcgcataacgcatcgtggaactggtagcacattctacttctatggcggtgacaaacctgaaaagctgaagtctaacaccgttcgtaacgtgattgctgtgtggtatgaagaagcagccaacttcaaatctgctgaagtgtttgaccaaactaatccaacctttattcgacagaaatcatcatgggttgatcaggttcaagtcttctacacgtataacccacctaagaatccatatgactggattaatgagtggattgatagcgttagaggagacccggacttcttcattgacacctcatcttatctcgatgatgatcttggattcactaacgaagagcagcttagactgatcgacaagtataaagccaacgactatgactactaccgttggctttatcttggcgagattgtcgggcttggaaccaacgtctacaacatggatctgttccacctgattgatcatattcctgatgatgatcccttgatttacctatttctagcaatggatagtgggcatatatcgtccgctacagccttgccagtcgctgctgttacctcgaagggaaatgtaatcgttcttgacacctactactactcgccagcaaatcaatcgttaaagaagccaccaagcctcttatccaaggaaattcacgaattcttggcttcggtaaccaagaaatatcgcggcgtgaaagtcaaaaacatgacaatcgattctgctgaaggtgccatgcgtaaccagtattacagcgactaccacgttgcttggcatccagtacacaagctcaaagaagccgatatgatcgactacgttcaaagcttgctcgcacaagggcgggtttttgttttagacactcccaacaataaagtgttcatggaacagcatcgacagtatcaatgggacgaaaagtcgatggagtcagatgatcccaaagttatcaaagaaaacgaccatacagtagacgcattcaaatacatgattcttgacaatgctcgaattcttgggcttaaacgctaagaaggtgatgctttgaacttaatcaatacaatcaaaaatctattcaggaaaggaggcgcagcattgggagttgtacaaagccttgggcaaattaccgatcacccaaaaataagtgtagatccaaaagagtatgaccgtattgcactagataaacgttactttgaaggcaaatttcgcaagattgagttcagaaacacgtacggagatcttaaaaagcgtccttatgtcactttaaacatgatgcaagttatctgccgacggttggcctcacttttatacaatgagcaaagcaagattacgattgaaactcgccccgagaaaactgacgagtccggaaatacggtcgattataaagctccggatgaagcagatacgtttattcatgaagttctggaagacaatgacttcaataagaactttgagcgctatcttgagtcgtgcttggcactcggcggtattgcaattcggccttatgttgactacagcacgaagaaaatcaagctggcatgggtgcaggctccgagcttctacccacttcggtctaatacgaatgacgttagcaatgcagctattgcaacgagaactgtaagaactgaaggaaagcaaacggtgtattatacgttactcgagttccacgaatggagcgaaaacgagtacaccattacaaacgagctttataggtcggagacctcggatactgttggcatcaaggtagatttatccacgctgtaccccgacttgccaccgttggttaatctggatacgtctgtgtttacgcgtccgttattcgtttatctgaagccggccggattcaacaatagaaacatcaccagtccgttgggaatcggtgtttgcgacaatgcgctgaacactcttaaacagttgaatgatgcatatgatcaatttaactgggaagttaagatgggccagcgacgagtagctgttgccgatagtatgacggagatcacattcgggcgggaaggccagaaggaacccaaacaagtatttgaccctgaccagaatgtctttctgtcagttcaaggcggtggcatggacgataagacagtccaagatttaacgacccctatcagatcgcaagattatgtcgcatctttaaaccactttcttaaaacgcttgagatgcaagttggtttgtcttccggcacgttctcgtttgacaccgccggtaacattcaaaacaaaacggcaaccgaagttgttagcgaaaacagtatgacgtaccagacacgtaacagccatctgacaatggttgaacgtgcagtgcaagagctgtgtgtttcgatctgtgagcttgccagtggaacggttattaatggatcggcattatacagcgggacaattcccacgattgaccaagtgactgttgattttgacgatggcgttttcactgataagtctgcaagccttgattactggatcaaagccaatgctgcggggctcgtgcccaagcgtgttgccattgctagagcgcttgatgttccagatgaggtagcagaacagtatgctgccgaagtttcaaaggaaagcccagagccggttgctccgcaagatagccaatcaggtttatttgatggggacggtgatagctgatgcccaaagtgactccgcatcaattgacaatcgcacaggcttctattggtgatatctacgcatcgctagaacagacgttgttcaagatgttcattgacagattaaccaaccacggagcatttccgcttgacgaggatcacatgctccaatggcaagcagagcaacttaacaagctccatttggtcaatgaatcaacaatcaaggaagtaagcaaagctacaggaattgctcaaaccaaactagtggccttgttcaaagatttcgggattgcgattgcaaatgatgaatatagtcgcttggcaaaggacactggtaagaatatttcgcctggcactgacgtcgatcggttgcttaatggctatttgaagcagaccttcattgatctcaacaacaacgtcaatcaaacactcattacaaccaattacggccaaaatgccgctatgagaacctatcagcagattgtaaaagaaactaccgcacaagtgattactgggcttaaaactccagccagagcattagccgacaccatctataagtggcgagatcagggcattcaaactgtgctaacagataaaggaacacatgcttggtcacttgaaagctatgcgcgaatggtgattactaatacaagtggaagagcttttcaggcagtcagagatcaagcggctgatgactatggcattgatacgtttgtcatgtctagccacccagctagtcgcgctgcatgtgcaccaattcaaggaaagacagtaacaactcgctatcagtcgttccgatctgaaattagtggtgagtggttcgagtcgcttttcaatcatggctatggggaaccgggtggaacattcggaattaattgtcatcaccaaaaatgggcttatgtacccggcgcaaacaccaatagccaatcgcaatttgatcctaacgaagccattcgtaatggtaatgtgcaggccaaacaacgcgaattggagcgaagggtgcgcaagtacaaagccgatgcggacctagccaaaaagctgggcgatacagatggacagcagcattacaagcaattgatcagcaataatcaagccgccctgcgacaaatcgtcaaagatcacgactttttgtctcgggactattcaagagaaaaagtgttttcgtaaattaattcgacctaagcatgtcgtaaaactgctatttgttttacccaattcgcggtcgtaccgcgtcaaaaacacgtaagggagagattgtattgaaacgcgaagaattaaaaggattagagctttcagacgagcaaatcgaaaaggttatggcactccatggggccgatgtgaacgaactgaagggccaagtcagtcagctgacgacagaacgggatgggctgaaacagcgtgcgtccgactcggacaagcaactgaacgagttaaagtcagcccacaaggatgacaaggactttcaggctgagatcgacaagctcaaagccgacaataaggcgaaagatgatgcagcttctaagcagctcaaagaaacccagttgaattatcagactgagcttgctctggtgaaagcaggtgcattgaataccaaagcggcatcagccctgattgacaaggacaagcttggcttggacgataagggcaatgttaccggattagatgagcagcttgaagcactcaagtcagatgacagtagcaagttcttgtttaagtctgaagaggcacagaagccaaatgacacaccaccaattacagtacctggtaaccctaatccaaacgcaaatggcactcttaatccagccactgccacctatgaagagttggcggcaagcatggcacatgaagaataagaaaggatgatttaaatggcttttccaaatgcacaaacgaccgacaagtccgcaatgattattcctgaggttatggctcagatgatcgcggcacggcttcctaaggcaattactttctcgcctctcgcaacggttgataacactcttgtaggtgttcccggtgacactatcacggttccacattggaagtatatcggtgatgctgtcgattttgctgaaggggatagcattgactactccaaaatgcagaacggcaaaacaacttcgacgatcaagcgagctggcaaaggggtagaaatctctgactttgctgttcaagttggacttggcgatcccaagacggaagctgctaaccaactgtccatggctattggttctaaggtcgataatgattgcgtcacagcattgctgaatgctcgtctgacactgactcatgcggcccctgatcttgacttgatcgacgcgatcgaagccgcttttgaagacgacactagcgagttcaacaccgaaggttcttcaccagtgcgtggtgtgctttacatgaacttgaaggactacaacaagctccgtaaggctgcagcatctgactacactcgggctaccgaactcggtgatcaggttctgacaagcggtgtactcggtgaaatcttcggctggcagcttgctacctcccgtaagattcctgttggtacttacttggctgttaaggctggtgctcttggtatcaacatgaaacgtggcgtggaagttgaaaccgcgcgtgatattgaccacaagacaaccaaaatcaacgttgatgaatactacggtgtttggcttaaagatgacaccaaggcgcttgtcgttaatactccagcagcaccaaaaggatttgatccaaacggtagcgttaagccaactgatgctcagaccgttgatgaaatcaaggcttggttaactgcccacagcatcgatttaaatggaaagacagcaaagtctgatcttttagcgttagttccaactaaatagtcaacattagtcgccattgaaatgcacaatagggaaatcccggcggctttgtgaggtgatgatatggcctatgtagataaagatgattacatgcaggcaatgcatattactgatgcagatgttcctaagaacttcgatcaattggcagatttggccagcgaatatctagatgaccagacacgtggtttttatcaagataacgaccttgccagtgacccgtggccacttcgtgcaagtaagtttaagcgggcggttatccgtcaaattgcttacatgattgattctggtatcaccacaacagagcaagccattagtcagcctacgagtgtttcgaagacaattggacgtacaacggtgtccaagtcgtggaataatagccagtcctcagttgctggccaacagcgctcggctatcagtgctgatgcgctggcagctcttagcggcactgggttgctataccgaggtgttgactatgttcgatgagatcgatgacttgatatcatacaacgattcggtcacgttgttccgagtgaccggtaaagatgactggcagaagcctatttacagtgaaccggttgtcattgggcacgctagaatcgatcgcgggacagtatattctggaaccaacaacgatcggcaaattgttgctaaagccgtcatttacattcgatgcgctggcaactcagacatgccgttgcttgatgatagttggctgcaaggacaggccgaatttgacagtcgcaagtacaccattactacagtcaacgttttaaaagatgctgatacgcctgaaatatgggggtacgaattggaggtgctgtgatgggtgtgaaagtaacagttgacgttgatttgatgagtaaacttggaacgaaagcccaaaacaaagctctcacagccgctgctactcagctcgatacagaactgactgattataatactggcgttgtaccaaggcttaatggtgacctgcgggggactgcaactccgaacggtgcggacgttgacttcgacagtgcttatgcggcagctcagtttaacggtgggtatacgaaaaaagatggcaccaaggttgtttttcatcattggcataaaaaaggaactggcccccactgggacaaaatgattcaggcaaacaatcaaaaaatggaacgaatccgcgatgcttatctgaagggactgaacctatgaacgcattgaaaacgttgacggatgcaattaacacgattcccgatatgccacagagagtcagcatgggcttcctttctgctgatgaatcgctttcaatctatccgacaaaaaacgggtcggtgattgatgaagatttcgccggcaatcaagaaactcggctgtattacgaagttgctattcgtaccaaggatcagcggttgggcaacacaatcatgtggctagtctctgattttgttaaacacttgaaggaacttccgtctgatgatttccactttgaaaaaattgaaaccacgtctgaaccaagcatcacccaagccgattcacgtggcttttttgtatacacgattgatatcgcgatgaacgtaacagcaaataaatacgaggagtgatttttcatggcagaaaaagaatttaacttgaactttaaaaacaagttcgaaatcgatactaagggtggtaaagacccgtcggatgtcgctggtgcaacctttgtaccattggcggccggcatcaataactttacgccgactctgaatgaaacaacggctaatgacgtctattacgacggtgaaggttatggttcgactgatgttacaggtaaacgtctccagctggcttatacaggccaccgtttggaaggcgacccagctcaggactatatcgcaagtcacttgcttgaccttggcgacaaactcaagactttggcacgttggacgcaagctgatggttctactgttgttgggctagttactattagcaatattgttacttctggtggtgctccaggtgccaagcagacaatgtcattcactttggcattcaacggcaagcccgtttatactcctgcgggcccaaaagtgtaacggtgagcattaaagtgagagaaaccacggcattaacggctaaagttagcccggaagatgcgactgacaaggctgtttgaagattgatagtcagcctattatttcaaacgttgaagtacctgttggaatatcaattcaaggatatacttaccaaggtactgctaaggatgcgcaaggaaaaataagagagcgtaaaatatcttgtgtaaatgcataaaagatttctgaatcgtatagaaatagggaatgccttcccttatgatatttagtaaccacagaaaacatcacaggaggcattccccatgaatgaacttaccacagaaattatcgctgcactagcccaaaagcaagatttggacgaagtttttcgtcaccacctcgaaattgcgattaaccagctgcttcaaaccgaattggcagagtttttgggttacgaacgctactcatacgctgggattaacactggtaataaccgcaacggcagttatgagcgctcgtttgatacgaagtacggccaacttgacttaaccattcctcgagatcgcaatggccggtttgaaaatcataccttgccagcctacggtcggcacagtgataatttagaaacaacggtcattcagttgtataccaggggaattaccactgctgaaattgccgaactcattgagaaaatgtacggtgctcactactccaaagccacggtttccaacatgactaaagccgtcaatgaacaggttcaagctttccagcaacgtcgactggcttcacaatatgcggccatcttcttagatgccacttacttgccgttaaagcgggataccgttcaaaaagaagccgttcatattgcgattggcattcgtccagatggtacgaaagaagtgctgaactaccaagtggcgccaacggaatcgactggaatctggactgaactgctgggaaccttgatcaagcagggcgttaaagatgtgctgttgtttgtggccgatgggttagttggtttggatgaaggcttgaatcggcatttccctaaagccaaacgacaacgttgcctggttcatgttgggcggaatctgatgaacaaagttcgcgtaaaagaccgcaaggccgtgatcagtgactttaaacaagttcatcgggccgccaaccgtgaagcagccgaactgaaactgaatgagttcgccaacaactggcatcagacctatcccaaattaatcaaagatctgcttaaaatgccgaatttactcactttcatggactttccaccagctatccggcaatcactatactccactaacctgattgagaactttaataagcatctcaagcgcaccacccaccacaaagaacaatttccaacggaagattcactggatcgcttcctggtttctcagtttaatgtttataacgagaagtctctgaagcggatccaccgagggttcaaaggactccaggaccccttggaagcatcatttatttaagttagatacatattatatgtacgaaggcatttcatttacacaaacttcttgacactcccaaaaactcatctcctaaaacgacttagcttttaaagtcatcaatgtttggacttattcccgtacacagaatcgaactgcgtctagtcaccagaacgggaagcggcatttaatttagtaaattaaattgagtgaataatcgcactaatcccagtaatcataaagaataatcctactaggtaatagattgataagattgaaaaggcgggataaatcaataaaagaacacctaaaataatgccaattacggataaaatcacgtcaaccataaaatacttttcgttaactaacttgataatgttcgaaagccataacgatattattgaatccatcaagaacataattgcaaacgaaattgcaacaaatagaatgccaaactctccgttgaacaacattaaaattccgataataatgtcaacgaccgcgttaaaaacgacccatccagaattttctaaagcacctctaagaacggttaacttgtaaatcccggacaaaattgcggtaattgctgcaataacgactaccgcactgaaggttgctaggggatttcttaaagaaatgaccgcaacgaaaatacttaagatcccgacgacaaacataaatgggtcaaatctgtccaataacttattcatataaaattcctcccaataatgtacagcttttatagacatcagattgttggtcgtaaattaaataatgctataaaaattgatttcggtgtaattttacatttgtgggtggtaggttgcaaatttaatccgaatttttggacaaatttgtcagcataacctgacactcattcctacaaaccccaacccaactttttcatttttactcctccaaagtagaaatcgccagtcggcctcccaccggctggccaatacataagcaaacccgcgtatgaatgcgcgggtttttgtttggctttatttagcaataggcacaacttccctaggcagtttatatcattaagaacaggtattgtgagtttggaggggtattcgttttgaagaaaagaacatgggtgataacaatcacaggtgtcgccattttattggtgattacatttggcgtcatactcattcagaaaaacgacgcagaacgccgattatcattagggcgctcaagagcatcaattatgtcgacatcaaaagtgaaagcgtcaaagtggcaagtctctgtttcggaagcacaaagcaccgcaaactcaaaattttatgcagataaaacgtcaaaagatgctgcagcttcatcagccattgtcgcatctgaagcaaagagtaaagcagaagccgttaatcatgttgacttcaataagttgagcaaaattgaccaagcaaaagcggctatctattacggattaggcaacatgcaatattttaacgacaaaagcgtcagtaattaccccggagacgctgtttattcgagtagcggcgttgatgtggtctttgtaaaagatatgtccgcaggcattggcagtacaccttatttagtagcgccccatctttctcaagtaagtgctgcagcaccagtattttcatacgtcgaactaggtatgcaagcagatggtcaccgacctgaaggattgacatatggaaaagttgatgataattcctccagctttgttatcgatccaagattacatgccattggtctttccttttcaacagtaaacgactggattaattcacatggaggtatggccgctgttcaaaaaatcaacatcaaccgttttattgactttgaccaagagtaatgccaattttgctagcaaacaactaaattgattctcacaaattcagtatgcaaaccaaaatttaagggggatgccaagggtgactcaaaaataaagagcaatagcttagtcctttttactagctgcttaaatctgctatttttctgtatttgaataacacaaagaccatctttgcttcacaatttcgtcacacctagcctgtagtattagcaacatagaaatgagccacccactcattcctacaaaccccaacccaactttttcatcactcattcctacaaaccccaacccaactttttcatttttactcctccaaagtagcaatcgtcgatcgtcccccaaacgatcgcaacaaaagggccgcccacccagcggtcctttttgctacacccgatcacaagcaacgtgaaaaattctcaatcaaaaatggcctcctgaccgaacgtgtcagaaagccattttggttaattaacgattaaatatatcatacaatgcatctggtgtctgtgctgcttggaaactcttgacgaagtcttcgtgcgtcagcaactttgctgtattggacaagtacttcagatgactgccgctgtcatgttctgggatcaagaaggagatcacggcattgacaggcttgccgtcaaaggttttccactcaacaggttgcgccaagtgcaagatcaacatagccgatcgtttgatggtttcatcttgagcatgcggaatggcgatccctttttccatccctgttgatccttcctcttcacgcgctacgtacttcttgaaaatggcgtctgcgtcggtggcaagtccatccttgaccgccatgtcagctagataatgcaaaacatcatctcgcgtcttagcaggtacgttgacctcaataaattctttgttgagaatttcgccaggatcaaaactttgatcatcatcggtggttggtgcaggttgattgcgagcatcgtcgacagctattggggcagtagcgacatcgtcatcggcagcttcggttgctaacgccgcttcaacaacaccggtttttacaccacgttttctagccgaccgaccagcgatcatggcaagcagaacacctgatgctgcggcgcctaccagaatccatgcaacccagagaaatggcttattgaccaacggcaacacgatgaagccgccatgtggtgcaggcacctgaatgcgtgacatgtaagtcaaaacagccgcaattgccgaaccaaccatgaatgctggaatattcattaacggattcttcgcggcgaatggaatcgcgccttctgtgatatgcgtcgagccaagaagtgcattgacatagccagcactgcgttcatcgcggttataagctttcgggttgagcagaaccgaaatcgttgttgccaacggcggggcaatgcaggccgctgacacaccagccatgaagaagtaattgccttgtgccagtagtgccgtcccggtcagataagccgctttgttaatcggtccgccaaaatcagcggcacacatcacaccaacgacaatacctagaatgatcgggctggagctttcaagtccttttaaccaagccattaagcctaagttcatcgccttcattggcgtattaatcaaaaacataattgatccggcaatgaaaacgcctaataccggatatagaaaaatagcttttaacccacggaactctctgtcaggcatgaaagcaaatgccttttgcaataataagatgaccaatccggccatgtagccaccaacaatagcgcctaagaaccccgacccgttgccgccgttataagcaatcatgccgactgccatcccaacgatcaagccggaacgcttagcaacagcttcaccaatataagcagccagcactggcaccatgagtcccattgctgcaccgccgactgcattcagcatggctgcaaactgattgtattgagcgttcttgggatcggcagaataaatgccccagaagaaggaaatcgcaatcaggacaccaccggcgaccactagtggcaacatgtgtgaaacaccattcatcaaactcgtataaattttgttcccgatacctgctgaactggtttcggtcttttcaccggcttcagccgtggctttgccacctttaggcatgaacaccgccgtatcgctgcttaacgctttttgaatcagtttagccggttcgcgaataccagcagcaactgggacattgaccagtggcttgccagcaaagcgatcggcgtcgacatcaatatctgatgcgatgacaacccctttagcgccgctgatttcttcttgtgtcaacggatcgtccaccccggtttgtccgtgggtttcgactttaattgtcaagcccattttcttagccgcttgttccaaggcttcctgcgccatgtacgtatgagcgataccagttgcacagcctgtcgcggcgattaaatcatactttgccattacttaaccctccatcttgcgaattttgatttgtcctaacaactcatcggtatttgaaaaatcagtgatccatgcctgtcgtgccgtgtcactgccagccgcaatcgccagtttcagcgtctctgccagatcatgatgctgatacaacccggctaaaaaggtcccaagcatcgtatcgcctgcaccagccgtgtttagaacggcaattttaggagcattgccaaccagcgctacatcgtgattcatgaacaaggcacctgccgcaccaagtgacactaaaatgttctgtgccccagcttccaatgcccgatgacctagcgtaatcatggtcgttaaatcagcctccccggtctggtggaaccaattcatcaactcaacatcgttcggtttgaccaacagcggcttgtaagccaatgcctcaactgcttcaggatacgcactgtcaatgatcaactggaatccatttttttggctcaatgcacccagctttaataaaaaggctggcgcgatgccttgcgcaaaactaccagacacgcataaccaatcgtctgaccccagcgtggttaattgttggtataattgatttaatgtgtccgcactaatctgcggccccggattgaccaacttatactccgtatcggttgtcacaacccgcgcaaagacattaatccgggtaaagccagcgtccttataaaaatgatttggcacaccttgttgcgttaaaaagtcggcgatgtaatcaaacgtaaacccagcaccaacgccaagcgccgtattgtccacgccacgccgtttcaaaatgcaactgacattcacccctttaccattggcttgcacatcataactgtcggttcgattaaccgtatttggcgccatctgttgggttttaataaatagatcaattgcgggatttaaagtcagggtataaatcaagttaagcgctcctttgtgtcgtttgttttgcttatccttatgttaaccgctttcagccgaaaacggttttcagtttcaggcgaatctgcgccagtactgaaaatgcttttcaggaggtcaaattcatggctacactcagtcccaccgaagcgtacctttgggattacatcgaaaatcatcagcaagccgtcgttaacgcatccatcacccaactcagtactgcggccaatgtctcccccgccaccgttgttcgcaccatgaagaaaaaagggttcaatggctataccgatttccgccacgatttgttaaaacgcacaggcgatgccgcaccgttcagcattcttgaccaagttgacgaccaaatcaaaaaagtcattatgcaaaaccaagtggaagtctataatacgctggaaaatttgaaggtttctgtcattgaagactcggttcaattgctagctaaggccgaaatcgtcctgattcttgcgcgcggcttatctgaatcaattgcgtcggaagtcactttgaaattgcagctcttaggtaaatacgccgagttttttagtgatccgaatatcattcaaacgattgccggtcaggtcagcccgaaggcagtcgccattactatcacgttgaatggcgaaaccccagagcttgttgctgcggcaaagactttagcggcgcgcgacattccgcaaatcattttgacaaccaacgcagaagcgccaattgtccaatatgccgatgagttatttgtcgggtacaaatccaaagccgcttacttcgacaaatatgaggtggcatcacgcctgccgctgcaagttatgagccgtattttgctggatagttatgttgtgcggaaacgtgggcagaaaagttaacggtcactagcaggctttaataacttgctcgtaaccacataaaaaggcaatgatcacttgagaaaacagtgatcattgcctttttcacttcatccaaccatcaactatgcttttggtagcggccgatgtttaaatagttgtgttgcagcgaccgcttgttgccagccagcgtataaattctcgcgccgggcttctgacatctgcggttcaaaccgcttgccgatcttgaaaatctttttgagttcatccgtatcttgccagaagccaaccgctaatccggccagaaaagcggcgcccattgccgtcgtttccaaatttgccgctcgttccaacggcttacctaaaatatcggcttggaattgcatcaagtaatcatttttagcagcaccaccgtcaacacgcaaggcggggacagcgatttgggtatctttgtacatggtatcgaccacgtcgcgcgtttgataggctagtgcctgcaaagtcgccttgatgaaatctgttttcgtcgtgccgcgtgtcagcccgaaaaccgcaccgcgggcttcagcatcccaatatggcgcccccaaacctgtgaaggcgggcaccacatagacttcatcattactggttgatgcattggcggccatctcagtatctggtgactttgcaaccaaccccatttgatcacgcagccactgaatcgctgaaccggcgacaaacaccgagccttcaagtgcgtaattaactttgccgtcaatgccatacgcaatcgttgtcagcaaattgttcgcggacatggttggtttttcaccggtgttcatgacaataaatgagccggtgccataagtattcttaaccataccgggtgccagcgccaactgaccgaaaagtgcactctgctgatcgccggccatcccggcaatcggcacagcactgccaaagaagtgataagccgccccttcgccgtatatttcggagttactgtgcacttcaggcaggatcgcgcgcggaatattcagcagttgcaggatgtcgtcatcccaatccaatgtatgaatgttaaacaacatggttcgacttgcgttcgtataatcagtcacgtgaatagcgccaccagacaacttccagcttatccacgtatcgatcgtgccaaacaataactcgccattttctgcgcgctgctgggcaccgggaacatgatccaaaatccaacgaattttagtcgcagaaaaataggcatcaatcaagagaccggttttctcatgaatggcatccccatgccccgctttgcgcaactgttcagcaatgccattcgtttgtcgtgactgccagacaatcgcgtgataaatcggcaagccagtctttttatcccagaccaccgtcgtttcgcgttgattcgtgatcccaagtccggcaatttgactaggctgaatccctgtcgaaatgaaggtgtctgcgatcgttgacaacacggcttcccaaatttcattagcatcatgctcaacccaaccaggttcaggaaaatattgggtaaattctttttgcgcctcacccaccatgttgccggcgtgatcaacgataaccgcccgcgtgctggtggttccttcgtcgattgccatcatatacttgtctgccatttttgtatccccctgctaatgactgtttccgctttcaattcagtataccggatgtagcggaggaggttaaggttcagatggtttaaaaatcccaccgcctcaagtttagccttattgcaacgattagatccggcatgctataatgaagatacaaagaggtgcgctggcctcaaacagcactccctaaaaagaccgtcaccaaaacttcgtcaaaaggtttggtgacggtcttgttgttgtctaagatttgaaattgacatcgttgcgacgccttgatactgcatgctataatgaagacacaaaagggagcaccggccataaccggtactcccttgacaagaccgttgaagacggtcgacattcgtttaagcaatcaattaagaccgtcaaactctgtcaaaagttttagtgacggtcttttttctaccattagtcaagaaaaagctgatttgatcacaattctcttttctttagtctggccttgttgtaggcggtaaaccgccaacaacaatttcacggctgagccccctcgccgctccgccagctcttgctttctatcttagaataccgatgacgcaactacgctgttgtactcatgattgctcaaatgatcagagaatgccattattgaattttcgtcactttgagagacagaatcaactggaatatcgttaccttgcttgcggcgatgggacatcagcgaaaattgtgctcaatatcagcccactcttcgggttgataaagtgaaagagatttagcctcagcatatgggtggttaatttttggcactaatgagtaacttccgctcttgtcaggaactaacagaaaagcatcccccgcttgaaactcgaaccacttggcagcgatagtgctaatgaggtaccgagttttataactttgacatccatcagattaaacgcccctttttattttccaacttaaatgactcaggacatgtaggaaaccgcaaatcaattctgtgatgaaataatattgttaaaattccgctttaactgcaacaagcgggaaaagtcttctaggaaatagaacaaacgcgcgcggctttcgaagcttgcgcggtctgttggcagcgctgatttagcaaaatcgcgttgaatttttttgaccatggtgaccaattgtgtggcgggattgtcttcagtcagaacactggccgtcatcgccaaggcatcgctgataacggctgcttgttccacaggagtttcgatacggtcaaggctgtcttgcatttgccggagcaactcatattgattgtcgcgcatttcaaaataggcttgaaaataatcgttatcggccagcaattgattgtcactatggcgattggcccaagcaacagcggcatctaaggtcattttcaaatctgacagattcgcccaattgtccgcacttttaatgtgatctggacccaattgctggctcatatgatcgagaatctcgcgcatctcggcttcgacttgtgcctgaaactcagtgattttggcttccagacttggcatgaacaaattggcaatcaatgccacaccagcgcccactgcgagcaataatagttcatttttaatccagaaccaactgcagcttttcgccatcataaaatgagtgactagcactgcggtcatgacgataccgctctgcaccgcaaacacgttggtcaaaggaatgaaaatgagtaagaaaagcccgaaagccagtgcattgtaccccagcaccaaaaatgcaccgatcgcaatcacaaaacctaacacggtcgccaataagcgatacgcgactagccgaaatgatgccttggtcgtattctggactgataaaatcgtaataatcccagcggccgtccaatattcaaggtgcaactcgtaagcaatcagcattgccgctgccgtccccactgctgttttaaccgttcgcatacctatgtgcatggccatcaccctccagagtcagtttagcatagaacattccatttaatgaatagtcaacacatgtactcgtcacgccccgctagtatttaatcgggctttacgctaccatataaacagaggagctgctatgaaaaaattactcattttgttagccagtctggcagtcttgattgttggatgctcggcgactttaaatcctaaaagccagttaaaaaccacaaccgccaccgttcaaacgcaggtgcagcaagaacaagatgcgttaaagacgattggatcaacggtaaacgcctttccttctgcttttgaaaaggcttaccaggaaaatccgcaaactgatttaaaaaaagaaaatggccctgtcaaaaaacttttggataggcgcgccgcggcgtttaaatcactagaagccgccaacagcgctttggttggggcaaataatacgttgacaaagctcaacaatcagccatctgaggatacaccgcaaacacagttgaataacgttctcacaagtctgaaactcgccaagttagatcacaaaacactggtcagttattaccgcgaaatgttaacggctgaggataccttcttctccaccaccgcagatagtgacacctcacaagatgacttagaaagccaaatttctcaagtgaatcaatattacagttcgctcaatcaacaaatcgatgtcatgacggccaatctcacaaccgtcaccagtcaaacagataaactagcaaaagccattaagtctatgcgggattagttttattataacggcaccgtacgagttgacacgtcaaattattttcccagccatcatcaaattaacgcaaaacaggaggccttctcatgccgcaaagtgtggcaattatcattccatgtcataacgagtcagaaaatgtcccgctgatctatcaagaacttgttaaaacattccgcgacgacttaaccgcgttacaagctcaaatttggtttgtcaacgacggttcaagtgacgatacccttcagcaaatcaaacagttacaagcaaaagacgatcaggttcacttcattgatctttctcgctcgtttggtaaggaggcggccatgtatgctggtctctccaccgcaaaagcagactactacgccgttatggatgctgatctgcaagacccgccagcgatgcttcctgatatgtatgccgccttgcaagacggctatgatatggctggtgctcaacgcactgaccgctcaggcgaagctcggatgcgttcatttttctcggatttattctataaattcattaataaagtctcgcaaactcaaattgtgccaggggcacgggatttccgcttgatgacgagacaggttgtcgaagctgtcattcaaatgaccgagcgcaaccgcttctctaaagggctattcagttgggttgggttcaaaacaaagtatctgccttatcgcaacatcgagcgtcaacatggggagacgagctggtccttcatggggctcttgcgatacgcgcttgatggcatcatcgacttctctgaagcaccgctaactttcgtctccattcttggtatcgtgagtttcgttggctcgttttttgctttaatcttcattgttattcgcgcagctatttacggtgatccgaccgctggctggccgtcaatggtctctatctttctgatgatcggcggcctccagttgtttgccctcggcatcgttggccgctacatcggccgcatttacttagaaaccaaacgacgcccgatttttatcgctcgggaaatcaagtaattgaccatcacatcattgggcatcattcaaaaagatttgggcttaaaaatcttctgccgtgccaaactccgcaatatgctctatgaaaaaacgaaaaacggctgcattttccacaatattggaaaatcagtcgttttcatttggcaactatgattctcaccttaaccctagattgtttttactcggacccagccgttatccgctcatccgttgcccgttgcctacgtgtttcacgcaacaaccaccagccgccaaagccaaacgcagccactaaggaaagccagccggtcacatgttgcagcgtcgtacctgtatagacaactcgaacacgatgcgtgcctgctggtgccgttatcgtgatctgagcatttttcccacttggccagtagtcaactgtcttaccgctaatggtcacatgataaccgacgtagccaaattttggcagcttcagggtcaccggcttgctgctggtataggtaaaacgcatatcattgtaagtttgggtcggcatcgttagccgagtcaattgatgagaagccgttaccgaataagttgtctttttaaaaaaagtcgttgaatcaaaatcttctggtgcatactcactcccgccgccagttgcatcttcataataagccgttgcattctcatcggtgatgcgataaatgttggcattaagcatcgtcgcattgatattcacggcataactgaaaccgacaatgcaggttgccagcaccagcccccaagcaacatgtgatgaggctggacgatccgccacgatcaacccaattgccagactaagaaataaagtcgtcagctccaagtatcgccaagggaattggatgacaccgaagatcgttttgctaaacaacgaccacgggaacaaattggtgcttagaaagatcgtcaacagccctaggccagcaactaccttaaccgcttgattcaatttccgccaacgaatcaccagcacaatggctgtcattaacatgaaaatgcccatgccaggtcgaaaggcttggccgacattctgcatattactggttgaggcatacatactcagggagttctcaaaaagatcacccaaactatagaggatgaagttcggccagatcgtcgcagactcgcttaacttcaacgcaatatgactggacatctcaatcatcggcaagtagctgcccagtcccatcagcagcgtactgatcgctgccagtatcgtgtacttgaccattcgccaagtcacgcgccgcatgccaaccaacacgagaaagccgccaaccaaaaattccagcaccatgaccagcgacaacatatgcgcatacatcagaccggtcacaccaaacgccagtaaaaaccagttatcggttcgtttgacgtaaagctcatacatgcccgcggcgatgatcggcaggaaaatgaaggccagattttcacccaaggccccccgcacaaaggcgtctaaggcccggtagaccgcagtcgtatacaccatgctgaaaacaaacgccgccagcggttttcgccgaattttcaagaaactagcgtaggcagccaatactgtgacgatgagaatgagggcctgataaccatcatacgcaccgaccacccccatccccatcagccgtagccacacatatggcaacaacattaatgaaggatagtacgcgtcaaaagcatagccaaagttgcggactgcctcaggaaaaaccttgggaaaatactggccgtgccgcacactggttacatagctttccaaccgccgcagctgtggcatcgtatcgtcttgatgaaaaatatagggtagatgcagctgcggccactgcacgagcaaaaccaagaccatcgccaaaatcggcaacagccagacagcattttgtgtcatgaatgtcttcagctttgctgatgatgtctgtgcgtgcataaaccgtcctcccaaaataactttcattctattgtaccgttccccgatgctgtttgtcttaccggaaaagattattttcatccctttgaccacacgacctgatgtcacaagtatcaccaattgctacgttttttttaaaatagcagccacagcgctttcattgcgcttccggtcacttttcagttcaaagacgcgttatgattaagttaatattcaagacttgcttatttttaagtcagtcattttttctgctatcatattgtttattaacttttgaccctaccgaattttcgaaggagtccctctctatatgtcgcgatttaaaaagcatcgaacatggccattattgctcatcagtttcagcatgaccttcaccatcagtctgatcgttttcgccgcgttaaaaatggcgccttttggctcgtcatctattttggcaaacgattcagccgttcaatatgttgatttctttacttatctgaaacacgccttaatgggcacagctggcaaagcttattctttctccaacagtcttggcggcggcatgtatgcaaattggacctattacctgttaagtcctttcaacttgatcttcgtgcttgtatcgcgccaagccattcccgtggccatgctgtttgtgaccgcgcttaagtacagcaccgcggctcttgctgcgcaggtattggccagccatcgctatggcaaaaactggtacaccttggtcttcagcgtcagttacggcctttccggcttcctgattgccaactttctgaatatcatgtggatggacggcgtgattttattgccgctcgtgattttaggcattgaccgcctctttgaagaacaccggctcatcccctatgttgtgccattaagcctaagcttcatcacgaactattatattggtttcatggtcgccattttctcggcgctgtatttctgctggcaatgggcgagtcaccatcagcctcaactgctgcgcaaaatcgcgcttttcgtcggcgggtcgttactgagcggtatgatcggcgccatcgtcttgatccccacttatctggccttaagtgcctcacgtctttccagtgctggtgcggatttcaccatcaaaccacttttctcgctgatcgatctgccgtcaaaattgattcctggcagtttcaactttgcgcagttatcaaatggcctgcccaatttatacatgggcatgatcgccctcttaggcgctgtcttttacttcttagctccagcaatctcggttcgcgagcgtttgatttccggcgtgatgactgtgattctgatgctgtccatttggctcaacccgcttgtcatcatgtggcaaggttttcgcgcaccggtttggtacctttatcggcattcttttattgtcattttctggttgttattgctcggtttacgcggtctcgccaacctgccatcagtctcacgtctacgaatgatcatcgccagcgtggttgtcggcggggtcgtcttcatcccaaccgcttggcgcatgggcagtcacaagtatgtcaccttgaccaacctcgtcctcggcggcgtcttgctcttagtagcggccatcttactgtatagttgggcgcatcacctgttcccacaaaaatgggtggttggcggtctcctaaccttgctggtgctagatatgggcgccaatgcatacgcgagtttcaaagccatcagtttcatctcaaaagcagacttcaccgttacaagcaaggcgcttaacgcggcttacaccgaagcgaaaacactggcgccaaatactttttaccgggtaaacagtgatacccagcggtccatggacgatccttatcagtacaattttaacggtattagcaccttctcatccgtcctcaacactagcacgatcaatgcgttaaccaatgtcggtgccattggctcagccggccgcgtgaaaaacaacgatctgacttggccgctcgaaagcctgctcggtgtccggcaactgttgctggtcaatacgcaaagcacgaaaacgacaacgcctgaataccagcagatttcttctcgaatcattgacaacccccgttatgatctaccggcatacaagttgatcggtcataacgattatttcaatatctaccaaaatcctgatgcgctccctgtggccacccagatttatcgaaaagtaccgacacaggtgcaagctaatcccgtgcttcaacaaaatgcctacttcagcaccttcacaccggaaacaatcggcgcaattttcacaaccaccgatttctccggcatcaccgttgacaacgtgaagccgctgaccaccttgaccaatgccattgccaccaaaaaggataaaaagctcggcgcgacgattaccttaaacgtcaacccgagtaccgagcagcgttacttggtcatgagtgaaaacatgcgcaaaaacatggccatcagcatcaataatgtgccgctcaaaaacgatcctgacaatggcagcaaaacggtctcattacctattgacgcggaaaaaccgactactgtcaccttaacgttcaaccgcaacattgatcagattgatctcgatcattttgctttatataccctcaatcgccaaccattcgaacaggcggttgcggcggcaaaacaacacgcgcctaagcaagtcgtcaaaaacggcagcgtcactttaaccacccgtcaaaacaacagcggctacatcatgttaaccatcccctatgaaaaaggctggcaagttgataacaagcaagtgaaaatccaaaactatcgcggcttcatcggactcaaagtcccttcaacaaacctgaaattcaccttgagttatcacacccctgggatcaaagctggctggaccgtgacaagccttgggttaatcggcttaattgtcctcgctttccttgaatactggccacgaaacgggaaacatgccagtctggttaactggcccgcgcgctttcggaaaatgtggcagtgatcagcaataggaaaaattgaaacggctaggatagttgaggtaaaaatcctaggccgtgccaaactccgccagctccgccttggcactaggatcttaaattccgactgctgacaaaaaagctcaatttttcaaagggtaacgattttgttcgaaagcgttcttaagcgatcattcagccccaaacgtgctgaaccagtctttaatataatcatattcatatttataatctttcctgaatcaaaagattaatgattaaaagataaaacaataaaaatatgtgctttcattcatcgaaatggttgcgttttctatagtcatcatgctaaaatacattgaccagataacgcatcacaagcgcatgttactgcttatgcaggcaagacttggattatcgtttcatcgcaaacgattttcttcagtctgcctgcttttttgtgccaccaaacaggcgcttcacaacaactggcacgcgtcctttgcaaaacttgcggtcagtggcggcccgcaggcatcacacgaacgacttatgaaaggggtgtccgatgtttcgcatcaaaaaagtgctcaatgtcaatgtcgtcctcgctgaacaggacggccacgagtatatcgcgtttggcaagggcattggctatcggcaaaaagtgaacgcctgtcttcccgacaacgcgatcttcaaaaaattcatgccgctggatgacagtcgcaaaagcgaaatgatccaatcgctcaataacataccacctgtttacatcagcattacctcacagattgtgacgtatgctgagcagcaactgcagctgtcccttcttcccagtatctactacgccttaacagatcatctggctttttcagttcagcgctatcacagcaagcaatcactgggtaatcggatttattgggaaatgaaaacctactaccccgaaatgtttgccattggcgaatatgggctgacggttgtcgaagcgaccttgcaattggcactcccacgggaagaagcggctaacattgccttccacatcatcaatgcaacaccagccgcggccggtaaagcgaatattttggaagtgacccagcttgttgacaacgtcttgcaggcggtgcgtgcgctgactggtggcacgattgacacgacgagtttgaattacgaacgttttgtcacccatatgaaattctttgctgagcgttaccttggtgataccatgctcgctgatgatggccaactactcacaagtgtctacactgtgtatccggaagcggccaaaatcgcacttaaagttcaaaaaaccattattgctatctacgaaaaagaaccgactaaggaagagttggcttatctcattattcatatccaccgggttttaactaactagtcatctcatgccttaccccaaccataacgcgcccccagcgcagcaaccgcgctggctcgcgctcactatccgaggaggaacacaacatgtctgaccatcaaaaaatcaccgatcgtatcatggcagcggtgggtggtaccaaaaatgtcaaaacgctcaatcattgtgcgacacgattgcggttcacgctggctgataaaacccagttcgatattcagcgacttgagcaaatgcctgaagtgctgagtgccgtgaactcaggcgacgaatcacaggtcgtcatcggtgccaatgtgactaaatattatgccgaaattaccaaaaactatcacatccgcgaagctggtgatggtaccaaacctagcgcggatcatgaaaagaacattttaaaacgggtcctgaatgccattgtcagcatcatggcgccaattatcactgtcttgatcgcaggcggcatgttcaaagtcgtgatcgcgattctcgccttgttcggccttgattccaaaggtgtcccctacctgaccctgagcttcatggccgacgcggctttttactttctgccattcatgctcgccgtcagtgccgccaaaaaattcaacactaatacttacttagccatgatgatggccggcgtcctgctacacccaaacttcaccgcgatggtcgcagccggcaaacccatcgccttgtttggcgcaccaatccgcctcgcttcatacggtggcagcgtcatcccaatcattctgatcgtctggttcatgagctatgtcgaacgattcgccgaaaaaatcgcaccgaccattatcaaaaccatgctcaaaccattattagtcgcgctgataacggcccccgtcgccttaattgtcattggcccgatcggtagcttgctaggagatggcctttacacggcagttaccttcatcaaccaacacaccccatggctggtaccaaccgttgtcggtgccttaaccccgctgctcgtcatggtcgggatgcacgtttccttgttgccgctagcgacgctgtcaatcaccagattcggcagcgaaaccatcatgggccccggcatgctcgccagcaatattgcccaagccggtgctgcagccgccatcgccttccgtgaaaagcaggcacgtggccgccagatcgcgctttctgccagtgtgaccgccttgtcagggatcaccgaaccggcgctttatggggtaaccttgaaatacaaacgggctttaacctgtgtcatggtctcaggcggcttggctggccttttcgccggactcactggtctcgtgcgctactcgtttggctcacccggtattttcaccttgccagttttcatcggcaataatcccgccaacttccgcaacgcgcttttcactgttgccattgcgttcggtctaacctttgtctcaacctatctctttgccattgtcgagaaaaagacccctgtcgacacgaacgagccagccatcaagtgccaaaacctgaaaagtgtggttactggaaaactgattcccctcaaagatgtcaatgatgatgtttttgcttccggctccctcggccatggcgttgcaattgctccggaagacgacctcatcgtggccccagtggatgctgtcgtgaccatgacctatcccaccggccacgccatcggcctcaccacagccaccggtcaagaaattttgattcatgttgggatcaataccgttaaaatgaacggccgtggctttaaaacgctggtcaaggcagaccaacacgtcaccgctggcgaaccgctgattcaaattgatctgaacctgatcgagcaggaaagcttcgatccaacggtgatggtcttgctgctaaacaccccagctgaccggattaacattcaaaaaaaagtgactgtgacgactgacgaccacttgttaatcgtcacccaagccgtttcagaagcgtaagacagagcgtgaacagccgcggtcagaagccaccttatgtgcaggcttctgagccagtgaacgcgttaaggagaaaaattatgacaaaccaacaattccccgaaaatttcctctggggcggcgctactgccgctaatcaactcgaaggtgcttttcaaactgacggcaaaggactctcaactagcgacttgctgctgggcggcgatgtcaacaccccgcgtaaaacgacccgtgagttagtccctgatgccttttacccaagtcatgaagccattgatcattttcaccgcttcaaagaagacatcgccttgtttgccgaaatgggcttcaagctctatcggttctccatcgcgtggacgcgtattttcccaaccggattggaaaccgagccaaatgaagctggtctggccttctatgatcaaatcattgcggaactcaaacgctacaacatcgaacctttgattacgatttcccacttcgaatcgccaatcggcttaacaaaggccttcaatggctgggcgactcgcgatatgattgccgcttacgtccggtttgccaaagtcatcatcaaccgctatcaccaagacgtcaaatactggctaaccttcaacgaaattaacatgctcacccgccccatgggtgcctatctggcaggcggtatgtatgtggacgattctgatcgcttcatcagtccagatgtcgactccgaacagctgcgtctgcaagcactacaccaccaattcgtcgccagtgccttagtaaccaagtttgcccacgagctcgatgcaagcttgaaaattggctgcatgctggcttatcgcatgttgtacccattaaccagcaaacctactgacattgcgctcgtccaaaccgcgacagaatttaataacttctactgtggcgacgtacaggtaaaaggccgctacgcctactttgccaagcgctattggcgtgatcacgacatccagctagatatcggcgctgacgatgagacgattcttgcggctggcaccgttgatttctacaccttctcctactaccaatccagcaccatgaccaccacgggtgaaggcgagcaagcaggcggcaacttcttcagcggcgtcaaaaacccctatcttgatcgtagcgactggggctgggaaattgatccacgtggcctgcgcacagcactcaatcaaatatatgatcgttaccatgtaccattaatggtcgtcgaaaacggcttcgggacacgtgacgaattgatcgaaaaagacggcagtaaaaccgtcgaagacaccgaacgtatcaactacttgcaaagcccacgtagccgccatggcagacgcgattcaagacggcgttgatcttatcggctatacttcatgggcgcccattgatctcgtctctgccagcacaggtgaaatggcgaaacgatatgggtatatcttcgttgataaacatgatgacggcagcggtactttggcgcgctatcgaaagcagtcgttttattggtatcagcaggttattcagcaaaacggtttgtaataacaactgtttttaatgcaaccttgcttattctcgattttccgggatgaacaacaaaatgcaaacagccgctcattctctgacttgatgccagaagataagcggctgtttttattgatatccatcatcaaaaatgtctttaaagacaaccgttttgtttcaaagcattgtgttaatcaatggaaaacggcttttatcaaggtgctttgacaagtgtccaagtagcagttgattggtaagtaccgggtggcaagaatgtcaatggtccggacaaaaattgtccggttctgccgaatgcgtatcaagcttcacaaaaagtcgcttagcaaactgtccgaaaaagtgttgacttcccttccagattttagaagctttgagcaaaaaatattagactattatgtagcaaagagcgataatatgattgttagggcttatattagagatgattcgccgcgatatcatgggcttcatctgtatataggctctggcaattccaaatttttgtgggaattccaaatttgggacaaattagatgaagccgataacttggcctctcatgctatacatgaaaggcgaaaggaggggaaaggctaatgctttttatacatttagttgcgctcaatagaacgagtggacgtgcaaccgcttatcactttgcatcgccaaatatttccgaagttattgcggagaagaagcgcgtaatttcctttttatcgggccaaaaagttaagccgtctattagttttcaagttgttccaacagaatcggcatcatacgattctgtgaatagctacaactcctacttcgaaccgtttaaacctacagaagatttaaagacatttggcgaaagcattcacgttacccaagcattaaattctgtagatgttgcctcttatttagaaagaaaattccacttcagcagttatactctccaaaagatgctttacttcgtttactctgagttcttggtaagatttcagcgtcccccatttagggcagatttcattgcatttgcaaatggaccagttgactatgatgtttatgagaaaagacgctggaatagggattcaatgggattaaattatgggtttgaggaaaaggcattcggatcgaaagatggcaaaatcattattgatttgatcgattttgtcaatggcaagtatgagaaatgctttcaaaacatgaatgacgaaggctcaaatttaacccatcggaaagggactccgtggtctatagcgcatgctcagggatacaatgctccaattacagacaacctaattttgaaatatcatagtcgttaaacaatttaagagttttagtggatgcttgaaaattgaataagcctcctaccagcaatggcgggaggcttatttttgttgctttgaagcacgggcataatgctgtaaaataagatacgtaagcaactaaatattttagtcagcctgtaaggccttgccgttctgcctcctttgctcatggaggcttatttttgtgcacaaaatatgcacaaaatgtggtttcctactattgtatatacgtttgttttcgcccttactctccgttgtcttgcattcggatgtagctacataagaagcctcaaaacgctgttaattcggtgttttgaggtttttttgaacatcaaataaaatttgactgtgcctgatatgattagtagcatgagtggggatttaaaggatggttaagacatctgaccatcacaaaatcgttaaccgactttagtgactattttttacgaaaagcttgtaatttttaatagcttccgctagtataaatagagcaatagacaccacacatggaggattagctcagttgggagagcgtctgccttacaagcagagggtcacaggcaagcagtgagcaagcctctttctaggtggtaactttattattgcaatctaggattccatattgtattgttatcccaccctgaaacttgatccccgccacgttgattgattacattttgttgtcccgtgacctgccacgaatttgtcggaaaggtaccattagcatcggtttgataggttgggcgaatgttagcagtggctgtcacaactgaactgccacttgtcactaagcctgttaacatactcatcaaaatcaataagaccgcgaacaaatgcccagttctcgccactttagctgtcatcttcgtcacatttttaccctcctctcaggtgaacttttagccactgacattgcaattgttcttgcgcttacaactcgacacttaagagccagtctttttgtccacttaataacaaataagaaacagcctcaacgataaataccgatagttatttaattctaattgtttccataaaacatttttatgctaattttgcgagttcttgctttcggctctaatctttcaagttgtgatacaattcggccttgatgataggagtgttttgatgagatatggctgtgcacgcgtcagcactgaaggccagcgtcttgagtcacaaatagaagaactgcgtagagcaggtgtcgatgaaatttatcaggaaaaatacaccggcacgaccacgggtcggccggtttttaaacagttattatctaagttgcagtttggtgatatcttggtcgtgacaaagttagatcgctttgcgcggaatacgcgtgaagcattggatgtcatgcagacattgtttgatcatcatgttgggatacacatcccgaatgttggtctcattgacgagacaccgaccggcaaactgatattcaccgttttctcggctttcgcccaatttgaacgagacctgattattagtcggacacaagaagggaaaaaatacgctcgagcacataatcccaattaccatgaaggtcgcaaaaagctttatagtgaccaacaaattaggaaagctttcgatgcacatatgcacggtaagacgtatcaacaaatttccaaagaaaccggtattagcacggctacccttaaacgcagaattcgagatttaagtacggagcattgttctgtggccgaaatgtgattcttagcgctaaaattaaaaagtggttgaccacattagcttgttgctaatgtggtcaaccactttttaatttaggcccagtatgctgacacatcatgttataaaaactagggcaataagccacctcacatgtttgttttgacgacatttttaaattgttcaaaattcctaacgcgtgcaagcgcagtcgccacttgcggctcactgaacatcgtgattaaggcttcatacaaacgcataaagcgctgttgatcattttgactaatagctgcaagaacgacaatattgacacgtcgctctccccaacgaattgagtttttcgctacgccgacactaaaagctgtctgccttgcttccatgtacacagaatgtggcaaagcgactgtcccaaaagcagtaccagccgcttcttcacgttcaaaaacatgctgtcgaaaacttggagacacaatatggcggcgctctagttgatcacacatcaaggttacaacttgatcccgctgcatgattggctgcaatgtaaaaaagaattgctcaccgaattagatatcaaaatagcgtcttaaaaaatccctttgcacgttacgacgattttcctcaattgtcgccatgatggtgcttttctctttactcgtcatgaaaggtgaaattgtcacgactcgataagccatcgatgaagcctgaggtactgtcgtgataagcagcgaaacatcgagcttatcaagctcagaagggtcattcaccaaggcaacaacattcaaatcatgctcaaattgcttagaaacatgctgatacagttgcgtgttcaaattcatatagttcggtgaaaaaatagctgttctgattttttcagagtgttgcttttggcgatctaattcagcaccaatatgcagtgcaatatatgctcgttcgccttccgtgattggaatgtgcaacaattgactaagccgaaaagaaacaaaaactgccaactcaaaaactaccggaaaatcctgctttaaagattcggttagcggactgttcagactggatccctgcatggcacgagaaaataatttgttgagatgcaagctgaacggaaaaacgaaataatcgttatctagatcaatcccaaatatgtgttggacttctgcaaataatgagctcatcgctcgcacaatgttgtcaccaacagttgtggttaacttgtcacgatcacttagcggtaaatggtcaacattagcatgaaacaacatgtggatctcttcacgctcatgtttatttaaaataaggttaaaaacgttctcaatacgtttaataattttcgtgacaatagccgcatcatacgtgtttagccatgaactataggcatcgcgggatagcaatgtatcgtcgtgatgcaaggattgaatcataatcaataaatgcatcatgagatttatcagtgcataatcattgagttttaatgttgatggcgctaattcttctttgataatttgcgcgatctgttcaacatcggtacgattaaagttttgtgtgagcaaggatcgatcaacgaaatgatgaggtgcttcctccataatgaaatgcgaaatcagtcggcgtttgtctttttcatttccggtaacctgaattttattatcgcgaatgactaccctaacgccagatttcgaaaacatctgattgatcttttgaatgtcattttttaaagaaatggttttcaatagatgtcgttttttgattgcttggtcgcgaattttctccaaaagatacttgtcaggttaacgaagaagttttatcacgatttaattgttgaactcaaatcaaacgatatcgagtccatccctattaaccaaaaccctgcagccgttgaatgccgaaaatctgcgccaagcccatgccttggttgagtcagggcatatgattggtaaagtcgtggttaatgggccttgggcttaatatcggcaatcaactgagcagttttgataaatccccacaaggatagcaaaaatgaggcgctttttatcagcacctcattttgtcgtatcaattttctgatattaccagcagtgtgtcggcactaactcaaacgatcactgtaaaccgggaacttctgaaactgaccataatctgtcaaaggcttcatctgcttgagtgtggtcatgtcagcatcgtcaattgaaaaatcgacatcagcattcgccttcatatgttctgggttgaccgtttttggcaatggtagcaggcccagttgcaacagataccgcataccaagctgagcaaccgaaacgtggtgcttagcagccatggcttgaattgcggtgtttttgaacatttcgccatgaccaaatggtgagtaagcttcaaccaaaatgttgtgcgccttagcataatcaatcgttttgaatggcgtctgcgtgatgtgggccaaaacttgatccaccattggcgcgattttggcatgcttgatgatattttccaaatcagtcgggtcaaagttagaaacgccgattgcgcggagtttgcctgctttgtatgcctcctccaaggcgcgccacgcttctaaattgccctcaaaataacgattgggttcatcgtacttagcccagggtttcggtgcatgaataatcatcatgtcaatgtagtccaagttcagcttctgcaatgagtcatcaatcgcttttaccgcttcatcatggtttttgatttcggcagccagttttgtattcacaaaaatgtctttgcgatcgatcccagacgcacgcacaccttcaccaacaccgacttcattaccatatgcctccgcggtatcaatatggcgataaccggcgtcaatggcttcatgaacagctttcgcagcatcagcatcggcatcaatcatccaagtgccaaacccgattttaggaatctgtacgccatttgctaatgtataagttgcttctaacataatagtccctcctcgacaaataatgctgccttgatctttcatcccagtcatcactaccaaacgttcgtgaccgagtggattttccttacgcttgatcaagtgctacactcaccctaacccctaaagttagctttaggtcaagcgattatttaaaaaattggaggtcatcatatgtccaaatcttattcaattggtgaagttgccacgatgacaaagctatcgatccccaccattcgttactacgacaaggaaggactcatccctgaactcaaaaaagacgcttctggtgcccgttgttttgatgaccagaatcttggcgctctcgaaatgatcgagtgtctgaaaacagcaggtatggcgatcaaggatatcaaaacgttcatgcagtggaatcttgaaggcgatacaaccttaaagaaacgccgtgacttttttgaccagttacacgtcacggtgctcgcccaaatggctgacctacaacgaaccctcgataaaatcgagtacaagcaaggttactatcgccaagccgtggctgatggtacggagaagtatgtcaaggccggcattagacattcgcaagttgtagcgaccgaccgatagtcgcaacctacgtccaatcaaaaagcccaccatcaaaaatggtgagcttttttgggtcataactttaaaaatcttctaaactcgtttcaacattgcgccgcttggttgcgacccatagaccgatcaggaaccagatgatcgcgatgtatgggaaggtgttcatcgggaatgccggaatcggccaaagactggtgtaaattgggtaaatgagcacgagaatgccgatgactggtgccaacacatgtttaaacattgatcgccccttgtctttgcggaagtaaacaatggcgccaatgttgaccagcacgtaaaccgttagcaagccgagcatgccaatcgttccgaaccagttgtacatgtcgctcgcgctcacacctaagccgattgcaaaaatcgcataaacgattaacgctaagccagtgatgccatccagcgcgtgcgtcggggtctgcttgtcacctgatagttctgccagccaaggatgcagatagccacttttgcctaaagcttccagcatgaaagcgccggcgttgagcgcaccgaagtagcaggcaaaataactaaccatcgctgcaaagtccatgaaaattgcggcgttcgtgcctagataatgggtcgcaagaaagttcattggcgcggtacttttcgcaagatcgccgatgtgggcggaaccaaaaccgatgacttcggcgtaactgacaagaaagtagaaaattgctgcaaagctaacggcacccagcaaagcaatactaatcgccttgcgcggatgggtggcccgtggcgcaatcgtcgccgagccttcaaagccggcaaaagacatcaaagcaaataccatgcccatccccaggccggtcgccatatgcggttgtggaataaacggctgaactgaattgccgctgcgaccacctgagaaaatgatcacgacagtcaggacactcagcaccaaaaccgccaacagctcaagcaccagcgttagccttgtcgagaattcgatgcctttatggctaagccagccgccaagcagcagcacaatgatgttgtacaagttgactggtaaatgaataccaaaatgacttaaaaacacgtcagcaaaattgccgacaatggcgcccgaactgaaaacaaaggtcacgtacgtcaacacgagcagccagccagaaatgaagcccgccttttcgccaagcgccttggcattataagcataggctgacccatcaccgggaatgcgcttgccaagttcgacaaaagaaatcgcaacgaataacacgccgatcccaccaagcaagaaagcaatgggcatattgatgcctgcattggcggcagcacttgccgtgttaaaggacatggcgccagttggagcaaccatggctatcgagaggccgaatacctcgagtaaggttaattttttacgtttttgcatgattagtgaaggaactcctctttaaacgcgttctccagcccagaaacctccacataaggaccacaaacacaatggccaaagaacggccatcgcacttgtgcccacttatgctccggtttctaaccgggctgaatcgcgctctcttttaaacgcgttcacttgcgcaaaaacctccacataaggaccttccaaaacccggccatttaggcttaaggccgcttatgctctggtttctaaacgcgcagttcacgctcttgatgatagagcttggcactggtttgccagcagatggcgttgatccatgcctttttctgggtgaggtcaacgaatggcaattggttaaaatgcgccaccaaggcttgcttgaactgccgtgctgccaacccgtacatttctgggtaggtgctggcgtcggaggcaaataggatgcgcgtatatggtgccaattcgacagcttcattgaaaacccgactggccccacttggccctaagttatccaacagtgaaatatcaaagtacagattcggaaacacgctggcaagatatccggcttcgcgatggtatggataacaatgtaacagcaccactttcaagccttttttggtaaaagctttcaagtagtcgcgcatgagcagcggattgccaagatacatatcggtatcagcatcaccgtaaccaacatgaaattgcaacggcatatcttgcgcgattatgagcggcgcaacgtgatacaacatgtagtcaatcaacggcttggaagtcagtctcttttcgcctgaatgcttccacgtatcgaatccagctgctgcctcaatcacgttgaccggttcaaggtgcagtccaacccgataagcagcaatggatttgaacccaacgaacccgtgggccttggcctgcttcacatcgttactgaacgcctgccaccaagccgcaaaattatcatgttccagcatgaagtcttcggcgtgcgtttcaagccgatagatcgccttcactggtataccaacgagctctgccgtccgatcaagattaagaatcggatcatccggcacaaacccagtgtcaataagtagctccttgaagtgaaaatggccgaaaatccgatggttgtaagtcgcataaccgggatcattcatggccgctaatggattatttgcgtcaagcgcaaactccttagccaaggctaaaaagccgtgataagccagtcgatttttggtatcggcaagcggataatctttgtctgcttccgttgatacctgtgcgagccgatcgtcacgattcggtaccttgccgtcaatcaaaaaatggcaatgatgatccaacaatgggacttggtcgacaaattcagataagtcgtccaaaatacttcctccttcacacgtttgctggtgcaatgaccagctcacgttttcctagaagttttaaagcgaagtgccttcatacaatgtgatcgctgccaaccttcatgacaacgatcatgtcaaaatagtttaatacaattcgcgatgcaaggcagcaattttttccaatgccaatttggcataatactgatcgtcctcgcgcttgattttcgcgtaggcatcgaccaattgcttgccaaatacttgctggaatagcgaatctgcctcaaaagcgtcaaccgcttggctctgtgtgcgtggcagaagctgaatccctttggcatcgcgctcagattgactgagactggctggatcaacatcgcaatagccatccggttgcatgtgatttgtgatgccgtcaagtcctgccgccagcaaaccagcaaaagccaaataaggattagccgtcgcatcacttgccttgagttcgatgttcatcgagctggccggatcaccccaactggttgacggaatgcgaattgccgcctcacgattgtcttgaccatatgtggcgtatgcactgctccaatgaccaggtgccaagcgctgatatgaattagccgacggacaggtcaatgccagcaaaccttgaatatgtttcaaaacaccgccgacaaaatactgcccaatcgtggatagttgcatcgctgccttgtcatcaaagaaagcatcttctttatcttgccaaagtgacaagtgaatgtgtgcccctgacccggccgaatcaattagcggctttggcgcgaatgaggcatataggtcaaaagccttcgcggtatttttgatgatccgtttgtaaatcacctcattgtccgcagcggtcaccggatcactcggcaacatgctcagctcatgctgaccaatgccaccttctgggtaataagcgttcggcataacgccgactttttgcagttgattgatcgccttcagaatgaatggatacgcaaaatccatggactcggtggaaaaggcgacatgtggcattgccggttcgcgatgatctttatctccagtaaataactcgaattcattttcataggccattttgaccgtgaagccagcatcagcaagctgcttgacgacttttttcaaaatggaccgcggatcagatgcgtacggggttttatcaagattgtaaatatcccccattaaggtggcgacttgcggcatatagggtaggacatgtgccgacgccggatcaccaacaaggcgaagttcgccaattggcgtcatgtccgccaccggcaaaatcgtatcacgttcactgacattcaaggttgctttggtcaacccaatcccatcagccagcttggccttcaagctggcaagcggaattaccttaccacgcgttaacccgttataatccacatacagaaactcgatcagctcagtttgcttctctgtcagctgctcaatgacggcttcatcgcccatgttgatttcctcctcttagaatgccctcgccaattattcagatacacccggttaaaaaacaccgttacatatgtatcgttcggccctaatgttacatgattttaaataaaaggaaagattgtctaaaaattgttgcgggggaatttgcaaatagcgtcactaatttggcaggttttacagcagctaccatatccttgtcccgaaaaactatcgacaatcatgaagcaccaaggccttcatcgaaataaaacaagcacccgaccaatctcaaagaatttttgagctgatcaggtgcttgttctgttattcgagctaatcgtaacatccttatttttgatgtgtagcaatccgatccaaaaagtcttgaaaaaccactaattgttgcggatcttcttgttgccacatgttttctggatgccattgcaccccgagaaaaagatcattgtcaattgactccatcccctcaacaacgccatcaggagccaccgctgtcacccgcatgcccttgccgacagttttaactgcctgatgatgccgcgagttcactttaatcttggtcttcccatacaaggcagccaatcggctatcaggtgtcaaatcaacatggtgggtcgcaaattggcccagtgtggcttggggatgctgaattttcaatcaaggtattgactttccaaatcctgatacaacgtaccgcccatcgccacattcatgatctgaatgccacggcagataccaaaaatcggtttatttgccgccagtgccgctttgatcaatgcaatttcgaaaagatctttctgataaagcgtcatgccaatcttgggatgcggttcttccccatagaatgtgggatcaacatccggaccaccaggcaacatgaggccatcaatcagctgcacataatcttgcgcaagctgctcagtctggctgacatcatcaggaaacgcaatgatcagcggcaaagcatcaagtttaataaaagcctcttttacatcatgcggcgcataggcaagatggttgtttggcatcactgggttaacttcgatcaattcatctgtgggaatcccaattattggcttcacgatttatttccttctattctacttaggatttatttttcatgagtatacgccgttttggtagtcgccacaatgagcatcatcggccgtcgcaattcatccgccatccccggaatggttttaaccatttcatctgtcggtgtcggctcaatcacgcgattcaaccgtaactgatgatcaagcaaggtattgagataagtcgtcaaagtacgatggtattttttaatctggtgccccagaaaatcagtcttccgctggctttcatcgaaatagcgatcaactggccagtaaaggttgtgcccttgatcatccgtgacccactcttctttgccttgggctgtaaaaattggatgttcaaccgacatgacaaaatgaccgccaactggcagcttatcactgatttttttcacaagctgggcgtaatcctcaatgtagtgaatggccagcgagctcaagataatgtcaaactgatccggcaattgatcaatcgcctgcatgtccatccggcgataagtgatccgctggtcggtcgtctttgctgctgccgcagccaacattttagcggaggtatcaatgccgaggacacttttggcgccatgctcagcagcatagcggcaatgccaaccatagccacagcctaaatccaatacccgtttaccagaaaaatctggcagaactgtttttaattcatgccactcaccggcacctgctagtccctttttggaccgatccatctggctgtatgctttaaaaaatgcgggatcatcgtatatatctgacatgacataacgctccttctaagaatataagtccatcatcgcagtcaccgctagcatgtgcaaccattgtgcatatgacgcaaaacaaacagattggcaaaatgagattttgatttgaattcggtggcaagcgatgctacagttgcttcatactttttgaatcttgtctgtcaggttcaggtacagacaccacgtctaaaatgaaggagtaagcgatggaaatcacagcaatcacggcgttccctcggcaggtaaaacttaaaacgccttttaagttagccttgggcgagttgcgggacatcaccacactgatcatcaaaatcgagactgatgatggcgtcaccggctatggtgaagcctcgccttacgcaccggtaaatggcgaaaccaatgaaaccgaacaagctgctctgccagttttcgtcaatgctttaactggctgcgatccgcgcaatcttgaacaggtgcatgcacgcatggatgtcgtgatggctgggcatacagcattaaaatgtgggattgacaccgcctgtagcgacattttaggtaaagcagccagcttgccgctatggcaactgcttggtggtcatagccatatcgtcaccacggatatcacgattccgattggcactccggctcaaatggtggcttcagcgcggacatatgtggccgctggtttcacggcattaaagttaaaagctggggacaacgaagccgccgatatcggcgccattaacgcggtgtgtgctgcagtcggccccaccatctcggtaaaagtggatgctaatcaggcttggactgtatcgcaaacgttaagaattgcagcccaactcagggcccccaatttaattgccatagaacagccgatgcctgattggcagttgctgtctctacctttgttacgcgcgcagtcacccgttgccttgatgcttgatgaaagtatccacaacgcccatgatgccgccgatgctattcgcctgaacgccgccgatttgatcaacatcaagctggctaaatcgggcgggctgttcggcgccgcggcgattgacgcgactgccgcagctgccggcgtaccttgcatggtcggttgcaatgccgaaactcgcctaggaacagccgcatccgctcacttcatcgccgcacacgagaatgtgcactacggcgatatcgacagtttcatgttgctggcagaaactgactggcttagcggcggcttcaccgcagacggtccgaccttaaccttatcagatcgaccaggcctcggcgttgacgtccgactttaagagagcgtgaaccagcccggttagaaaccggagtgtaagcgggcctgaacgtgatgaccgtactttggtccttgcgttcagggtccttacacgcaggtttctgagctggtgaacgcgtttaagagcctgagctggcgcggttaggaggaaatcaattgactgattggcaaggctatcaaaagattaatgaaaagtaccatctcaatggggcgaccatcatggtgaatccgactgaaatactttcaagttggcaaaatggtgccgccgatttttcaatgaaacgtccgtttacccttcaaacaactagtggcttaggttcgctaagtaaacaattcaccgctgatagcgtgttgctcctgaacgcggctgacaagctcgacatagaggcgtccttagtagattatgtgccgaactatcgctatgccgatcaagtcaccttgcgtcagatgttgaatatggccagtggcattcctgattacaccgagcttttactaactgattatgccaaacgcatgcctggtgccagtgaatcccatcttagctaccctattttggaagatcttggtcatggcgatgagattaccgaggtcatttcgttgctaaatcaacatccactggattttacaccgggtgaaaaaggcgtttactccaacagtaattacttattgcttggtttcatcatctcaaaaattactggcgattcgttagcacgcttttttgaggaacatttctttgaaccgctggcgatgactcagacacgacttgggacacaatatgctgaggccaacagttatgatgacctagacgttacggctggtaaacctgtcgtgcttggccgaggtgcctaccaaggtggggacggggccgttgtcagctccttaaccgatcttgccaaatgggcgcaggccgtgttgcgccacgatattctgtctgaaaaagattggcacgaggcactgaccctcacccacgacttctacggtatggggtggatgcattcgaaaacgccaaattggttcagccatgccggtcacgttttcggctattggacctatttcgatgtttcgttcgacaagcagctggcgcaagtgacacttaacaacatgtcccctggcgatgaggctcgcaagacatggcaaacagagatggcggcttggcagtagaccctctaagtaaaaaaaatcctcacttcggacatgactcggagtgaggattttttattgaagccatttatttttgatacaagctaatcgaaaattagaagaattgccgcataatatccttcaatggtggcatggacggaatcttccaataattctcaagatattcggaaccgtacttcatgtaacccttcgcttcatcaccaacgattttgcctggaagcggtgcatcgtcttggacgtaggtattgatcagaaccggtttatcggtctctttgtatgccttggctaatgcatttttgaattcgtcattgctgcgagcggtgtagccaatgccgcctgctgcttcagcaattttggcatagtccatatcagccaaatcaatttcatagttcagctgaccggcactttgctgctcatattcaataaatgccaacttctgattattcatgacaaccatgatgatcggcaacttgtacttgactgctgtgacaaagtcttgcatgaccatcgcgaaggcaccatcccctgcgacactgatattttgccgctttggaaaagcctcagcacccgcaatcgcgcctggcaagccacagcccatggttcccaaccatgcggaaattgtatacttttgcgttggctgaacgttcaagaaacgggcaccccatgatgtggacgtaccgacatcaatcgagtaaatcgcatcttttggcgcggtttgatcaatcgtcgcgaagactgcttcaggcgatgccggattagtagccagcaagcgcttttcgctcatccacttattccagctctccatattcttctggcaagctttcagaaaacgatcatcatcacgcaaggagcccttcgcattcagttcggtgaaaaaggtgccaacgtcgccgtcaacagcaacatcaactgaataacgtttgcccaagttttctgggcgcgtgtcgatttgaacgcacttagcttgaccttcggctggcaaataaggcgtatatggataattcgtcccgatcatgaagaggagatcagtcgctttcatcgcctcatatgccggcttcgtacctagtttaccgacattacccaaactattgggatgatcatcggcgatagtgccttttgctggcatcgtttgaataaacggtatgtgattggcctcgacaaacttttgaaccaacgcacctgcatgctcagcaccgcgaccgatcaacgcaagtggtttttgtgcctgttgcagcatcgaagcaacgtcctctaactgtttaggatcaactttcggcacattcaaggcaaaagcagcagcgctgtcctgataactagcagtttctttttgagctggcaaatcatctggaatggttaaaactgccacacctttttctgtaaaggctgtgcgaatcgccgtatcgacaatttgtcctaagttatccgatgccatgacagttttgttataaaccgccacatcgtcaaaaagcttcggtgtattcacttcttggaaaaagccttcattcatgttgctcgtcgtcacctgaccgagcagggccagaaccgggacatgatccattttggcatcatacaaaccatttaatagatgaatggcgccagggccgccaatggagagacaaacacccaaaccgcctgttaacttagcagttgccgctgcggacaaagcggcgacttcctcatgccgcacctgcacaaacttgatcttatcctgatgtcgacgtaaggcatcaactgtggtatcgattgaatcaccaggcaatccaaaaacgtgtttaacttgccaatccatcaaaacactgactaactgatctgctgcttttgttgccatatcaaaatctcctttatcgcatttcgtcatgcaaacaactcaattgttatcaatttattgacaactccaccttagttctttcaacggcatggtcaactgctcttagtgtgatctcatttatcaaagagatcagactttgtgaattcagattttttcaaaccatacaacaactaacccaatttaagaaatacccacttattgcgatttgcttttctattagttagcattttaaattgtgaaacgtgccacttataaacaaatttccgccttctttttatgagagtaatctcatttaatcttgactaaatatccgattgcggtcacacaactaccagtttcaaacaaatttcaatttgatggtcattttttattttgtcggcaaaaagtgagcaaatcagtagcattttccctgattacggggtacattcaaagtgactttgcgtacacacagacatatgtatgacgggtgttataaaaagccgtcacgccggtcgagtagctctcatcattttctcgcccttttctcccgcaacatatgataaaatacaacggttgtgaattgtttatttcctaggaggatatctacatgccattagttaacgctgcagagcttgtaaaagctgcacataaaggtcactactgtatcggtgccttcaacaccaataacttggaatggacacgcgccatccttgccggtgcgcaagaattgaacgttccggttatcatccagacatccatgggtgctgctaagtacatgggcggctatgaattctgccagaccatgatcgaagcaacggttaaagccatgggcatcaccgttcctgttgtgattcatttggatcacggtaactacgaagctgccaaggaagctattgctgccggctacaactccgttatgttcgacggccacgacctcgactttgaagataacttggaaaaaaccaaggaaatcgttaagttggctcacgccaagggcatttctgttgaagccgaagttggttctatcggcggtgaagaagacggtgttgtcggcgaaggcgaattagctgacgttgaagaagccaagacattagccgctaccgggatcgacttcctggctgctggtatcggcaacatccacggtcaatatccagacaactggaagggcctgcacttcgatcgtctgcaagaattgaacgacgctgttaagatgccgctcgttcttcacggcggttctggtatccctcaagaacaagttcaaaaggcaatcaccatgggtatttccaagttgaacatcaacaccgaatgccagcttgcctttgctaaggcaacccgtgaatacatcgaagctggtaaggatcagcaaggcaagggcttcgaccctcgtaagctgctcaagccaggcaccgatgctatcaccgataccttcaaagaaatcaccggctggattggcaacaaaccagttaagatggttccagaagcactttaattttttcattaagtgctattcaaaagcccactcgcaaatttcagcgagtgggctttttcatacatatttcgttactcatcaagtatttgattaacaaaacagtcggcttcatgatcattgaccaaccctgcagcctgcataaatgagtagataacgacgggaccagtaaatgcaaagccatctgccttcatttgcttgctcatgtgcttggccaagtcggttgtgttaggcacctgatcatgactggtaatatgatgccgaatcggctgattgttgacaaaggcccacacgtaatgatcaaagtcctcgcctttggcagctaactgtgcgatcacgcgcgcattgttaatgatcgccgtcactttcagccgattccgaataatttgcgtattttctaagagcacaggaatcttcggtgccatctgctgcacctgccgatagtcaaagttagcaaaagcctgtttgaaagcagcgcgtttattcaaaacggtctgccagctcaaacctgcttgcatgatttcaagcgacaaaagctcaaataagtggcgactgtcatggctgggccgcccccattcttcatcatgatactcgcgcgtcaagtcattactggtttgtccccatgcgcaacggtgtttttcagccagcatatcgtacctccagcggttgtatcttaatcggctgggtcacttgcacgcgtcgattctgcgtcaaagcaagttgatgctcagcgacaagtttagccacgacatcattgcctagcttgccagccaaatgaacccggcgttccgaaaaatcaatgcaagtctgaatgttcagctgatgcactggacgcccgaggaattgcgcaaatgcgtggcggcctttttcagtaagctgatacacatttggtgccgtcagcacaaccatctttttggctaacagctggtcaaataaggcaacaccagctttcccagccaaatggtggtagcaagttcgcgctactccaagcgcatgggctgcctgtcgttgatctaagtaatcatctgcaactgcacttaatttgctggtcgcctgttgcggctgagtggtctgaaaataatcgcgccctgcaaagtgacgtcggttcattttctgtaatcctactaagtgtaataaagtttcctcaaccggcttctctggcatcttcaataacttagctatttccttaagtgtcaagaaccggccactgtctaacaagtctaagatcttctgagataaattttcttgcatgctggtaccttcttcccaaatagcaaacatatgttcttatctcgagtatacctttctcattcttcaagaacaatagtgtcttcgttgtaaatggcttggatgctgtggggcggccacataactgaattagcaaaaaaattcagccttccagtactagcttcattgagccgtactgtatgtgtttaacgactcgtctgcaattgcttaaaatatccctgctgggcatataacaacatcgccaagcttgcgccaatcgctgtaaaaacggcaatccccgagaagccagtaaactgtttaatcaagataccgccgatgataccgccgatgacaccaccgatggcctcacctaggtacatgacggcattggcctacgcggaaatcgtgctgcgggctgaccccgcgtgttcttgcaaggtactcataaacaatggcagcagtgcgccaccgattgtatagataaatgccagaatgaccgttgccgtcagtggcgaattggtgaaaggcaaaaccagatacccagcaatgaaaagtaagaactcaagcagaaacgcatgcggctgacccaaccaagtgactaatcggctgcccagcaaactgccaacaaactgaccaacgccgattaaaagaatgaagctgccaatggcaccaactgataaatggaagcttttcgcaaaccaagtgccgataaaggcgaaaccgcaaaaatttgcagtttgaaacaataagtatgcccctagcagtttaagcacggttttgttctgaaaaagtttgcgatagataccagttgcaagacgtgaagttgtcgcctcgttaagactgggcatgaaacgcacgaccagcatcgtcaacatcaaggcaatgacgccaacgaagaagaacggaaatcgccatgaccataccgctaagtaactccccaatggtaccccaacgatttgagcaaccgccagaccggccgtggcatatcccattactttgacaacttgcgtctttggaaacaataccgggatagccgctcagatttgcggtccggccgtggccgccgcgacaccagcgacgaatctggcgacaagcatcatcgcaaacgtattcgccagcccgcacccggcagtcgccaacgtgaaaaccattaacccgatgatcaaaatacgtttgcggtcgtgccggtcagaaatcggaccaatcaataatgccgatatcatgtagcccactgcataagcgctgacaataaaaccagatagactagtcgaaatgccatagtattgcgtcaatgtcggtaacaacggtgaaaccaaaaaggtatcggtgccaatcacaaacatcactaagaagaatagaaacgaaagtctacgttctttcgtacaatagccttaaaagttgtcactttaagaaataaaaagtgatgacttttaaaagtcatcactttttatttcttaaagtgacaacttttaaggctattgtacgaagtgatggcacttccttttttaaacgtcgtcaatagaccgataatcgtcgaaattgccatcattattgtcctttgactacgaaaatgtcgttaaattttgaatgcgtattcaaaaatgatgaaacatcacccgcaacatcgtggtgacgcctcatcatttagattggcttacatgagccgttcttttttaacatcacgccttgctaacagcggcatgatgaagccaaaaccaaagagtaccatcacggagatgatattcatcaccagttgatgggtccagccattggttccgaaaacaacttcctgtggtaagaaaccaagcgtcgcacagatgaacgtgaagacaaagcaccaaccgccaactagataagcaccggccttacttttgatgaaggtatagccggaagtgaacttgtctgcttgcgcccgcaacgccaagaaagctacaaagacaagcgccgttttgtatggcgatacaataccattcaaattcagtaaccagttgaagatggcattaatattcggcagcgtccctgacagcaacaacaagaacaggcaaagtgaggcggtaaaaatataactatggatcggccgaccttgcttgtttttctgcaacaaccatttaggcatgaaccgcatggcgatgtcggctgacaatacccggctggaagcatcaatcaacaccgctagctgggcgagcatgaagagtaattgcgtgacggcaaacaaatacatcagcactttgccccatccccacgcctgaccaagcatggaaaaagcataataagcgccattcattttgagatcatctggcagatggttggcattgaaccaaacgcctaatgccagcgatccaaaaatcaccagaaaaccggtcatgagcgccagagcccacatggctttaggaaactcttttttcgggttgcgcaactgagcaacataagtggcgccaagttccgcccctgatgtcgcaaaaatcaagagtccggtcgtggcaaagtaatgcagcgaaaaatgtggcttgaacgcggcccaactaaagtttgttgccgaatgcatgcctttgaccaaaccggccgccgtcaagacaacgaacagaactgccatcaaaaacatcgccgcaccgccaatcagcgacatgacctcaagtgatcgggagaacaggttctctaacacaataaataaaagaataatagcaaaagtcagcaggccaaaggtcagattcgacattcgtttacccaaactgttatcacccagaatcatccatgaaagcgccacgatgacagcgttggaaacatcgactaaatatggcagggtctgagcccaataaatccagcttgtccagtatccccaagtgtcccctagcgtgcggcgcatccaagtcgccaagccaccgccttcatcagcccgggtaaaagtcgtccctaattgtgccgaaatcaaggcgtacggcacgatataaatcactaacaggatgacccagttaacaacaacggaaagcccttggttctgaaaaggataaaaaatattttcaaagccaatgaccgtaataaaaacaagtaagcttaagactggccagctcatataccgccggggcgtcagttcttcttcttgcacaattcaaagcctccaaatacaaattaagagcgcctgtagctcggtactggtcacatatcgggatgcaggctggtttgatagcctcttgatgactggctagtaactaggcgtgttccccaaaatggccgccaacttggcaggtcatgaattggtaccatccattgaagcgtcacgttcatccgccatcaaaagcatcgcgccctccttgatgtcagtatagcggaaactggtctaaaaaaatagcgtttcacaacacaactatcagtagtgatcaggctttgcgtggttattttgcagggattggcaacgtttcacaacaacatgattgaaaaaatcgactttttcaaaaaacgccgaagacatttctatcttcggcaccccttcttaaccttgacgcaaactcactttttcactcaactttgcccagtgatttgtcgggccatggccatggccaactgaaatgccttggctgatggcgccttgcagaaaggctttggctgtcatgatagctgctttcaatggctgcccttttgctaactctgcagcgatacatgccgagaaggtatcaccggttccatgcgtgttcgcagtggcaattcgtggcgcactgagccaataacacgtaccgtcagccaatagaatcagatcctcggccttgtgattctgacgatggccccctttaataatgacatgcttgacgccaagtgtttgaatcatacgcgccgcccgaaccatatccgcattggtcacaatttttttacccacgagaatttctgcttcgggtagattcggcgtcaccacatccgccaacgggagcagctgttctttgatggtgacgacagcttccgaggcaagcaacgtcgcgccgcccttggctaccatcactggatcgacaatcagcgggccaaaatcaacctgttgcaaattgcggacaacggcttcgacatgctcacgatccgctaacatccccgttttggccgcgcgaatgttaaagtcagcagctaacgattgaaactgggcgtcaatgaagcccgccggaatcggcagaccggcctggaccccatacgtattctgcgccgtcagtgctaccacaatactcatcccaaagacgtgtcgggcctgaaaagttttcaaatccgcttgcaaccctgccccacccccggaatcggaaccagcgatggtgacgacttgcggtgtacgattaacggtcatttggtaacaccacctttaactttgtgcgcaaagcctgcactttgtgagcgatatcaggtgcctgcatgatttcgctcacaatcgcaaccccggcgatcccggtatctttaaacgtcgccaaattggcttctttgacgccgccaatagccacgaccggcacggcaacttgtacagtgatcgcctttaatgtcgcaatcggggtcaccgctgcgtttgccttcgtctgcgtcgggaaaatggcgccaacccccaagtaatcagcaccagcggcaatcgcggcaaccgccgtctggacggtttttgtggaaacgcccaataccttgtcaggaccaatcaactggcgggtcatcgcaacaggcagctcatcatcgccgatatgcacaccagctgcatctacagctaaacaaatgtcgacgcgatcatcaataatcagcgggatctgataacggtcagtgatgagcttaacccgttgtgccaattcaaaataggctcgagtgctcagcatcttttcgcgtaattgcaccatcgtgacgccattttcacaagcagccgcgattttagccaaaaaagttgcttcgttgtcatcgtaacgatgggtgactaagtacagttttagatctgttgcgttcataccgcttcccctttcaccatttgaagccagtcagcggtggcagccagtaaggaaagttgattcaaggtaccttcgcgaaatgccgccagtccgccggttcgattctgcgcagctgctacttcgccacagcagttgaagtaactcacagccacgacgactgctgcgtcgttgtccaaacctgtcccccaacagcgcggcaatcaaggcaccgacaatgtcgccagtcccagtgaaacgatccagctgcggcaccccatttttcaaataccaagtccccttcgcactcacaacgagatcaatcttgccggttgccaagaaggtagtggtgggaaacgcttgggtcagctgctgcaagctcgcggctagttctcccaaggcggtcgcactttgatctaactggcttccatcaacgccgcgacctgtactttttaaatcagcgaatcggcgcatttcagaaatgttacctttgaccacgttcggatgattggctaacaattgatggcctaagtcatagcgcaactgggtggcagaaacgccgaccaaatcaatcaccgttggctggttggtggcatgcgcaaacttgccagcggctaatagattctgctggcgcacttcggaaatatgtccaagattcaacagcaacgcatcactttgagcaaagaattccgggaactcgcgctgatcatcagccatgacgggcttcgcatcaaggtatagcaacgcattagccatggattcgacggtgatttcgttggtaatacattgcaccagtggggatgatgttaatggcagggcggttttgaacgcggtttgaaaaacgtcagtgattgcttttgacatggaaaaagcctcctagaaaattttttgaatacgcttggtgatgccaatgtgatcaagttcatataggacaaacaagccgattaacgaccctgagatcgatccaccgaaaaaccgtggggtgtaaacgaaccagtagagcgattgcgcgctgccggtgaaccaaaccatcacgggataagacagtatggatccgatcaaaccagtgccaagaatctccccagcggcggcccaccaattgtgtttgccaaaacgatagccgaggccagctaaaagcgccccgaatattgcaccggtcaatgccagcggtggaatccccaataatgccatgcgaatcagagcacaaccaaaggccatgatggtggcatatagcggtcccatcatggcagctgccacgacattgaccacgctggacatgggtgccatcccttcaatacgaaataagggtgaaagcaccacatccaaggcgatcatcatcgctaatattgccagtttcttaacgctgctttgtgtcatcaacctttgctcctttcggccacgcttctaagtgatacgccatctcccaaaagctgtattccatttgactgctgatccgaaacgcagccagcatttgttgctgctcagtcggcatgctttggtcgtacaaccgatcaatcaacgcaatcgccgctcgctgatcgtccgcattgtccgcaccgctataagtgtcaatccaacgctgataaatcggcacgggtgattttcgttgctgcaactgctgcgccacctcctgatacaaccatggacatggcaacatccccgcaatcgccacatgcggcgtgccttcaaccaattgccgatacatatgggaaacatagtgataagcagttggcgcaaccgcggtggccgccagctcggtcgttgtaatgttcaactcggcgaaaaagtcgcggcgtaccgcaatttcaccttgagccaaaccttcagccgactgcagcgcataagctttcaattccggctcctgcgtctgtgcggcaatcagcgtatataaatgtgtaaaatgttgcagataataagcatcctgagtcagataaaagcggaaaatcgccggatcaagggtgccagcttgtagctccgtaataaatgggtgagtgaagctgccttcccagtacggaacaacttgctgccgagctttttcagaaaatttcatcatcgtttgctcctttaattctgtctctcttgaccatattcaaagcctaaaaacagtatttttactagaatcaagttttttatgacgttaatggccaataagattcaccatcacgaacactgcgcctgccatcaacaaaccgcgacgggaactggtcagttgccgttgaatcgttcgcgaaccaccttacgtgtaaccatgcgcatacatggcggtcacatactgatcctgccaagccatcgcaacgaagatgaccttgacgtaaatcagcggcgaccaaggacgcagtttctgaccgtgcaacagactcgcttcccgaagatcagccacttcccgcatgatttgcggcagggcatggatgaccactaataatccatagacaaaattcggcgataatttatgctgctcaagccacaacaacaacgcttccaaatcaacgccagtgagaaacaccaagcccaaagccgtaaacgcgtatgttcggacaaacagtaacagcgcataagatgtgtctgttccatgaagcgtgatggcccaatagctgctcgcggctgggatcaacggcagcagcagtaacacgatcaagcttctaaaggctcgccgccacccaagaaaacccagtgctaacacgatcaacgcgacatttagcttcaccgcgtgactaaacgaaatctctagtgttaaggctagaatcaagaggctcaagttgagggcatctgtcttcttctgtgccatcacgtcacccctgcacaacctgcaaccgctgattggctagcaaaacctgttgctggctgataccagctaacggtgccaatcgatgcgtcacaatcaaaaacgcctgcgtggccgacttagccttaatccacgcggcaaagtactgacaggcgcgatcatccaagccgctaaatggttcatctagtagtaaaaatgacaaatctaagctcagcatcgtcatcaactgaaccatctttttctggccttcactcaactggtaaagactagtggtctgcttttctgctagtccaagataagctaatgcggcttgttgtttttcccgcaccgcagccgctaacgccggcccaaacgctagctcatcagccagcgtcaacgtcacgaattgctttgccgcgtcttgcacggccagcgtcatagtttgataaagtcgtttccggcgacgcaagcgttgttgaccaaggaacatacggccttgatagggatgcagctgcaccattgatcgcaataaggtggacttgccactcccattggccccagtcaaggtggtgatgccatcgttaaaatcccaactcggtgcttgaagcaagatatggtgattttgctggcaaacaacgtttttcagatggaagattttattggtcgtctgccgtggttgcgtgaggttaaaatgcgtcggtagcgtggtcagcgttgcgagtggtagccgacttagctcgccatttttcaaggcaaccagttgatctgccacatcggcataatctgtcaggtcatgctctgcgatcacaattgttttgccatgatcacgtaacgttcctaattttccaattagcacatggcgacttgccggatcaatgctggcaaacggctcgtccagtagcaaaatcggtgcatccatcgccagcaaaaccgttaatgccgcgcgctgcttttcaccgcctgataaggtactcaagtcacgattcagcaatgcctgagtctccccaagggcaaccgcctgggcaaagcgccgctgaatttcggcaaccggcaaatttagattttccaaggcaaaagacaactcaccgctcaaggttcgcatcgtaaactgctggtcagggttttgaaacatcatgccaacatgctttgctttgacttgcatcgcggcgttccgatcatcatgaccatccagcaaaatagtgccttcgtatggcatcgctgcaaatcccgcgatcaaactgagcaaagtcgacttcccgctgccgctatcaccggttaaaacggttagtgctcctgttggaaattcaaaattcaagtccgtaaacaaatccgtctcgcgatgaaaccgtatcgcttttaacacaatactcatttgccgctacctgctagccaagtgcttggcaccagccgcctgttcataaagtttcagaacgagttggaccagcacaacgccgaaaaagatcactgacaacaagcgaacaaccacaagcgccaaaatcatgccaagactgtaagcgccgtatccaagtttgaaatactagtaggtaaaactgaacaccgtggtcccaatcgctgcgtacaaaagactcacggcgtcataacgccgataacgtgtcaccataaagccggcctcgctgcccaaaccttgaacaaacccagaaagcaagactgctgggccaaagtacgacccgtaaagcatctccgctaaagcagcgaaacattcgcctaaaattgaactgcctttttttcgcaacagcatcgtcgtcatcggcgccgccatcacccacatgccaaacaacaattcattggcaaacagtgcataacccagcggtgtcaacgcagctgctacaacagcataaatcgcatcggcacccatgaaaacaccgccgaagaggaaggctaaaaacgccagcaaaaccacatcgcgcaaagaccatttatccattaaaataactcccgttttcctcaaataaagacagacgggggctaaaaacgcgaatcattaccaatcacgccaacacttattcatgttcaaaaaaggacccatcaccaaaatttggtggggcccatgaaaacacaaacaagcatcgttacagaacgattcacttcttcgacatttccctgcggcagtcctaactgcatcaggttccatgggtatcatctcagctttacagcaccccaaatgtttctattcgattgtaaagggagtatatcatgttttatttggaaccgctagcaggaaagtgtcaactgacgcagaaacctgatactgaacttgatatcaacggattgcgttcgccgtgcttaaaatgatttctccactagaaaaagactcacaagtcatgctatacttgaaacacaaaaagccgccgcgttcccgcgcgacggccgggcagaaatgccctcacagaaccatccaatgaacgatggctactagaataggcaactaaaagcaaaagtcatcactttttatttcttaaagtgacaacttttaaggctattgtacgaatcaaggcgctatccttcttcgggttactctgcttgccgctcaagcttgggaacagtcacttctgccagatgatgacccataattggcgaaacatcgccaatgtccttttgcaaaagccgttcgagtgtgaaagcaatttccgcacgctgaatattgcggcgctcattggtgaaaagaagttcgatatgggaaggtgcctacgtataaacaactgtcgtttggccaagtgagaagaccttgaccagccgggcatcggtaccactcaattgttggcttactagatttctgaaactgttggtcacgttaatcagtcgcatgctcatgccctccatttctctccctactgtttttattataaaacagtttaacggaaaataataatatgtgaattgaaagccctcgaacgcaatgaagttcgagggctttcttaaaacaaattactttttagatttttgagtggtttcagccttggcaggttcaccaaccgtaatctcaccattactgatgcgggcttcaagttccttagcctttggatggtcaaggtagaagtcagcaacgcggtcttcaatctgttcctgaatgactcgacgcagcggccgagctcccatggcaggattgtaaccgagattaaccagcttttccttaaccggatcggtaacatgaatcgtcaagccctgatccttgatgttattgttggtatcttgaatcatcagtgacacaatcttcaacaagtcgtctttagacaatgacttgaattcaacgatgtcatcaaaacggttcaggaattcgggcttgaagtaattaccaagctgatccagcacactgtgcgtcttaccgcttaaagctgcgccaaaaccaacgtttgcttcggcatcggttgagccagcattggatgtcatgataatgatcgtgtccttgaaggaaacggtacggccttgagaatcagtcaatcggccgtcatccaagatctgcaagaacatattcatcacatctggatgggctttttcaatttcatctaacaagatgaggctataaggatttcggcgaactttttcagttaattgaccggcttcctcatacccgacatagcctggcggtgacccgataagcttggagacactgaatttctccatgtactccgacatatcaaaccggatcatggcgtcttcagaaccaaacagctctttggcaagctgtttagccagttcagttttgccgacacctgttgggccgacgaataggaaggacccaatcggccgaccggacttgttaaagccgatccggttacgacgaatagcacgagcaactttatcaactgcttcattctgaccaatgacatgcttttcaaggtcaccagccagattcttcagctgtgcttgctcctgcgccttcagttcaccaactggaatgttggttttttcttcaacaatctgttccatatctttttcggtgacagtcggaatttcattttcaggcagattagactgtttcttagccatatcttctaacttagtaacttggtcacgatagaaggcagctttttcgtaatcctcctgcttcagagcagcttgcttttgcttctcggcgtcgtcaatcttggtcttgatcgtttctggatcgacagtggcaatggtcagattcttccgggaacctgattcatccagaaggtcaatcgctttgtcaggcaagaaacgatcttgaatgtaacgattgctcaaagttgcagctgcttcaatggcggcatctgtatatttaacatgatgaaaatcttgataccgaggctgcaggccttttagaatcttaatcgtctcttctacagttggctcctcaacgaggactggttgcagacgacgagcaagggctgaatctttttcaatttgacgatattcattgctagtagtggcaccaacgagctgcaactcgccacgtgctaatgctggtttcagaacattgccggcatccataccgccttcagcattgccagcgccgacgatttcatggatttcatcaataaataagataatgttcttattctttttaagttcgtcaatcaattgttgcatacgttgttcgaattgaccgcgaatgccagttccttgaactagtgaaacgacatcgagtcggatgacatgccgatcttgaagttttgacggaacatcgccattagcgatcttcaatgccaagccctcaacaacagcagtcttgccgacaccggcttcaccaatcaggactggattatttttggttcggcggtttaagatctcgatcacccgtgaaatttctttgtcacgaccaatgaccggatcaatttgaccattccgtgcttgttcagtcagatcaacaccgaattgtcccagcaatcccttgccacggttgccattgcggccgttattgccattgccgccacggcctgcctgagttggcggggtctgagcatttggttgttgcggttgatccattccctgattcatcgcacggaaaatatcatctaagctgccgaaaccaaatggatcggttgcatcagttggtctcatatttcctcctgcttggttcttgagtaattgataacagttttggcagagattaatttcctgtcgagtgccattaacaacggttgaaagatgaatagtggctggattcttatgacagttttcacacagcattttgtcacaaccttcctatctgtttaggtgccacgtgcagtcaaaaaaggtttgacctttcttgacctatggcaatagtatacacccacatttttggaatgcaagcactctgccactaagagtgctaaaaagttgcaaaaatttcagtgacagcaagcacttgcgctttttccttaccagcttttatgctactcttattaggtgaggtgaggcaaatagatgactcaggattacgtcgctttaatagatgagttaaagactggtcagcgggacaaaatcacggtgacgccagaaacgttcatggcgtttcgcgcggcatggacgaattatcctgatcgtgaagagatcgtgggaatggctaaacgtgatggtgtcattgaataccattatcgatcagttgattctcgttaatataggcgccaaatctgatgtggcgcttgtgacaagcttcaaaaaatggtaaggtttacatgaattgttttgggtacgaatgcgcacacaaactattcggaaaaaaactagaaatctagttaatacgaaggagcagatcagtcatggaaaaacgcgaatttaatattattgcagaaaccgggatccacgcacgtccggcaaccttgttggtacaggcagcaagtaagttcaactcagatatcaacttggaatacaagggtaagagcgttaacttgaagtctatcatgggcgtcatgagtttgggtgttggccaaggtgccgatgttaccatttctgctgaaggtgcagacgaggctgatgctatcgctgctattacagacacaatgaaaaaggaaggcttggctgaataatggctgaacatttgaagggaatcgctgctagtgatgggatcgccacagcgagggcctatttactggttcaacctgatttgtcattccaaaaaaagacggttgatgatccttcaaaggaaatcgatcgcctgaagcagtcacttgatcaaagtaatgatgagttaaaggttattcgagcaaaggccgctgaatcgcttggcgaagaagaggctcaggtttttgatgcgcacatgatgattttggctgatcctgactttactggtcaggtagagactaagatcaaggatgaaaaagtcaatgctgagcaggctttgaaagaagtctccgaattctttattaagacattcgaaggtatgaccgacaatccatatatgcaggaacgtgcggctgatgtccgcgacgtgacaaagcggatcatggcacacttgctcggtcgcaatttgccaaatccagcattaattgatgaagaagtcgttgtggttgcgcatgacctgaccccttcggataccgcacaattgaataagaagtatgtcaaagcatttgtcacagatattggcggtcggactgcgcacagtgcgattatggcacgttcgttggaaatcccggctgttgttgggacagatgacattaccaagaaggctaataacggtgatcttatttccgttgatggcttaactggtgaagttgttgttgatccgaccgatgatgaagtagctaagttcaagcaggatgctgaagcatttgctaagcaaaaagctgaatgggctcttttgaagacggccaaatcaatcacagctgatggcaaacactttgatgttgctgccaatattggcacgccaaaggatcttgatggtgtgctggcaaacggtgctgaaggtatcggtttgtatcggacagagttcttatacatggattctgctgaattaccgactgaagacgatcaattcgaggcctacaagaaggttgtcgaaacaatgagtccgaagcctgttgttgttcggacgatggatattggtggggataaacatctgccatatttgccgcttcctgaagaacagaacccattcttgggttatcgtgcgattcggatcagtcttgatcgccaagatatcttccggacacagttgcgcgctttgttgcgtgcatctgcctttggcaatctgcggatcatgttccctatgattgctaccattgctgaattcaagcaagcaaagcagattttcactgaagaaaaagataagttagtcaaggatggcgtcaaagtatctgatgatatccaacttggcattatgatcgaaattcctgcagctgcagttttggctgatcagtttgctaagtatgttgacttcttctccattggtacaaatgacttgatccagtactctatggccgctgatcgtgggaacgagcatgtttcctacctgtatcagccatacaacccatccatccttcgcctaatcaagcatgtgattgattcggcacataaggaaggcaagtgggccggtatgtgtggcgaagctgctggtgatccaatcatggtaccactgttgcttggtatgggtcttgacgaatactcaatgtccgcaacttctgtccttaaagtccgcagcttgatgaagaagctttcgacagctgatatggctaagatggacgaaattgctctgaaccaaaatatcactaatgatgaaaacgctgatctggttaagaaaacaactggtcagaaataaactttcattatcagaaagaggctattgactgaataagttgacggcttctttttttgaccaaaatttgattttgatcgggctcgctagcattgatttttctgaaacccgctcgaaaatgggactttatctttgccatgcaaaaaggtgattgcgcgactatttgtcggcatctgaacagtgaatgactgcagacttttcagaaaagtgttaaggttattatgtaaactaaaaattgagttactgattcatggtatggcactgtgagcggtggttcatttggacttgtagggggaattgcatgtatcaatcaaaaacacacaatcatcgatttaccggtcaccttgcgagtgcgaagacacggttgcggctagtagctttgatttcaacgatgggtggcctgctttttggctatgacactggggtgatcaatggcgcattgccttttatttcttcggaactgaaacttgcccctggatcacaggggtgggtcaccagtagtttgacgctgggtgctgcttttggtgctatcttagtcggtcgtttaagtgatcgctatgggcgcaggcggctcatcaccatgttagcgggcttattttttctggcaacggtagcctcgtcactttccccgagtgctggctggctgattggcgcacggctgatccttggattagccgttggtggcgtctctgtgctggttccgagctttttagcagagattgccccaacgagtcaccgtgggcggttagtcacacaaaatgagctgatggtcgtgactggccagttacttgcttttgttctcaatgcctttttaggaactacttttggtaacgttcctggtatctggcgctggatgattgtattggcagtcattccggcaattatcttaggtatcgggacttattttgttccggaatctcctcgttggttaatgatgaaaggacggccggcagcagcacgttcaagtttggaagtgttgcgatctgctgctgaagtgccagcagagattgaccatttgaaacagaatcttgccgaagatgctaaacataagcaggcgagtgttcgagcattgaaaaccaaatggattcgccgactggttctgattggcatcggcctaggcgtcattcagcaaattgctggcatcaatgtcatgatgtattatggcacctcaattttacaaatgacgggttttgggcgagatagcgccttgatcgccaacattgccaatggggttactgccgttgctgcaacgattgtgacgttgcaattgttgaagcatgttccacggcggccaatgctgattgtgggattgattggctcaaccgtggcgattacaggtgtcaccttcgctagtcgactaccagcgggttcgccattccgggcatttgcgacaatcgggatgatgatgctgttcttggcgttcttccaaggcgctatcagtccaatgacttggctgctgatgtctgaaatcttccctgaacaggttcggggtatagggatgggcggctgcaaccttctgcttgtggttagctaactttggtgttggcgttctgttcccgattggtctggcccaaataggcatgttctggacattcgtttgcttcatcgggacaaatttgatttcattgcttttcgttctgatttttgtgccggaaacggctggacgctccttcgaaactttgcaccgagaggagaaagcccgcttaaattattaatgacaagccatttgttcaagaccaaaaagttgcgctttacaaaaagtttgataccataaaggtgtatcaacaattcgatgaaccttcacaaaggggagccattggctgagaacggggaaacccggacccttcgaacctgttcgttaatgcgagcgtagggatttgtgaatggtcggaagcgaccttctttgtgaacggggactcactaggaggctttttttatgcaacagcacaagcaacttgttgtcattttggaaactgcgatcattgcagcttttgcgatggcattgacttatattccacataccacgggtgtttcggcaattgaactgaattatggtctgattccaattgctgttttggctatgcggcgtgggttagttcctgcagcatgggcaggctttgtctgggggattttggatctgattttgcgtggtattggcggtggcagtgtcttgaatcctttacaaggtattcttgaatatccgattgcgtttaccttggtcggtttaatggggttgacgtttgcatctttccaaaaggcagtgcgcggtagtgaaaaagtgaaggcgagcggctatgcctttggtggtattattatcggcacatttgctaaatactttatccatttcatcgctggcgttgttttctggggtgcgtatgcgcctaaaggaacgaatgtctgggtatactcgttgatcgtcaatggcggatcagcgttattcagcaccgtcttaacaattgttgttgttggtgtattgctaaccgttgccccgcaactctttgttgctaaggacggcaaatcattttcaacgaaggctgcctaagtttaagacttcaacaacgcatatctgatgaacgcacatcgctctgtgatgtgcgtttttttgtgcgcgagtagcagcctttggcgatggcgactgcaataagttgtcaaaaggaatattagcaatacagatgtgatttcagacattgaaaagctgacgggttaagattttaaaagaaaaacacgaacgattgttaatataaaattgagaattgttctcatttttattgaatctgtcgagctgacgtgctattctcaaaacatcttaaagaaagcggggaacgagatgcaaaaagtagcagtggtcatggggtcaacctctgattggccgaccatgcagcaagtgacggctcggttaacgtcattggctattccttatgagaagcgggttatttcggctcatcggatgccagacgagctggcggattttggtaaacaggcagtggcactggggtttggtgcaattatcgccggtgcaggcggcgctgctcatttacctggaatgctcgccgctaatacattgctgccagttatcggggttcccatcaaaacacgaacattaaatggggttgatagtctcctgtcaatcgtgcaaatgcctggcggggtcccggttggcacgatggccatcggtgatgccggagctgtcaatgcggcgttgttcgctgccgctattttagcgctgaacgattcagaactggctgaccgactgcaagcttttcgcgatgctcaaactaagcgtgccaaagaaagcgaggccgcgcttcaatgattgatgtagtgacgtccccagcaacaattggcatcattggcggcggtcagttgggacgcatgctggcacaaagcgccaagtcgatgggttatcgcgtcggtattttagagccgacacccaattcgccagccggtcaggtagcggattttcaaatcactgcgccctataacgatcaagccgccttaaagcaactggctgatgcgtcagatgtgctgacgtatgagtttgaaaacgttgacttagccgcgttggaggcggttcgcagcgagacgcggattcctcaaggcaccgccattttggcgataacccgcgatcggatcaaggaaaagacttttttaaagacacatggggtaccggtgacgccttttgccgctgtcaaccgtgccgctgagttggcacaagcagttgcgaccatcggcttgccaagcatcctgaagacgaccactggcggttatgatggccatggtcagcaagatatcaatacaccagatgattttcccgccgcccgcgaacttttgacgcatggtccttgcattctcgaaaaacggcagcaatttgatcgtgaagtctccgttatgatgacacgtgatggccgcgatcaagtgcgtgtttttccaatcgttgagaatcgccatcagcaccatgttttgcatctcacgcttgcgcctgcaccgaacatctcgccggtgttagccaaaaagattgatgatctcgcgactaaaatttcgcttggcctggatcttcgtggtgtgttgggcgttgagctctttatcgaaggggacaatgtggtggccaatgagttggctccgcgtccgcacaattccggacactactcgattgaggcatgcaacttttcacaattcgatgcacatattttgagtatttgtggcttaccgataccgccgattacattgaagcagccagcggttatgcgcaacctgctcggcgacgatttaaccattgccaagcagaaatggcctaagcatcctgaatggcacatgcatgattatggtaaagcggggattcgccccggtcgcaaaatgggtcatcttacggtaactgatgatcgtaatgtgttggacatacttaaacaaatggaggcagcatggtgaaaaaaacaacattactgtataccggcaaggcaaaacaggtttatgcaaccgatgatcctgatgtgttgtggatggcatacaccaatcaagccacagcattaaatggcgagaaaaaagcccagattgcgcacaaaggcgaattaaatcgggccatttcgacgttactgtttaaggaattaacagctgtcggtataccaacgcattatcttgattcgccggacagcacgacgatgatcgtcaaaaaagccgcgatgttgccgcttgaagtagttgtgcgtaattatgcatccggtcattttgtcaccaagttcaatgttaagccgatgatgaagctcgacccgccaatccacgaatactattacaagtctgatgaacttggcgacccgttcatgaatgaagcccaaattttcgccttgcacgaagctacgcctgaacagctcaagcaagtgcgcgctttaactgattgcatcaatacttatttgatgcaacggtttgcggcgattgggatcaccttagttgatttcaaactcgaatacggcacgcttaaggatggcactttggtactggctgatgaattgtctccggataattttcgcttagttgatcaacaaaccggggcatcgctcgataaagatgttttccgacaaaaccgtggaccattgaccccggtttatgaagaagtcctttcacgcctgcaagaaaaaggagctgctcatgtttaaagctaaaatttacgtaacctacaaaccttccgtgctggatcccaaagccgaggtcattaaaactgctttgggacgaatggcttatcacaatgttgaagatgtgttgtacggcaagtactttgaattgacattagcaggcagcgaagcggacgttcgcaagcaagttgatacgatctgcgaccaattactggctaacgtcaacatggaaacttatcgctttgagctagaaccgatggcggaggttaacgcatgaaagcggctgtgatttcttttccgggctcgaactgtgatcttgatttgcaatgggcggtgcgtgacattgccggagccgagtgtgacttgatcaagccaactcaaaccgacttgactgcttatgatgttgtgatggtgccaggcggtttttcctatggtgattacttacgcagtggtgcgattgcacgcttttcaccagtgatggccgccctaaagcagtttgccgcggctggcggctatgtcattggcatttgcaacggtttccagattttgaccgaagccggtttgcttcccggcgccttgcaatggaatcgcgacttgaacttcatctgtgaaccagttgcattgacggtagaaaatgccgggacggcgttttcaaatcaataccaagttggtgaccatttgacattaccgattgctcacggtgaaggcaattattacgcagatccggaaacgttggcggctctagaaactaatggccaagtggttttccgttatgcaaataaccctaatggcagcatgcacgatattgccggtgtgaccaatgagactggtaatgtgttaggcatgatgccccatccggaacgggctgttgaagcactgctgggcggtacggatggcttgggcgtattccaatcgctgattaaccaaacggaaggagccgatgtacgtggtgcacgttgagatgacccccgaggctattgcaacccagaaaccttatttagaccttgggctgacagaggctgaatatgatcgttttgcagaactaatcggccatcagccaaacgataccgagatcgggttagctagcggtatgtggagcgaacactgcgcttacaaatatagcaagccggtgttacgccaattttggaccaaaaatgagcgcgtgttaatggggccaggtgaaggtgctggcgtgattgatatcggcgaaggcaaagcggtggtcttcaaagccgaaagtcataatcatccctcggcagttgaaccttatgaaggcgcagcaacaggtgtgggcggcattatccgcgacattttctcaattggtgccaagccggttgcaatgttggactcgctagcttttggcgacattgaacagccacatacccaacatttggttgatcggattgtcgcggggattggcggttatggcaatgcaattggcattccgacagttggcggcgaaacaaactttgacgggagctatacccgaaatccactggtcaatgccatgtgcgttggcatcatggacaaagatcaaattcaaaaaggtaaagctgctggtgttggcaatgctttgatttatgtcggggccaaaacagggcgtgatggtattaacggtgcgagctttgcttctggggatttttctgacgaagaagcagccgatcgctcggcggttcaagttggcgatcccttcatggaaaaactgttgatggatgcttgtctcgaaattaccgggcatcatcaggaggcgcttgttggtattcaagatatgggtgcagctggattggtatcgtcaagcgtggagatggctggtaaggctaacagcgggatggtgttagatctcgacctgattccgcagcgtgaggccgaaatgacgccgtttgaaattatgttgtctgagtctcaggaacggatgctgctgtgcgttcgggccggctttgagcaggaagctttggctgttttcgctgattatgatttggatgcggcgattgttggtcatgtgattgctggtcatcagtatcagctttatcaccatggcaaattggtttgcgatgtgcctgtgagttcgttgaccgatgatgcgccgatttatcatcaacaagggaaaatgccaaaacgactggcccaaccggctgcggattttgaccctatcatcactgatccggtgcaaatatggacggacatgatggcgatgccgacgattgctgacaagtcatctttgtacaagcgttacgatgcgcaggtgcaaactaataccgtcgtcttgccaggcagtgatgcagccgtgattcggattcgcggtactcaccgagcactggcgatgaccaccgatagtaagggccgttacttgtatcttgatccgcaggtgggtgcggcaatgagtgtggctgaagctgcgcgcaatttggttgccagcggcgcggaaccgcttgggatcaccgattgtctcaattttggcgacccaactaagcctgaggccttctacgaactggctgaggcggcgaagggaatcattgcggctaccaaagcctttaacgccccagttatttcaggaaatgtgtcgctgtataacgaaacgaatggtgaggcgatctatccaaccccaatgattggcatggttggcttgattgaggatttgagcacgatcaccacggcggctttcaagcaagcagatgatctgatttatctggtgggggaaactcatggtgattttaacggcagcgaactgcagaagctgcaaacaggagaagtcactggcaagctgttcgattttgatttagaggctgaaaagcagcatcagcactttgttttgaaggccattcgcgagcatctaattactgcagcgcacgatttaagcgatggtgggttgttggtcgccttggcagagatggggtttgatgcccaacttggcgcccaaattaacgtcacattgccgactgcttggggattttccgagacgcaaggccgcttcttgcttaccgtgtcccctgaaaatcaggcagcatttgaagcattgcatggtccggcccaattgattggtcgagttcaggccacaccagaatttgaagtcacaaccgttaatcaacatttttctgcatcgttgcaacagctacagacagcattcgaggaggcgctcccatgccacatgaaccaaaaggcttaaatgaagaatgcggggttttcggtgtttggggtaatcctaatgccgccagcatcacgcatcttgggttacacacactacagcaccgcggtcaagaaggcgccggtattgttgggctgaccaaagacgggatgcggcggcattatgggttggggttgctgagcgaagttttcacgaataccgatcaattgacgccattaatcggacgcgccgccttgggccacgtgcgctactcgacagcagggggacgcgtgctggaaaatattcagccgttgcttttccggttttcggatgaagccattgccttggcgcataatggcaatctgaccaatgcgatcagtttgcggcggcagttggaagatcaaggcgcaatttttcagtccacctccgatacggaagttttgatgcatttaattcgacggcaagttggccagccttggttgacacagttgaagaccgctttaaatgaagttcatggtggttttgcgtttgtcttactgacggaacatggtttatatgccgcagttgatccgcatggctttcggccgatggttgtcggggtgttgtcagatggcggctatattgtgtgcagcgaaacagcagctttggacgcggttggcgctgaattcgtccgtgatgtccagccaggggaattaatcacaattgatgatgctggtttgcacattgatcatttcaccacgaatacccaattagccgtttgttcgatggaatacatctactttgcccgccccgattcggatattcacggcattaatgtccatcaggcccgtgtacggatgggtgaacggttagcaaaagaacaaccggcggaagcggatattgtcgtcggcgtgccgaattcatcgctgtcggctgccattggttacgcgaaggccagtggaattccttatgagatgggtttaatgaaaagtcagtatgtggcgcgaacctttatccaaccgacacaagcattgcgggaaaaaagcgtcaaaatgaagctcagtgttatcaaaccagttgttgccggtaagcgaattgttttagtcgatgattcgattgttcgtggaacgacttccaaacaaatcgtgaagttgttgaaagaggctggcgcagctgaggtccatttacgtattgccagcccaccgttgcgctttccttgtttttacgggattgattttcagacgaccagcgaactttttgctgcgaatcatagcgttgctgaaatgcgggatcttttagcagtcgagtcgcttggattcctttcaacccaggggctggaagagagtgtcggcttatcggccacggcacctaatggcggtttgtgtgtcgcttatttcaccggccagtatccagcaccgttagatgattatgcctttgccttggataaggaagtggcatccctcaaagtcaatgttgcggaggttagtgcatgactgattataaagacgccggcgtggacattgaagctggcgaggcagctgttcaacgaatcgcggcgttggcaaaagaaacaacgaatgccaatgttttagctagtgttggtggctttgccgcggcttatcggttgccggagatttcggagccaactttgatcagcgccacggatggcgttggcaccaagttgctgttggcattgcaatgcgatgcgcatgaaactgttggaattgatttagtcgctatggttgcgaacgatttattggcgtcaggcgcccagccactttttttccttgattatatggcggtggatcatttggatgttgaccgcgctgaagccgttgttcgcggaattgcttatgggtgtcaacaggctcagatggccttaattggtggcgaaacagcggaaatgcccgacatgtacccgcaacatcattacgacttggccggtttcgcagttggcttggtttccgcttcaaaacgcctgccgcaaaaagtggcggctggcgatgttttgattggtctgccaagttcaggtgtgcatagcaatggttattcactggttcgtaagctgctggcagagaccgacttagggagtcaatcgcttgatgacggttcggaaatgatgaatgcattaatgcggcccacgcgcatttatgtgaagcaggtattaccgctcatgcagcaggggttgattcacgcggccgctcacattactggaggtggcatcaccgaaaatctcccacgggtgatgcctgatggtttggtagcaaacattgatccgcaagcatggcaacggccagagttgttcgatcgtttgcaacatgccggacgtttaagtgaaacaacgatgcgtagtaccttcaatcttggaattggcatgatccttgtcgtgccagaacaagcggttagtcttgttcaagacgcgattcctagcagtaaagtgattggcacggttggcgaagatcctgtcgaaaagctgcactggcaggtgagtcgtcgatgaaagatctagctgtttttgcatctggtcatggcaccaactttgaggcgttggcaaatgccgctgatcaaccagatagcggctatcgcatcgccgcactggtttgtgatcaatcacaggcgccggtgattcaaaaggctgccgcacgcaacattttgacgatcgtagttgattttaaaagctatcctaataaaacggcggcagagacggccatcttagaacagttgccgccagtatctgccttgattttggccggttacatgcgtatcatcgggccaacccttttaagagcattccctaaaaaaatcatcaacttgcatccagctttactacctagttttccagggcgccaaggtattcaggatgctttcgactacggggtgaaagtcactggcgtcacggtgcattttgtggatgctggcattgacaccggcgagattatcgcccaagtgccagtcaatatcactgatggtatgagcttagtcgagcttgagcaggcgatccatcgccaagaacatcaaattttccctgcaactgtgaagaacctcattcaagaaggagcgatttaagtgaagcgtgcattgttaagtgtttcggataaaacaggtttggtctcttttgccaaaggtttgattgatcggggatttgaattagtttcaaccggcggcacgcatcgcgaactggctgcggccggtattgcggtgaccagcgttgaagaggtgactggttttcccgagatgctcgatggtcgggtgaagacactgcatccaaagattcatgctggtattcttgcacgccgcgatgatccagatcatatggaggcattagctaaccacgatattcaaccggtcgatttggtttgtgtcaatctctatccgtttgccgccacaatcaaacgtccagatgttacaagggcagaagctatcgaacaaatcgatatcggtggcccttctgccttacgtgcagcagctaaaaatagcgacagtgtctgggcagtcgttgatccggccgattacgaggctgttttaaccggccttgaccaagacgatgctcatctgcgtcaaaagctggctgctaaggtctttgcaattacagcggcttatgatgctcaaattgtgcattatcttgatcctgagccatttcccgagcacttcacaccgacttacacaaagcgccaagatttgcgctatggtgaaaatagtcatcagcaagctgcgttttacgttgaacctgatccgaatccaactagccttgccgctgccaagcagttgcacggtaaagaactgtcctataacaacatcaaagatgctgatgctgcgctagcgatgcttcgtgaattttccgagccagcggttgtggctgtcaaacatatgaatccttgtggcattggtcttggaaaaaccattgaaggcgcttgggacaaagcctatgctgctgatccgatgtcgatttttggtggcatcatcgccttgaatcggcctgtagatctagtaactgccgaaaaaatgcacaaactttttcttgaaatcattatggcaccggcatttgatgatgatgcttatgctgtgttggccaaaaagaaaaacgttcggctgcttacaatcaatacagctgatacgccggctgaattaggaacagagacgacagcaatttatggcgggttactgattcaaacgcgggacaatcagacagaaacaccggctgatatgactgttgtgacaacggtgaaacccacagacgagcagctcaaggcacttgcttttgcgcaaaccgtcgtcaaacacgtgaagagtaatgcgatcgttgttgcccaagctgatcagacgttaggcattggggcaggacaaatgaatcggattggttcggttgagttagccctcacccaggcccaacaaaacgacaactttgctggcgccgtcatggccagtgatgccttcttcccaatggacgactgcgttgattacgcggctaagcatgatatcaaagccatcatccaaccaggcggcagtattcgggacaaagattctatagaaaaggctaaccattacggtattgcgatggtgacaactggtgtccgtcattttagacattaaaaagaagagcgtgaacaggcgtgtttagaaaccggagcataagtggccttgaggtgaactgggtgggttttggccagatagcttcaaggttctgatgtataggtttccgcgcctatgagcgcatttaagagaaaagacagacgcgtttaaaaagcttctccaccagcaaacatactaggaggttacgatgaaacaggttttgatcattggcggcggcgcccgggaaagtgcccttgctttaaaattcaaacagtctccgcaagttgatcatgtctatgtggcgccaggtaatccggcaatgaccttgctgggagttgatccgatcaacattgatgacaatgactttaccaagttgattgactttgctgagacccaccaaattgatctgacttttgtgggtcccgaagtgccgttagccgctgggattgtcgatgcttttcaggcagctgatcaaccgatttttggcgtcaccaagaaagttgcccagttagaggccagcaaaacgtttgccaaggattttatggcgcgccatcagttgccgactgcctccagcaagacggttcacaatgctattgatgcccatgccgaagccgcgacaatgggcttgccattggtcttgaaaaaggacggtttggctgctgggaaaggcgtcgttattgctcaagacgctgaaacgctggatgaaacgattgaaaaaatgtatgccgatcatccagacgcaaccgtgctacttgagcaatatcttgccggtgaagaggcctctgtcatggccttgtttaatggtgaaaagcgtgtcgttctaccgctttcgcaggatcacaagcggcgttttgccaatgatcgtggtcctaatacaggcggaatgggggcgattagtccgttaccgcaatttaacgatgatcaagtaaccgctgcccatcaacttgtggatgcaacgttaaagggcatgcaggctgatggcttagatggtcaaggggtcatgtacattggactgatcttcacacctgacggaccgaagattttggaatataacatgcgttttggcgatccagaaacgcaagtcctgctgccgcaaatcacaaatgatttttatcaactgattagcgacttattagcaaaccgccaacctagtttgacgttgagcgataaggcctatgcttgctttgttgccgttaatcttgcgtacccgagcagcgcgctcaagacagttcccgtcattgtgccgacagattggccagagggaacttggctgccagcaggggtggcgaaaagtgaccacggctgggaaagtcatgctggtagaatcttctccgtagtagctggggcggagtctttgccagatgccgttaaagcggcaaaaacagccatggagaaaattcaaggcgttttggattatcgcactgatattgggttccacacactgtaaaagtgaatgaatacaatcgcgcctcggctggctagccggggtatttttgtgcgctcaagaaactgcggttgacttttatggtttacagttgtaaattaaagatgttgatagattacagatgtaaacggaggcaagcgatggaaacaccgaaagttgaaatttcccagtctgaatgggaggttatgcgaattatctggacacttggtccactgacaagtagcacgcttgcaacaattcttgctgaaaaaatgggctggaaagtggcaacgaccaaaacctttttaggacggttagtcaaaaaaggcgccttaaccactgaaaaaaatggacgtgaatttctttatcacactgcagtcggtgaacaagagtctatggatgccgccgtggcggaattatttagccacctttgtcaaatgaaaatcggcacggccatcaatcacttgatgacgaacgtcactctttcgaaacatgatattgagatgttgcaacaaacgcttttagcgaagcagcacgatgcgccggaaacagttagttgtaattgtttaccagaaggttgtaaggaggctgcacatgaatgacgatgaaatgaaagcgatgaacgatacgaaaagatcacagactgacaaaaaagatcaaatgaatcacgatcatatggcgatgggtcaccatggcgatatggaccgcatgcacatggatcacgactctgaagaagagcatgctggcatggcgaagatgcagatggaaccgggttcaatggatcatgcagcaatggatcatatgcacatgaatcacggcgatatggaccacatgcacatggatcacggctcgatggatcatggcgggggtcacatgatgcatatgggaaatctcaagcaaaagttttgggtgagtttgatcgtcatgatacccgtgttgttgctttcgcagttcatggggatggatatccacctcggcgttttgcaattgccaatagtttttcctgggtctgattggcttgtcctgattctttcgtcatttctattcttctatggcggttggccatttttgaccggcgctaaatcagagttgcaaagtcgccagcccgcaatgatgactttgattgcaatggggatcaccgttgcgtacggttactcgctttatgctttcgtcatgaatcactttatcgcgccacatggtatggtgatggacttcttctgggaactggccactttaattgtgatcatgttgctgggtcactggattgaaatgaatgctgtgatggcggctggtaatgcggttgaaaaattggctgcattattgccaaataaggcgcatgtggttcatggcgacagtgtgatggatatgccattgtcagaggtccaggttggcacgcgattacgggttttggctggtgaacaaatgccagctgatggcgaaatcgtaagcggcagcagtagtgtcaatgaatcgcttgtcacaggcgaagccaaggctgttcgtaaggcaggcggtgataaagttattagtggttccatcaacggagatggggtcattgaaatccaagtgacaggtactggcgaaagtggctatttagcccaagtaatgaagcttgtacaaagtgcgcaagcaaataaaagtaaggccgagggcatggccgacaaagttgctggctggttgttctatgctgcgttagctgttggtattctggcgtttattctctggatgccaagcggtctggccaccgcttttgaacggatggtcaccgtcttcattattgcttgtccacatgcattagggttggcgattccgcttgtcattgctcgaagtaccagtattggcgccacgaatgggttgttgattcgcaatcgccaagcgcttgaaacagccaagcgagccaagtacatgctaatggataagacagggacgctgactgaaggcaagtttacggttgccacaacgttgcattttgctgatcagagtcaggaagaaattctagcaaccatggccgccttggaaagtcattccgagcatccgcttgcaactgggattaaagcggcagcaattgagcaaaagctaacagtgccagctgctgaaaatgttcaggtcatgaagggtgtcgggctgtcaggcacagtcgacggcattcagtatgagattgtgaatgcccgatatttacaggatcatcagttgacctacgataaaacgcaggctgatcagtgggttgctgccggaaattcgttagcctttttgctgaaaggtcagcacgttctgggcatggtggctgaaggcgatcagttgaagtcttccagtaaggcatttgttgccgagttgaaacagcaggggattacgcctgtgatgctgactggtgataaccatgaaactgctaagaaagtggccggtcagcttggtctgacggaatttcaggcagagttaaaacctgaagacaaagttgcgcaagtgaaggcttatcaacagcatggcgttgtcatgatggttggtgacggggtcaacgatgcgcctagtttggctcaagcagacatcggtgttgcaattggagctgggacggatgtcgcgattgataccgccgatgttgtcttagttcatagtgacccggccgatattctcaacttcttgtcattggcaaaagcaactaaccggaaaatggttcaaaacctttggtggggtgctggttacaatattctggcgattccgcttgctgccggaattcttgctcccgttggcttcattctcagtcctgcggtcggtgctgcgatcatgtcgttgtcaacgattgttgtggctttgaatgcaatgacactgcacttaaagcgcgcttaataagtcacgtgtatgaagcatagcatcagagaatgccgacctgtcgtcaagatatagatgacagaccggcattttgtgtacaactgatactacatcttgggggtgaaacgtgatacgatgaaaaaagtggattcataagactaaacagcagggtgcgtgacaccacgtgggttggcgcaccctcaaggaaggcagacatatgatcgaaaataaattaccccaaaatcccaaacctaaagaatggcttgccagtgagctttcacagcaacgtatcgccgattacaaaccgtttaactttgttgacggcgaaggggttcggtgtagtttatatgtctccggttgccgtttcgcttgccctggttgctacaatcgggttgcacaaaattttcgttatggtaaaccttatacgcaagaacttgaggatcaaatcatgagcgatcttagtcaaagttacgtacagggtctgacgctgctaggcggagagcctttcctcaacacgcaagtctgcattcgcttgtgcaaacgaattcgtcaagaattcgggcatgagaaagacatttggagctggagcggctatacgtatgatgaattgattcaggatttagacgataaacttgagttgctaaaattgatcgatattttggttgacggtcgctttttgttggcgcaaaaggatctgaccttacagtttcgtggcagtgctaaccagcgcatcattgacgtaccagcaacaatggcggctggcgaagtcaagttgtggaaaaatctgattcgttagttcgttcaggcaattcgaaagacgataagataatctattaaaaaatcggcatcagaggctgcttgcctctggtgccgatttggttgaataggtggctctcaattttgagatctagggttgattcaactacttgatgctatcttattcgtcagctgtctggatgtgacctagtctgggtttgcacagcaatcgcgtgggattcaggatggtgcacagtttgatcggcctctccataatagctcacgtaaggaaaatggattgtgaccgtggtaccttgattgattaccgaggttaacgacaagtgatggcctagtttttcagctaacttttcagccaagaacaatcctaatcccgttgacttatgattcgaaaggcgcccattactacccgtgaatcccttctcaaaaacacgatgttgctcatctttggggatgccgataccggtatcagtaatctgtagttgcgtttccttcccggtgttacgaatgagagccgtgatacggcctccttctggcgtatatttgaccgcattggagatgagctgagcaagaataaagcgaagccacttgttgtctgtcaatacgatttgatcggtgccattcagtctgaaagatagtcgtttattgataaagccgttccgctggttggcgactacgtcattgatgagcgggcgcaatgatgtctcatgcagcaaataatcctttgaaaagctgtcgagacgcgagtaatacaagacttgctcgacataaaattcgatttgatccaattgcagatttaaattatccagtttatcatcaggtacttgcccctcaaaactttcggccagcaacgtcactgccgcgagcggtactttgatttcgtgcacccaagaatcaatgaagtctttttgatcttgctgttgtgctagcagggcagtcacttgttggcgatgctgggtcaaaatttgattgtacgttttcgtcacaagttgttcagttgcggattcaccgccaggcaagggccaatctaacgcagcctcctgagcatcgatccgttcctgaagccgagccgcgaacctccgtactcgccaataccgtgcgatcaaaaaagcgctggccaatagtgtcactaacaacacagcgtaccaaagcgtcatggccttaacgcgatgctgcgggtcaagccagatgatcaaggccgccagaccaacacaaagaatatagccaccaatcgggcttaaatgatcctttaaataatcacgaaaccgcatctgccagcctcctaaggaacgatgtaaccttgtccaaccttggtttgaatataatctttcaacccggcttcctcgatttttttgcgcaggcgattaatgttgacggtaagtgtattgtcatcaacaaatcgctcgtcttgccataagtcctttaataaccgggaacggctgacgatttgaccgtgttgccggatcaagatttgcaacagtttatattcattttttgacaggttaatttcgttttcgccaatttgtgccataccgttttttaggttcaacatcaagccgttgtgttccaaaacatcggttccttgatcagcataattgtaggttcgtcgaagcaaggcgttgattttggcgatcaacacttccatggcaaacggcttattcaaaaagtcgtcagcgcccatattcattgccatgaccatatccatattcgtgttacgactggaaatgaaaatcacagggacctttgatacttcacggattttttgaacccaataatagccgtcaaaaactggtagattaatatccaataagactaaatggggtttttcttgcaaaaagtcatcaaatacagcattaaaatcggttatcacaactggatcaaattgccatttttttaagttatcagcgatcagcccactaatcgtctgatcgtcctctacgatcatgattttaaacacgtgaccaactccatttctgctctaatggtataagttttgggaaggaagcacaagcgcgaacaaggtcaatgagaccagtttttatgagctgggtttgtccggcttttaggaagccgcaatcttctaataaataagttttcaggatttactttaaaatgtaaactaagagcaacaaacccgagattctttgtctaacgggagttggcagcacatgcataacacgtttttggtatgataatggcggaggtgcgcgatggcaattcttgaagtatctaacttgagcaagatttttggacaacggcatgatcgagttcgcgctttgaacgaccttagctttcaggtcaacgcgggtgagttcgtcggcattatgggaccaagtggcgccggaaagtcaacattgctcaatattttagcaacgattgagacgccaagtaccggaaaagtcaatattgcagggaacgatcttgaggcccttaatgaacgacaacaagcggcttttcgtcgagatcatcttggctttgtgtttcaagacttcaacttattagatgatatgacggtgacgcaaaatgttttgttgccgctaaccttgcagcaagatcttcagcctgatcgtgctgaacgattacagacagtcgcgaatcatcttaacttaacccccattctgcaggcttttccgggggagttgagtatgggacaacgacaacgcgtcgcggctgctcgcgctgtgatcacccaacccgatcttttgttggcagatgaaccgactggcagcctcgattcattagcagcaactgattttttaaactatctgcgtcaattaaacgaaaaagaaaaaaccacgatattgatggtgacgcatgatcccttcaccgcgagcttcgcaagtcgcatcatcttcatcaaagatggggcattttttgctgaagtaacgcgtggtaagtcccgccagcagttttttgaccgaattattgatatggaagcaactgtcagtggaggaggccatacccgtgtggcatctgattaagacaaatttacggcgtcatcgtcacgaggatggcttgcaggtactagtggcagcattgatcagtgccgttatgtatgccattggggcggttgcaaataatgaaccgattttgagcgatgccagcaagcggcttggggatctggatattgttccgattctattgatgattgtgatgatggtcttagcactatttgcgatcagttttttgctttatttcaacactttactcattgctcatcgtgatcgagagattgggctatatcgtttgcttggtttgtctggggccaaattaggattgttagtctgtattgaaagtttaatgatcggtatattcggaatggctctgggtctcttactcggattgattatctcacctttattgggcatggtgctgattcgattgatggccttgcacacactgattagtttgatgctctctttcccagctatggttgatgtcgtgattttaatgggcgttgtctacctattagtgggcagcatcaatgccatttatgttcaaaacccattgcgtaattttattcgccagcaggatgtctcggccgcacccaaaccgcaaacatggtggcggttttcccttggcattgctggcgtcgttttgttggctggcagtctgtttacgatggtccatttgttaccagttagtggcgtgttgatgcatatactgccgcgaactcaggggcgtttgattccgccattgttaatgggattcatgctagtggctttgttgctgggacttttcctcgtttttgaggagtttctgcctggcatagtggcttggttccagcaacgaagtcaaatgaagacgcgcaatgcgcatgccatctcaagacatttgatcattaaacgacttcaaggaaacgcgcattcattgtggctaacaacattgctgtgtgcgattacgattacgatgcttggcagttctgctatgttgtttcaatataatcaggatctggttcagcgcgagattccgacgactgtggttgcagcaggggcaggcgtggataatgtcacgaaaattttagcaaaagctaaggtcaaaccaactcaagcaattatcctatcttcgaaacttgtatatgccgaaattcgactaagagatcaggccgatcaggtccgaaaacaacctggtgtttataatgtgattgcgatgcgggattatcaacgcgctgcccacttacagcactatttagctcctgttagacttcgtgggaacgaagcacttctaatgctgccaacgcgaaccagtttccgaccagtcggtgcccgccgcaatcctgatcgagccatcatattgccgggtagcgatgcgtcattattgttaacacgaacaaccaatcttttcccgaccggcagaaacaatttttttgaccgggggttgcttgtcagtgatcggacgtttgacatgcttgaaggaacgactgatcgattgtatatgtctcgcttacctaagtccaaagcaaccgccgctgcgttgcgacaattacagcacttggagaatagtcaaaatcttcaagagtatgtcaatattggcagttctgagcgggatggcaatgatttgagagtgacagatcgagccagcactaccttgaacttttggcgcaatccgttgggaattcagtccttccagcagggaattgtgaacactttgtatggctttttgttctttctgattttattgctcggcggcgtttttgttgtggctacgggtagcattttacttttaaaacaagtgattgcagctcgccaagaagcccgacattttcaaattttaaaacatcttggtatggatccgaggcaactccgtttaacgatttatcggcaagctgcggttgtatttgcggtaccgtttcttttcgggacaacaattgggctttgtatgattagtgttttgacaacttatcttgataatccgccttcgcgttatttgggtttgatgattttgatctatgcaattatcgattggcttttttatgaggcaactgtgcacattactgcccgcatggtagatgaacctgtttcccgttgggcgattgattagctacggcgctatccgtgggctatctgaataattacacaaaataattacacaagcgagtgcattcttaaaaagcgcattaggcgccaataaaaaatccgaagtgattgacttcggatttttcataggcgttaacaagccgtctatgtaacttatttagtttttctgatgcggatcaatcaccacatagccagcctgatggaagccgtttgcggaggccgcgcgacgaatgaactccttgactgctgacaaggccggcgtattcttaaactcgtagtagtcgttactggattgccaacctgatacgaccacaaagtcgtctgggtgtttgactttctgggcgactaagacttgagtttgaccaagaaaaatatcatgcttatcaatgagatccttaattttggcaaggaaaactttcacgtcatcgctactcaaattaaagtacatgaagtgaatataaccattgtcggcgggcgtacctaaatccgcaaggatttcatattgcaagggcgcggaaaagtgtgcttttccgctggggtcatagatcatgtaatccaaaccctcttcagctggtttcaacagtttcaattgcgggtcatgacgttcgtctagcagtttgacaaggaacgacttgctgccgaagactgtttgtattgtggacattctgaccacctccaaatccattataagctttttgaatggtttcacattgaaaggaaggaaaaacaagatgaaattgacagttttaggttatcttggcggctacccagatgcgggtcacgcgaccagcacttaccttattgaaagtggtgactatcatttattgatggatttaggtagcggcggcttactttcactagagcagcagtttgatccattaaaattagatgcagttttattgactcactaccatcatgatcacatcgcggatgtcggtgttttgcagtactattatcaattgcgaaaaggggacaaaaaggtgtcaccgttgccgatatatgggcatacaaaagacccgttgaactttgccagtttaacgtttggcccttatacaacggctaaaggctatacggcagacagcactttgcatctcggccctttaacgttaactttccttgaaacccaacatccggtgccagcgtttgctgttcgaatcgttgaagacgtcactggtaaaacacttgtcaatacaagtgatacgcgttatttcccggcattggcaccgttttctaaagatgcggatcttttgatggcagataccaattttctagcagatcagccacaaccgcgttggcatcttacagcaccagaagcgggaaaactagccaaagacgctcaagtaaagcgcttattattgacacatttgccgcaacagcttgatcttgtcaccttgaaacagcaagcacagactgctgctgggggtataccaattcaattggcagaggatgacttgacaatctcaatctgatactcttgataagccttactttaaaataataacaagatgtgtaaatcgaggttattataacgtgtattatttattgcaaatgaataagcataattgttgataaaatgaacaatagtcaatattcgttaatatggaatttcagcttttaaaaaattatttttctaaatgtgattgcttagcgccggtccaatctcttatactatacctgtagagatgaaaagtacctcgtcacgaaaaggagcgagcgctaatggttattttatatacatccccaagttgcacatcttgtcggaaggcgcgcgcctggttgaaggaaaataaaattccattcgaggaacgtaatattttttctgatccattgaacgtagatgaaatcaaacggttactgagaatgaccgaagatggcactgaagaaattatttcaacacgttcgaaaatcttccaggagctgggtattaatattgatgacttgtcaactggtacgttaattaagctggttgccaagtatcctggcttgctacgtcgcccgattatgatggacgataagcgtctgcaggttggttataacgaggatgaaattcggcgcttcttgccgcgttctgtccgaacaatggagctgcaacaagcacaactacttgcaggtttttaaaaaactaattagtggctgttgaactaggccaccatatcttcgacccttgtagtaaattttaataaaatctttcaagagaagctttcaggtaaaaatgccgatcgtcctcaactgaaagcaatgttagactatattcgtgatgatgatgaagtagtggtactgagccttgatcgacttggtcgcaattctcatgatttgactgacatcatcgaaaccattcggcatcgtggagctcaattgaacgttctaaatctacctagctttgcaagtattgaagatcctaaccttcgtaacttgattacgacaatcattgtcgaactatataagtatattgctcaagaagagcgcgaaactattaagatacggcaacaacaaggcatagaaattgccaaacgctagggcaaatataaaggcaaaattcgcgaatatggtcctcattcacctaatcgtcaaaaacgctatatttataaagaagcctgtagccttttaaataggaagaaagacggagatgaaactctgaccaagcgacaaattgcccgcatgttaggtattgcaccagtaaccttatatcgcattgaaaagtatcaggcagaagatctagcaaatgttccccgtagtgagaggtaaacatcatgatagatttaaggggcaaacgaattctctttacaggccgtttgcgatcttttcgtcgtttccaggcacaacagttagcaactattctaggagcaaaacctgtcaacgggattgaaaaaaatgtcgatatccttgtcgttggtattattagcaaaccctatgatcaactacttaccactcaaaagttaacgtatgctagaacctatggcattccaaagattgacgaattagcctttatttcatggtgccaatggcgattagatcaattgaaagcaactctttaagtgccttcttatcaaacggggggattagtatgcaaaagcgtatcgatttggccaatcaaacgtttggacgactcacagtcattagttttttttggaagcagttctaatggaaacgcactttggctctgtcaatgtcaatgtggaaataaatgtattgttgacagtcaacgacttcaaaaaggattcactcgcagttgtgggtgtttgcgatcagaaataagcagatcaaacataaaagctaataaccagactaaaaaatacatgggcaatcccaagaattttcaactaattaatcgaacaaatttagttgcttctacacttaaacgatccaataacaaattcggcatgataggtattagttaggctaaaacgactcaaaattaggtagcacgacttcactttcaaagccatcttaataaaccgtgtatatgttcatgcggagggtgcaatcgctgctccaaagacagcaaaaaaggatatcattcctttgcaagagcaatataatcaatcacaccaacaaaattgaacaaattgatcagacaatccgagtaggcgcaaatcccattgcttatactgccgatgaacctatagaaaaggcgcttcgtcataaaatggttcagtactgtaatcctccaaatggcataaatattaagactagttttcaagaaaggaagccgtaacgtgcgtttatggcatcaagatttaattcagcaactcccaagacaacaattattgggacagcatcgtgaaattgcggcgcttcgcggtaatggatggggacggaaacacgctaccgttaattacgtatttgcacattccccatataaattatttcaatttcactgtattgtgttacgtgaaatggaaaaacgaggttatcatccagatcagaaatggtatgatcctctgtatcgaggtcaacattgcccagcatacaaacaactcaatccggttgcactcacaatacccatctatcctgagcatgaccaacgatataaacatgtttgcttaacgaatttacaaaacaagggaatctttttaaaccttccgtgatcctagtctgcgatgttcatcttgggacataggattgacaaaatagtatctcaacaatatatttactaaaagtaaataaatagccagtattacgttgataggagaaaatcaaatggtaaaccttacagaagaaatgaaaaatatgttaaagaatcagctcccctttctagcaacaacaggaaaagatggcaaacctcaagttggtcccaagggttcactacatgtcttagatgactcacatttaatctactttgagcacacctttaggcaggcctataataatctctcgaacaaccatttggcggcggttgcggttgctgatagaggcgctcaaaagggatttcgctttgagggaacggctcatattcatgaagcagatgactttgctaatcagattctagataaaactaacatctttgatcgtttcccacgcgctggcgtggtggtcattgatgttgaacgaatctataaattggataataccttagaagctggtattcaaatcgcctagggtttttaaaacgaattcaaccgagtaagtcgaagaactttttagtgtccaaactcatacagtgtttatttcatgtcattaagtattcattagcaagcagttttgttatactttggttagaagtgatagaagtacgtctaattcttaagaaacccgtagcttactgttaacgccattacttcgagcgtgtcgattttcgatacgcctttttttgtgttattggataaaaatcatccaataaaaatggctctacgtcaactggtgttgaagaataaatttatcatttgaggcggttctcctcaagtgcattggccgggctttggccagtgtgcttgaggtccttatacgcaggtttctgggctggtgaacgcgtttacgaggagggaacagaatggcagatccaaaagggtttttaaaataccctagacaagacgatccaatgcggccgatcatgcagcgtatcaaagattttaatgtgatggaacttgatttagacatggctgaacgccgtaagcaagcagcgcgctgtatgaactgtggtattccgttctgccatcatggcgtcttttttggcggcggacgagccgtgagtggttgccccaacgataatctgattcctgaatggaacgatctggtttatcgtgatcaggataagcgtgcgtttgaacggttgagccgctcaaatatgttgccggatatgaccggacgcgtttgcccagcaccttgtgaagtttcctgtgtgcaggcactcaacggcgctggcattaccattcgtaacaacgaaaaatttattatcgagcaagcattcaaacatggctgggtggttgactctggtaagcccctgcatcgcaccggtaaaaaaattgcagtcgtcggcagcggtccggcaggtattgctgcagcatggcgattgaaccagcttgggcatgccgtcactttatttgagcgcgatgatcgctttggcggtttgctcatgtatggcattcctaatatgaagttaccaaaagacgtcgttcagcgccgcatcgatacgttgactaaagtgggaattgaactggttgcaaacacggaggttggtaaggacatcacggctgatgagctgaagaaaacgtttgaccgggttgttatttgcaccggtgcgcgcgaagctcgagatctcaaggtgccaggcagagaactttcaggcattatgcaagcaacagattttctcaaagcagccacccaaacagttttaaaagatgggccagccgcaaatgatcagttgaagggaaaacatgttctggttcttggcggtggtgatactggtaatgactgtattggcacagcgattcgtcagggatgcgctgatatcacccagttagaaatcaccccagcgttgccagcagaacgaacaccgcaaaatcaatggcctgagtggccgatggttttgaaaaccggctacgggcaaaaagaggctaaagcattgtttggcgatattaccgcctatgcctcgacggtgacggctttcttcggcaaagatggccaagtcaaagaagcagaaattagtcaggttgatcactttaaaccagtggcaggcaccgaaaagaaaattaaggccgatcttgtggttttggcaatgggctttactggcgctgaacaatggctttttgatcaatttggcatcactgccaaaaatgataacttcacgaccaatgacacgcaaatctatgtggccggtgattgccgtcgcggcccaagtttagttatctgggggattcatgaaggcaggatgtgcgcggagaaaattgatgcatcattgcaaacgttggccagtgagaaaatttaactagttggcggattggcgaaaagtaatgctcacctttctgacgattgatacgtacttacacaaaaaccagaggaatccgttactcagtcgattgattaacaggtttctctggtttttgaggcactaaactaatgaactttaactggcgtccctgttggcacatgctcgaatatccacttagcatccgcaatactcaaccgaacgcagccatgagagccaggctctttgccaagcttagccgcctcgtttttgatgtattgtacgccgacatctgtcgggacggtatgaaaaagataagttccatgcagataaaagcttgtataataatgggcgcccatttgttcgtttggattgaagaattcataaccccgttcgtcttgaatcgcaaaatcacctcgtggggttgagtcatcaataccagtagacgcatacatcgtgtatagcgttttgtcgccttccttgataaaaacccgttgcttttttagattgacatctaaagtaatgttcggatgctgggtgaggtcgggataagcctgtttctcggaaggtgctgtccagtcaatgttcttcggggctgtatgtaccttggttttatgactggtggccttgtgacgttgttgtttcttttttgtggttgatagagcgatagcggctttcgaacttgacggtgtcggctgatgtaaccgttgacctgctataattgcgacaacacaaactggcaacaatatcgcgaagaataaaagtgctcgtcgataattgcgcttgagacgatgtgtcttaaaaaagtggatgctggccgcgatctgatcgaaaaaacgagtgatacgtttcacgttattcctcccgtttagtatgcagcgcgataacaacaagcaatgcgttatcccatattatagtggatttttgatgaggtggacagcaaagacctttcgcgcaaagcgcaaggttcttaaggcaggttcttcatgttcaagatcatgtaccaacacacgcaccaccatagggcacttgcaggcttgcaagcgcttctgcacgtgcttacaaaaaaagcccgattcgtttattaaacgatcgaccttcttttgtttatgtgagcgttacatggagattagagatcttcatcgatgcggattggttggcctgattgcaagtcatcgatttcaacaacgcggaagctttttttctcaagccgggaaacgatttcgttcaatgtgttttcatcagttccggccggcaatgtaaagagggtgcggcgtacgaactcgtcgcgtttggcatccaaggtgatacacccagaaatggacacatacttggccaaaatcttgctcattttggccaggtcgccacgctcgccagtcgacataactgtcagcacgtaggaaccaacatcaacgttccaagcttctgacagcatgccaagcagtttagcgtgagtcaagataccgtaaaagttggcattttcatcaaggacagcaatatacggtaaatccttaatgttgaagaagactttaaagaatggcgcattgactggaatcgtcttggtggcattcttcagcaaataggtcactggcaaactcatgtcaccgccttgagacttgtgccgataaatgtgcatcttgtagatgttgccacggaagatcgtgccgctttcatccagaatcggcacacaacgaaagccggagtcttcaaggatcttcagcgcgtcttcaagggtgaccgtttccttgacagtggtcaggaactccttttttaatactaacgacttaattaacattcgttttcctccatcaaacaggtatcactttattaaaatattctaatcttgctttatgataccatagatcactggcggtgtaacgtttttctggactgttcatgctgaagatcactttcagaggtaatgttatatctgttgcacgatgctattcagaaacgattgtttttaaaagtgcagagaccgttcctgacatctcattaaataatgggttcgttgttttttcgttgcatgactgatattaccgaagttgtaccacttagccttacgaatgcctaattgttccagcgtttggttgataaagatcttttgaattcaatttccggaggcaatgaagataaacgactcaaagaaacattagcgccaagtggcgtaaagtcgcgtccgatcagctaatgtttacaatttagaataaacaaaaaagacttgatcctttgatatcggggatcaagcctttttgtgacgctaaaaagaatagttatgggtcgagcgaatctatttttaatacacgatcacaggtgtgccttcgtcaacagctgcatataacttcgccatgaagtctggtgggttgttgacgcacccatgagagccatgttctttgtaccaatcaccaccgtattttggttgccatggactgtcatgaagaccaacaccggtgtaatcaatcggcatccagtaagaaaccggactggcataagaactgccatcgtcgttcttcccgcgtaaggtagcgttacgttgcttagaccaaacatagaacacaccagacggcgtatcttggcctggtttaccagtcacgatgtcagagtccatgacgaccttgccatccttaatataccattcgtgttgtttttctttggagacttccacgtaggtattgccgatgtcgccagtggttgtataaccagatccgctgtggctgacttctttattcaagtcttggccagctttcacgctagcaagaatcatagcagaggtggcgctaatgttgatgctccaaccataagtgccagcgggaacggaaacggtaccttgttgttgggaattaaattgacgagtcttgtgaatggtgctgtattgttgcgacaaggccgtgacataatttgtaatggcttgggaagaaaccgttgccttaccattatcattagtgacccaactcaaaacagttgcttgcggaaccgtgacggtagtgctttgaatctgcaagctgactttggtgcttgcaagtttgttcatatcacgttcagttgtctgcaagtcgcgatcagatgctttaaccgttggctttttataagcatctgttagttcaatcacttgacgatggttatcaagtgcgcttgtgacagttgtcgccagcttgtcggcatcaatttgatcaccattaacttccttttgaatcttgaactgatcaccgcttgtcacaagcttcgcattgaccggttcctgacgattttgatttaacttgtcagccgtcgaagttgcgaattgcttcagagcagcagtgttaatggtagggtcttcctgagcattggttttttgaccagcaaagactgatgtcgtccattgccaaggattttgcttgttaaggatttgtgttaagccttttttaaaatcttggctaagtcctaaagcatcacctttaactttcaaaatctttttattcttttcaacaaatgtgtactgacgttgatcgaattggtcggtcaatttcttgttagccgcgttgacggtctggccggagacatcgacaccgagaatttctgtgtttggcagaaaatggtcgcgataatgcatactttgaatgatgtaaaatccgcccatgagtacgacgaggacgccaacaacgaggagccatcgcttgtttttcttcactgatcgctgcctcctgttcttcgtttgttcttgtttcgtggcaagcacttcctcaaataagatgacattgtacttcgccattataaggtattgaaggtcgaattaaaagcaacatcacctgtttcaaacgcggcatgagtgacaatatcaagtgttaccgtggtgttacagaattattaaaaaacatttagatatttgcggtttgctaggcgctcctgttcgcgctcaccataacgcgctcgcagtcgcagaaacctccgcataaggaccatggctgcaatggtcaaaaaccgaccatcacggccatggtcgcttatgctccggtttctagacgctcctgctcgcgctcacaaaaaaagcaaccagcgactgggctggttgcttacttatcagtgatcgtgatgattactgacgagtttcgatgtcattcttagcgaaagcatcggtcagaaccttcttcaattgagaagcagatttctgcatggattcttcttcgtgatcggtcaatgggatttccaggatgttctggataccattacggttgatcacagctggagtaccgatgtagatgtcgttcaagccatattgaccatccatgtaaacggaaagtggcagaaccgcattttcgtcgttaaggattgcctttgaaatccgggcaagggcagttgcgataccatagaaggtcgcacccttgagtttgatgatttcataagcggcgtcacgaacgtcttcaaacatcttaacaagcttgtcttccttgatttctggatgagccttaacccattcagcgatggtaacgccaccaatgttagcgtgggaccatacagggaattcagtgtcaccatgttcgcccatgatgtaagcgtggaccgaacgagcgtcaacattaaccatttcagcaatggactgacggaagcgggcggtgtccagtgaagtaccggaaccaacaacccggttcttcgggaagccagaaagtttccaagttgcataggtcaaaatgtcaactgggttggcagcaactaagaaaataccgttaaagccggaatcaacgattgggtcaacaatggacttcaagatcttcaagttcttgttaaccaagtccaaacgagtttcgccaggcttctgaggagcgccagctgtgataacaaccagatcagcatccttagcatcgctgtattcagctgaataaatcttcttaggacttgtgaatgggagcgcgttgctcaagtcaatcgcgtcaccctttgtcttgtccttgaaaatgtcaacgattccgatttcctgagcgataccttgcaaaaccattgcgtaggcataacttgaaccaacggcgccgtcaccaacgagaataactttttggtgatccttatccgtaatacttgccacggtgatatcatcctttcttatgtgcatgcaaactgcatttcacgttgagtataacacattatcaattccctgaaacaaatttgatagactttttcatgattttgccattgtcaaaaaatggcgtcgagccttactacagcaagacttgtgaatcctgtttcaagcaagcttccaataacgtaagcgtttccagcatctgttttcacgaatgtgggaaattcaacagttcccacggtcaactcgcacagacgtaagacgtcagtatggtatactgctctggacggaaaaggcaaaatccgtctattcgcgttagagcgcgaacaggagcgcttagaaaccggagcataagcggtcttcgacacaaatggccggtctttggccatttgtgtcgaagacccttatgtggaggtttctgcgactgtgagcgcgtttccgagcgaagcgtggctagccgctactagaaaggcacgatgcttatcgaatctaaaagcaatcgcacagatccggtccctatgtggaggcttctgggcctgtgagcgcgtttccgagcgaagcgtgaccggccactaccacaaaaggcacgatgcttatcgaagcagtcatacagatccccggtccttatgtggaggcttctgggcctgtgagcgcgtttccgagcaaaacgtgaccggccgctaccagaagataagcgagttagctcgtccggccagaatatagaaacactcacaaaaaaagtccttacaactataaacgcgttttccccaaggaggataaaagttccaatgaaaatgattgttggcctaggaaatcccggccagaaatatgcaggatccaaacacaatatggggttcatggtcgttgatggcttggccaaacgactgaacctgacgattgacaagctggagtttgatgcagctaccgcgacaacccgtctaaatggcgaaaagatcttccttgttaaaccccagacatttatgaatgcttcaggtcgcgccgtccgcgagctgatgatgttttatcagatacaattagatgaaatttttgtcgtgcaagacgatatggatttaaccttaggcaaattgcgcttacgcaagcgcggctcagcaggcggccataacggcatcaaggatattatcagtgccactggcagcgatgagttttgtcgactaaaaatcggtattcagcatccgcaacggcaacgggtcgttgattgggtactaacgccgttttccaaaactgaccagccgttaatcgatgatgcgattgagaaggctgatgatgccttggaagattggctaaatgggatgccgtttgatcagctgatgaataagtttaattaaaagataggtgacttcatggcgaaaaggtgaagcacatgtgtacgttagtagaagaaagaagcaggtgacgcgatgaatttgatcgacatggtgcaggcagatccagcattgtcggcattatggccgaagctgaaaacgggtcgccatttggtgacaggactgtcgggctcagccaagacggtcttttttggcgcgctattgcaacagcgaccgcagcagattctaattgttgaaaacaatcgctttcatgccgatgaattagctgctgatttaagcagtttgctcggagatgcaatggtttacgattttccagttgaggatgtgttggcagctgaagtcgcggttagttcgccagagacgcgtaacgatcgtattaatgctttgacgtttattcaaagcggcaaacctgggatcatcgtgaccagtctggccggttataagcggcttttgccgtcaccagccgattgggcagctagtgaattggccattgatatgacttccgagcttgatccgcaaaccgttgccaaacagctggtcgccatgggctatcgacgcgattcgttagtcagcgcgccgggacagtttgccattcgcggcggcatcattgacgtctatccgttgaatcaagacgatccgattcgaattgaattgttcgatactgaaatcgattccatccgcagttttgacattgccacccaacgtagtctgcaaaaacttcagcagatcacgattgcgccggcaaccgatatggtggcgactgatcaggttttggccgctgctggcgagcgcattaccaagcaagctaatgcctacaaggcaaaagtgaaaaatgccgccgctaagcaggccgttacagatggtttattgacgactggccagcagctatcggcccacgagcgtcctgaaaatctagctttatatgcggccgagctatacccagagcagcaacgcatcagtgactatttgcaaccagatgcactggtagcattcgatgattacagtcgtttgctagatagcgatacaaccttggtgcaggatacggcagaatggtactcacagttgcaagaagaaggccgtctgctacctaacacgccgaacctgacgattcaggaacttgcacagcaagataagcgcccgcggctttaccttagcctttttcaaaaaggcatggggcagttgcgacttgacagcttgaccaatattcccagccgtaacgtgcagcaatttttcagtcagatgccgttactcaaaacagaaaccgatcgctgggtaaagcagcagcaaaccgtggtgttcttgatcacagataaaaatcggctggaaaagctgagcgaaacgttgtcagattttgagattagcaatgtcatgacagccccgactaagctgttgccaagccaggtgcaattgacagaaggcagcctgaaaaatggcttcgaactgcccgacttgaaattagtcgttgtgaccgagcacgagttattcaatgctcgccaacgtcgtcacgcacggcaccaaacactggcgaatacagagcgattgcgaagctataacgaactcaagcctggtgactacgtggtgcatgttaatcacgggatcggtcaatacaccgggatggagacattagaagttgacggtgtgcatcgtgattacattacgattgtttaccgcaacaacgataagctgttcattccagttgaccaactgaatctagtccaaaaatacgtttccgcagatggcaaaacgccaagcgtcaataaacttggtggtgctgagtggcagaaaaccaaacgcaaagtagctgcccgaattgaagatatcgctgacgaattaattgatttatatgccaagcgtgaagcggaaaaagggtttgcatttgggccggatgatgacctgcagcacaagttcgaagcggagtttccttatcctgagacaccggaccagttgcggtcagccaaagaaattaagcatgatatggaaaagccgaagccaatggatcgcttattggttggcgatgttgggtttggcaaaaccgaagttgcgttgcgtgcagctttcaaggcaatcgattatggcaaacaggcagccattttggtgccgacaacgattttagcccagcaacactttgacacgatgaaagaacggtttgcggactttccaatcaaagtcgggttgttgtcacgattccagacagcgcatcagaacaaggaaacgattaaggggcttaagaacggcaccattgatattgtcgttggcacccatcggctgttgtctaaagatgtcgcttttcgggatttgggattgctggtcattgatgaggaacagcgctttggcgttaagcataaggaacggatcaaacaactcaagagtaatgtcgatgtgctcacgctgacggcgactccgattccaagaacgttgaacatgtccatgctaggcgtgcgtgatttgagtgtcattgaaacgccgccaacgaatcgctatccgattcaaacctttgtcatggagcaaaatccaggcgtgattcgcgaagccattgaacgagaaatggaacgtggcggtcaagtcttttacctgcataaccgggtggaagatatggaacgtaccgtgagtcaactggaggaactggtgccagatgcaagtgtcggatatgcgcatggtcagatgactgagacgcagttggagaacgtcatttatgactttttgcacggtgcttacgatgtgctggtgaccacaaccattattgaaactggcgtggacatgcccaatgccaatactttaatcatcgagaatgccgatcattacggcctgtcacaactttatcaattgcgcggccgaattgggcggtcaagtcgagtcgcttatgcgtactttatgtatcagccgatgaaggtgctcaatgaagttgctgaaaagcggcttcaggcgattaaagatttcacggaattgggtagtggtttcaaaattgcgatgcgtgatctatcgattcgcggagctggcaacctacttggcaagcagcaacatggcttcatcgattcagtgggctatgatctttacacccagatgctgcaagaagctgttaataaacggcgcggtattaaatcggctgagaaaacggatgctgaaattgatctggggctggaagcatacctgccaactgattatgtggccgattcccgtcagaagatcgagttgtataaacgcattcgagaagcagacagcgatgaagccgaaactgagatcagcgaagatctgattgatcgttttggcgactatccgcaaccggtgaccaatttattggcgattgcgcatctcaagcggtttgctgacttggcttgggtcaatcacgtaacgaaggcggggcaaaaattgacggttgtgttgtcaccgcaagcaactgctaaagcacaaggcgagccgattttcaaagcgttaagtgcgacaacattgaaagcgcaggtcgcgatcacggatggcaagctgacagttacgttagcattgccaaaagatatgaagactgcgacttggcttgatcaattgaccggctttttgcagggattactgactgttgtcaatccgcaaccggaaaagaaatcggcatagttgctgtgaaaagtaggggcattcattgtttttgacccaacttggctgtgatgacatgccaatgatcaatcagctcaagcagacttcggtgtcagtggatatagtgataggagggctcccatgcacaaccaagaaatgaagcacttgatgcgcggcgcgtggattttgagcctgagctcactaatcgccaaaatactcagtgccgtttatcgggtaccgttccaaaacatggtaggtgacaccggcttctatgcctatcaacagatttacccgatttacggattaggcatgacattcgctttgtccgggttcccggtttatatttctaaactagttgctgaagcggatagcgatgaggccaagctaacagtcgcgcaccaaagccgcgtgattttaatatggatctcgtgggcattgtttttaggcctgcaaatctttggtggcgtgatcgcgcaagccatggcagatccggaattgctgccgttgattcaaacggtggctttcatgttcttgacgatgccgttgctggccacaggccgcggttattttcaaggcacttttgatatggctaaaacagccactagtcaggttgttgagcaagtcgtgcgtgttgctgtaattctgctagcagcttggtggtttttgcaatatcattggagcgtttatcagatgggtgctgtggcaatgaccggtgcattcttcggcggcgcggcggctgcattgacgttatggcggccatatcggcaagtgtttggtcagcagcactttcgttttccggggatgcaggcttatgtacgtctcattagccggtttgtccgtgaaggcggggcgatcacactttacgcagctttgttgattttgttgcagctgattgatagctttacggttacaaaagggctcacagcttcaggtatcgccatggtgactgcgaaaagtcttaaaggggtttatgaccgggcacagcctttagtgcaattgggccttgtagtagcggcatccttgtcgacaacgcttttaccgagtctgactcaggcgcgccaagcccatcagcgccgtcagtttattcgcagcggtgccgaattggtgcattttaatttagcattcgcattggcggcgacagctggcttgattgttttgatgccggctattgatttgctgctgtttggagacacagccgggacatttgcgctgcaactatatgcggttgctattgtcgttgtcgccatgatcaatgcctataatgctattttgcaaagtcttgatcagtatgctggcattagcgtcgcgctgttgctaggcatattgcttaaagccgtcattaaccagccgcttgtcgtgaagttcggtactgccggggcaagtggtgcaacgattctctcactgggcttgatcctttgcttgatttattatgcagttcctgagacgatcaaaggtgctagtgccatccgtctgttcgtccctaagttaatcatcgtgaccggtatcatggccgcggcagtctacgccgctgtcggttggattccgttaagctcccggatggtggcagcgggtgtgacagtcgttggggtattacttggggtcatcattttcttggccgcagggacttggcttaaaatgctaacgctgcgagaaatgctcgatttgccaggcggtaaactatatatgaagttcttacaacggataaagcgaggtaattaagttatgcgattagataagtttttaaaagtctctcgaattattaagcggcgcacagttgccaaagaaattgccgataaagggcgaattatgatcaatgataaaccagctaagtcaagctctgatgttcgtgtgggggatacgttagtgattaactttggcaacaagacgcttactgtccgagcggatgatttggttgaaaccaccaagaaaaatgacgcagcggggatgtacacggttttgaaagaggattataaagaaacattttaatacgtatttattggctcgcagccctcgggatttgttatacttgatttattgatttacggatgtaagtaaatggctggtgaaaaacgaaggtgcggtcaaatggcaaagaacaatatcagtcaattgaataatgcgtatacgcgtgagcacgaacaaaagcacaaacgtacgcccaatccacgggcgcacgccgtacatatgaagcggattcggaatctgttgatcgtgattgtcgccattttggggttcggcgggcttagtttagttcgaacgcaaatggcgttaggagagacaaaccacgccgtccaaaaagcgaagggcagtttgacaaaattaaaagccaacaagtcagccctcaaggttcaggtcgaccaactgcacaatgatgactacacggctaagctgattcgcgaaaaatatctctattcgaagcaaggagagattatttttaacttgcctgataaggtcaacaaggttccggatttgaatgtgaatcagtgatttggacagctaaatagaaaggctaggctctggacgctgttgtatctaaaacgcgctcacagacccaggaacctgcacataaggacctcaagcctaaatggctaaagcccaaccatttaggcttgaggccacttatgttccagtttctaaccgggtctgttcgcgctcttgcttaaacgcgctcgccagcccagaaacctgcgtgtaaggactttggttgcaatggccaaaacccggccatcacgacccaagccacttacactccggtttctaaccgggctggctcgcgctcttgcgtcggttttctgccgtgctatactaataggtacatttaactaggaggacttctttttttatggcagttgaagttggtacgaaagtgactggtaaggtcaccgggatcacaaaattcggtgcttttgtcgaattaggcgatggcaagaccggattggtacatatcagcgaggtctctgatgcttatgtcaaagatattcatgatgtgctgcatgttggcgaaccggtgacggtgaaagtactttcgatccaagatggtaagattggcctgtctatccggaaagcggtcgataaaccgcagcaaagtgaacacgaaaatagtcatcgggagagtcatcatacaccatctgcgcggccaagcggcaatcgctatcaaggcggtgcgcgtagtggcggcggcaatcattttggacacaaagcacaaccatccaaagatgattttgatgcgatgatgtcaggatatttgaaggaaagcgaagatcgattaagcgttcttcgccgcaataccgagggtaaacgcggcggccgtggtggtcgccgcagttaaaaatcgggtctggaacaaagcacattttgttctaggcccattttcttggtttctgcaggattgcgcggaggatgcccatgagcccgaaactttttcaacgatttggctttgcaccgcatactcgtgtgctcgtggcggtttcgggcggcgtggattcgatggtgttgttgaacctggctgtcaaagcagctgacttagatgtggtggtggcaaccttcgatcatcgcctgcgaccagagagtcagcaggaacaagcctttgttgtcgccgctgcccaacaattgcaggtgccagtggtgactggacaatggcggcgatctgatgggcagccaaccagtgaagcggccgctcggcaagcacgctatgcctttttagccgcgactgccgctgagcagcatgctgaggttgtcatgacagctcatcatgcagatgatcaacttgaaacgattctgtttcggctggcgcgctctggcgatccagccgcgttaatcggtattcgcgctgatcgagcttggcatggacgtcggttagtgcggccattattgccttacagcaaggcgatgattcgctcctatgctgatcagcacaacgttaggttttgcgaagattccagcaatgctgatccgcattacgcaagaaatcagttgcgtcatcaggtcattcctgcattcaaaaaacaaaacacgcaattgctggcgcatattcaaacattcacgatggagcagactggcctattagcgttggctgaagcacaactggctgagtggcttcaacgcctgcaggttgatgacgcaacggttaattggcgtgccgcatcaccgcagccggaagctgttcagcgtctgctattaaaaaaaatactgcagcaatggcaacccaacgttgatcgccagctactttcgccagttctagcgagtctaagcgggacaaaagagcggcggtttgatctgggcggcgggatttcaattgctgtccagagtgaacaaattgttcgcttaacgcggcaggcgccagttaaaccggtcacattcactaagcttgatcagcaacatcgtaccactcgtggcattttcagcctgcagacaagcgttgctgctgacaaaggcacgccggtcagagtgaaactgccaattactttgcgcacaaggcaagctggcgatgttgtgcaattacccaatggcgtgattcagaaactgcggcgttttttgattaacacaaaaattccagcctatcagcgcgatcaattattggttttagctcggggtcatcaagtgttttgggttgaaggtcagcctttagaacgattgtcggccatagatcaaactgatatactccatgttgtactggtgcaatcaccagatgttgacaaaagtgaggataaatcatgagttccgatattttgaaggtgttgtattctcaagacgacatccatgccatcacggcacgacttggcgctgagctcaagcacgattatgcagggaaaaaccccttagtggtgtgcattttaaaaggtgccatcatgtttatgacagatcttgttcgtgagatcgatgattacatggaactcgactttatggacgtttccagctatggggatgcgaccgagtctagcggtgaagtcaagattatcaaggaccttgacgccagcgtgaaggatcgggacatcttgattgtagaggatattgttgataccggccggactttaaaatatctgaccgacattttcaaaacgcgtcatgcgaagtcggttcgtatttgtgcgttgatggataagccagaaggtcgcgtcgttgatgtgcacgccgattacgttgggacaactgttcctaacgaatttgtagtcggttatggcttagattatgctgaacgttatcgaaacctgccttatatcggtgtattaaaaccggaaatctacgcagcaaaatcctgatctgaatgttgtgtttgtggtagtatataaggtactaatcgaatgttgccggaggttctaaatgaagaaaaaacaaaacggcctgttcagtagcacattaacgtatatcattatttttgtgctattggtcaccggttttgcgtattatatgcgcgataatgggacaacatcgtcccaagagattgaaaccagcacgttcttgtcggagttgaaaaaagacaacgtcaagagttattcactccagccatctggcggagtctataaggtcagtggggaatacaagaaggcacagaagtcttctagttcaaataactcgctgagtctgtttggtagtcagagcaccaaagtcacgaagttctcgacatatattccgacgaacgatgcgactttgagccagatccaaaaggcaaccagcgctaacaatgttaaaaccgacacgcaggaagaatcacaatccggcgtctggtttagcttgctgattacggttgtgccgattgtgatcatgatggtcttcttctacatgatgatgaatcaggctggccaaggcggtggttccggtcgggtgatgagctttggcaaatcacgggcgaagcaggcagataaaaatgccaacaaagtacgcttctccgatgtggctggtgctgaagaagagaaacaggaactggttgaagtggtcgaattcctgaaggatccgcggaaattctcggcattaggtgctcgaattccagccggggtgcttttggaaggccctcctggtactggtaaaaccttgcttgccaaggcggttgctggtgaagctggtgtgccgttcttctcaatttcaggttcagatttcgttgaaatgttcgttggtgtcggggcttctcgtgtgcgtgatctgtttgatcaggctaaaaaggctgctccttccatcatcttcattgatgaaattgatgctgtcggccgccagcgtggtgccggtatgggcggcggccacgatgaacgtgagcagactttgaaccagttactggttgaaatggacgggtttaccggtaacgaaggggttatcgtcattgccgctactaaccgttctgatgtgcttgatcctgctttgctgcgtccaggtcgttttgaccggaagattctggttggccgcccggatgttaagggtcgtgaagccatcttgaaagtgcatgcgaagaacaagccgcttgcaccaagtgttgatcttaaggaagtcgctcgtcagacgcctggttttgtcggggctgatttggaaaacttactgaatgaagctgccttagtcgcggcccgacgaagtaagaaggcaattgatgcctcagacgtggacgaagccgaagatcgggtcattgctggcccagcgaagcgcgaccgcgtcattaatccgaaagaacggaatatggtggcgttccacgaagccggacatgccattgttggtttggtcctgagcgattcgcggacagttcgaaaagtcacgatcattcctcgtggacgcgctggcggttatgcgatcatgctgccaaaggatgatcaattcctacttgccaagaaggaattgacagaacaaatcgttggacttttaggtggacgaacagctgaggaaattatctttggcgttgagtctactggggcatccaatgactttgaacaggcaactcaaattgcccgcagtatggtgacgcagtatgggatgtccgatcgtctcggcacggttcagcttgaaactgaaggccaaccgttcctgggtgcacaatatggtcagacaccaccttattctgaaacgacggctacagccattgatgatgaaattcgtcgcattatcgacgatgcccataaacaggctcacgaaatcattgaggcccaccgtgaacagcataagttgattgcggaagcactgcttaaatacgaaaccttgaatgaaaaggaaatcctcagcttgttcaatgatggcaaaatgcctgctcgtgaccaagatgaattcccaagtgaaaaggcggctactttcgagcaatccaaagcagcccttgaacacaaagataaagaaaagcaagcagatgaagaagccagtggtaaaactgattcaccacaatctggtgatcagcaagccagtgacgacgatactgattctgatgaggttgaaaagccagacgatacttcgactgacaattcatcttcaaacaacgatgatcagcagggtccgcaagcttagatttgaatgatttgaaaaagtcctttttagcagagatgctgagaaggacttttttcgtcttcttatgtcatggctaaattcaaatgatggtatggcagcaggaaaaatctcgttaagtatagttaaaaggtgtgtcagattgcgctaaaaaaatgaccgatcgatctattttcgttaataatgaggttttaatgctttttatgaaaagcattacataacgaactgttaacctttgaagagaaagattatcatattttaataaataatcatctggtttttgagacttgacaccttaactatgaagtgctaaagtgctatattcgtatcgttagatattatatatataaaaatatttgttgttttttgaggactctattgttaacatgaaataaagagcgttattaaattggacattaaataattaagaggactaattagggaggggtactcaggtgaaaagcttttcaaagttgttgatgatacttattatttaagttttgtcgctaagccttttccctattcagaaaacatatggtgccgcagatgggtttccggtagcaccaccggcctcaacgttgaatgccagtgattactttactaagagtcaagcggacccaaaaaacttccctaacgtctccgcttttagcaaggcttatccgcaggcacttattgtcacaggtagtcgcgagacgaagagttggcagattggcggtatgtggtctaagtcaaagattgacctgaatagtgcatttacatatgacacttatcattactttggctcgcatcctggagtagatgctgatgggatggcctttgttctgcaaaacgatccgttgacgataggtgcttatggctccccaggtggcggacttggcgcctatccgtggtcgactgatggcaaaaacaacatgatcaagcaatatatccgcaacgcacttgcagttgaaatggacaactggtggaacggatctggcgtcgcagatgatcgatttgatgtgaactatccaaatacgtttggggtcggccatcttggcgttgttcgtccgggtgagacaccgctaaccaccaaaaaatcagaagatgttggacatcttcaatatattcagttaaataaaccgctttcggatggcaagtttcgccactttgttgttaagtggacaccgtctgtgacgtatcaaaatggggtacgcatcttaggcggcgacttgcaatattaccttgacgatgacccaacgcaaggaagcacttttcacattaacaatgttctagactactttaaatcagacaaagtctattacggatacaccggtgctagcggcgctaatcctacttttcaggcggttgcactcattaagacacctcagaatgcaaaaccagtcactgttaagtttaccgactctgctggccaacaaattgctgatccaatcacgatccccggtgatccgggtaacagttgggacgcatcgtctagacgaccagaatggattcaatatcaaaataattggtatcaatatgctagcaagtacacagctgatacgcctgatggcaaagattcgggccaattttctgcgacaacgtcctacaccgtgacctaccagtatcaattgcgtcagccgccggaagatttcgttcttcaaaaggcggttcgcaatgacacagccggcgagactgagtttaagacggagacgaacggccaaaatggcgatggtgtcacgtatcaattgcaatataccaacttgacaggtatgggcacgggcagcatcaaggatcagctcgacccgaataccacttatacagatggttctttacaaattgcagatgctgacacgaacaacgagtttgtgacaattgacgacacgagtttcaatacgaatggcacccttgcctttccttatacgatcccgaatggccaaggtttcagagttcgttttaaagccaaaattgatcgaaaggataccgcagaaacgattctcaacaaagccagtgtgggaaccttattctcgaatcagacgaccatacatttaccggcgacgacaggcaaagttattttccgctatgttgatcgggcaagtgacatggcaaaaccaaccgagatcgcgcccgaagtgacagtgagtggtgatgtcggcaaacatgtatcggaaattaacgcagatccgattcggccaaaagcaattgatggttatacagtggtcgatcaggcaacttccagtgatctcacaagtgcgacttttgatcaagccagcgtggttgatccagtgatcagtaaagacgatttggtggtgacttatcgctatgagaaacaaatgctgaaactgaccgttgatccaacacttgactttggtcagtttgacaataagtcggttgaccgaacctattacattggggaaaaccaaagcacgaccaagcaaccattgccttttggcgtcacggttgaagattactacggcacacaaggttggcaactgagcgtacaacaggacggtcaatttaagtcaactccgaaaccaaacagtcaagatccaaacttacaggttgctcaaactttgaccgatgcgacgctgcatctgatgaatcctaaactgaaacgaacagatgcaacttcaaatccaacttgggcgcaggaagacacgatggattatcaagcacctgacgatttttccttgaatccgacagccaccagtccaactgttttagcgcaagttaaaaagagcggtcactatcgcaatgatggcagcactgataaagatccgaccgggacgttgtatgacaatagcggatatggcacatggcggattaactttggtgacaacgatagcggcgcgacaagtgttgggttacatgtgccagcaagcacaccacggtatcagacccgctatcatacgacgctcacttggaatttgtcgcttttaccataggaggaataacttttgcaatggaaacgaggacggtggctgatcgctgccgcggcatgcatactggtcggtctcgcaccgcaaagcgtggccgccgccagtaaaaccgaaacaactgactttgaagtgcagccggttttgcctgatgcgcaagcaaatatgaaactgaattattttgatttggtgtatccaaaagatacaacgcacaccatccagatgcgagttcaaaatatttctgataagaacatcacagtcaagagcgacttacgaaacgcctatacccaagatggcggcggtatcgactttacaccgagcacgaagaatcttgaccgaagtctgaaaacaccatttacaaccgttgcaaccttagacaaaggtggcgccacgattcaattagcaccgaaacagatgaaggtcatcagtgcaaccatcaaaatgccaaaacagcgatatgatggcatgatttatggtgattggcattttatcgaacatgtcgataaaggcgaatctggcggcaacgcggttggctcaaactatgcttactcagttggggtggttttacgtgggcagaattatgaagtttttccgaacgtcaagtatgacgaaacaaacccaatcttatttcaaaaacatcccgcacttggcgtaacgttgcgtaatgttgaaccgatggcaatctcaaaagcaaatgtcagtgttgcagtggggatggatagcggcgatgttaaaacgtacaaagctgataatttcatgattgcgcctaactcgaagatggtctttccagtctcatggagttatgaatcaatgaagcccggcacctatcacattaaggtcacactcaaaggcttgaacacgcaaaatcgttttccaatgagctggacgtttaagaagacgatgaaggttagtaacgttcaggctaagagtatcaacgaacgtgctatcaagaaaccagtcaatcactggctttatgcaacgatcgggacaggcgtcttgctattagccagtctggggggactgctatggactttcaagcttcgtccacgatgaagagcgcctggcaagccttgcgattagtcctcatcggtgttcttggtattgctttgatgaacatgtttacttttacaaattttgtaagcgctgccgtctctaacagccagcaagcactgatggtcgcgccagttttacctagtgacaatcatgttggtaaaggcgctggctacttcgatctcgatcttcctaaaagtgagcgacgagccattacagtacaggcatacaacgctagcgcacaaatcttaaaagcgaatgccgaaattcttgatgcgcaaacaggagctaatggcgttgttagttatgtaaaagccactcaggcgaatcgtaaatatctaccggtcgccgggagtgacttagtgagaattgatcgtcaatttgagctcaagccgggagaaacgcgacaactgccaattgttttgaagccggggaaagggcagccacgaggaacttatttgtcagcaattcgcttgtcagccttagcaccatcaacaacagatacaagtgtccaaaaccgaattgcttatacgcttggcctcgtcttgcacaacggtcatgttgctggcagcgttagcaacttaaggatggggcagaaatctttggtacaaaaacgatcaggatttcagttgcgatctcaagtacaaaatcctaagcgaatttttttaaaggatatttcagccaagattaatctgataagcgcaacgagtcgctttttctcattaactgtcacccgggagttgccacgaatcgcgccacaaacagtctttgatgtaacacgactgataaccggacaaaaatcagtggcaggtgaatataaactgacgagtcgactgaaacaaggcaaacaggtaagagaagacacacggtacgtcaaaatcactggttcaggggaactggttacaagttcggcaactgcttaccaaattgcccaacgaaaatggctttgggtcaaacttgtaattgtgttggttgttttactactgattagtttctttatttatcggcacgttcgccgcagcaaaggaggtgatgctgttgaaagcactgatcgctaaattttcctaccgacgcgtcaagtggttttggattggtctgtccatcctgctgctcatcgcctttgtgacgtgtcttgtctttacgatcaagacatacaacgattttaatacctggaagacggtcaatctgttctgatcgtcaagctatcgcttattgaaactgttttataccgtggataaatccatgatgtaaaaaattttaagaggaggaatttcaaaatgaaattcactaaaatgacaagagcgttggtcgcgggtgcaactttacttgccggtttggcaatcgctgccccagcggcaacgcaagcagctactgttcaaggtaatgcaagcgttaacggtggtcaggcactaccgcaagacgccaagacaaccgcggggatttcctttggtcaactgccgccaactggtaacaccggttatctgcgactgcaaatggttcctaagattttggactttggtaaccacgaacagttcttctcagattacccggttttcactgctgacggacaaaacgcagggcgggctgacaatactcgctatccaagttataagagcggtaatacaaacttgaccgctgtccttaatactgatgacaccgctttggctaatgttaagggcaaggcttggacaacggttgttgataagcaaaccacgcgtaccgatgctgaaagtgctgaagataaaactggccaaaccaacagtaaagctggggattggaccctgagcgtcaaggcagacggcccgctttcattgaaggacgacaatggtgccgatactggtaagacgattgacaatgcgacattgaccatgctgaacaccgcttatggccagactggcaatgtctacggtttgaccaacgaatcgcaagatgatggcttcacaccggttggagcattagtaccagtgactgacatcagcaaaacaacaacgatgaccttgagtggcactgacaccaatcatcaggtggcacatgcggctaccgatgaaggtgaaggcgccaacgtctttgcctgggacaagacaaatatcaaactggttctgcctaagacatcagtcgttaataacggtacgtacgaaaccacgttaacttggactttggcaacaggcctgaactaaattcaaatgacatcttgagcttttcacttggccggtacataggccgaacgtgaccaaagctttgattagtaacaatcaatacctcgctgatagaaaggcggggtattttttatggaaagaaatggacagagctttgcgtcaaatataaaagttgtttatccacgcttgttcaggcgactacgatagccgcatcttttcaataacacccatctctggtaaaatagccacgtttacctttcagaaaagaggaccctacatgagtgactatatcgcgagcgcattgtcgcgtgatgaacattttcgaattttcgctgctgatgcgactcaaacagtgcgtgaagcgcagcggcgccatgatacttggagcgcttcatcggctgcacttggtcggacgcttgttgccacagcattgttagcggcttccgggctgaaaaacgcagacgatatgttgacggttcgcattaaaggcgacggtcccgttggcgcacttgtcacggatggtaccaatgttggcacagtacgcggctatgttgaagaaccgcacgttaacttgccgctgaatctggtcggtaaaatcgatgtcgcgcgggcggttggcaaacgcggcttactagccgtgacgaaagacattggcgtcggcgatcccttcaccgggcaagttcccttggtttctggtgagttggcagaagactttacctattatttagccaagtcagagcaaattccggcggcagttggcctgtcagttttcgtcaatgccgacaacaccattcaggtggccggcgggttcatgttgcaagccttgcctggtgccagtgatgcggagctctctgaacttgaagccaacgtgaaaacattgccgctggtttctgaattattaaaaagcggcctgacaccagagcaaattattcagcgaattgccggtgacgaaccagtccaatttcttgatgcgcagccgttaaaatttgcctgcaattgttcaaaagaacattttggcgatattatggcaactttaccgcatgctcaattacaggaaatgattgatcaggacggtggtgcagaaaccacgtgcaagttctgtggcaatcaatatcattatagtgtggcggacttggaagccttgatggcccgaaacgaatagttgcagttgacacttattttaagtaaagttagcaaggcgcaagcaagaaagaggtggcctgtatgtggcatattgccgatgttgaaattccgaatcgcttagttgtcgcaccaatggcgggtgtgactaacgcggcctttcgggtaacggctaaagaattcggtgccgggttagtggtctgtgaaatgatcagcgaccgcggaatcatgtataaaaacgaaaaaaccctgaatatgttatttgtcgatccgcgtgaacatccaatttctattcagatttttggcggcaccaaggagaccttggtgaacgcagctaaatttgtggaccaaaacacagcagccgacattattgacatcaacatggggtgcccagtccctaaagtgacgaagacagatgccggggcgcactggctgctggatcctgaaaaagtttatgaaatggttgcagccgtaacagatgccgtctctaaaccagtgacagtcaaaatgcggactggctgggacgagaaccatgtctatgctgttcagaatgccctagccgcagaacggggcggtgccgcggcgcttgccatgcatggtcgtacccgtaaacagctttatgctggtcatgcggactggaacattttgaaagaagtgaaacagcacctcacgattccgttcatgggcaacggtgacgttcgtaccccgcaagatgctaagcggatgttagacgaggttggtgctgatgctgttatggttggccgtgcggcattaggtaatccgtgggtattgaaacagatgtcggcttatctggaagacggcgaattgatcccggaaccaacaccgcgcgagaaaattgcgacagcaaagctgcaattacaacggctggttgaccttcatggcgaacatcaggctgttcgggaatttcggatgcaggcagcttactacttgaagggaattccgcgctcggctaaaaccaaagccgcggtgaacatggttgatacgcaggcagaggttaatcacatctttgatgattttgttgaacaaaccgaagagcgcgctcgcgaacggcaagctaaagcataaattagcagtgtttcattgacacacgcctgtccacttttgttggtcagtgacgagtgtctttttgttagagtaggttgctttttggatgtaaaattgtcatcatcaaagagtgataaaaattgaaacggaggaacatgtgttggctaaggataacggacagcaaccagaaatgaatgaccaaatgattgcgcggcgagaaaagatggaagccttgcgtgaagcgggcatcgatccattcgggcaccgatttgaccggacccataccgcagcgaaagtacgcgaagaattcggtgaagatgataaagagacactgttggatgaaaaaccagaagtgacaattgccggccggatgatgtctaaacgtggcaaaggcaaggttggatttgcggatattcgtgatcgtagcgggaagatgcagatctatgtacgtaaagatgtcgttggcgatgacaactacatgatcttcaaaaaggccgatcttggcgatattcttggtatcagcggtgaagtcatgaaaactgattctggcgagctgacggttaaagccaaccatgtgacccatcttgctaaggcactccgcccattacctgataagtggcatggcctgaccgatgtcgagcaaaagtatcggaagcgttaccttgatcttatttctaatgaggacagctttgatcgttttgttaagcgaaccaagattgtcagtgctgtccgtgaatacttggacaacaatggtttcttggaagtcgagacaccagtcttacacaatcaggctggcggtgcgaatgctcgtccattcgtgactcatcacaatgcacttgatattgatttatatttgcggattgctcttgaactgcacttaaagcgtctaattgttggcggcatggaacgtgtttatgaaattggccgagtttttcggaatgaggggattgataccaagcataatcccgagttcactgaacttgaaacttatgccgcctactgggatttgacagatgttatgaccgaaactgaaggaattttccggtttgctgcgcataaggtgctagataccgggaagctcacctatcagggaatggcgattgatctggacgcaccgtttgcccgaattaatatgttggacgccattaaagacaagactggcgtggacttctggcctgaaatgagtgtcgatgatgcgcgtaaacttgccgatgaacatgatgttcactatgaaccttattggaaggtgggccatattatcagtgccttcttcgatcagtttgtcgaagagacgctcattcagccgaccttcatcacgggccatccaatcgaggtttcaccactggcaaagaagaatccaaaagacccgcggtttgttgaacgttttgaactatttgttggtggcggtgaatacgccaatgcctttacggaattaaacgatccaattgatcagcgccagcgttttgaagcgcaggcagctgaaaagagtgctggtaatgacgaagcacaaggtatcgatgacgattacgttgaagctttggaatacggcatgccgccaactggtggtctcggaatcgggattgatcgcttagtcatgttgctgactgatgcaccatccattcgcgatgtccttttgttcccaacattgcggccataaccaatcatgatatgtcgcccttgtggcggcattttttattttccgaaagatatgacggtcaccaggatataagtggcgcaaatcacggataatattgtgctattatttgcaaacattcggagaacgatttttaattgaaaaagttgttgacgatggcgcaaaccgttggtatgataaaaagcgtcgtaaatgagcaacaacgattaccgatcaggtatgaaaaaaagttattgacaagcattgattgcttgtgataagatatcaaagttgtcttttgacaaggtcgtcctttgaaaactgaacaaagtttcgtttcaagtgcattggccgggctttggccagtgtgcttgaggtccttacacgcaggttgctgcgctggcgaacgcgttatgaccgcgacatcgctttgatgtccacggctgatgatcttattaattaaccatcatacaacatgaaactacctttattttaccattgaatgccccttagtgactaatgattaggcacagaaatgttaattaacttcataaagtgaccttgaaaacttgaaaagcacactatgtaaacaacaaaagcaccggcgcataagccagtgcttttgttgaacgaataggcagaaattacatcataccgcccatgcctgctgctgggttagcaccagcggcagcattattatttgcatttggatctggcttgtcagcaacaacggcttcagtcgtcagcatcaaagcggcaacggaagcggcgttttgcaatgcagaacgggtcactttggttgggtcaataatacctgacttagccatatcttcccattcatcagtagcggcattgtaaccaacgccttgcttttccttcttcagctgttcaacgatgacagaaccttctttgccggcgttctcagcaatctggcgaacaggttcctcaagcgcacgtagcacgatgttgatcccggtttgaacgtcgccttcttctttcaaagcagcaactgcaggcaaaacatctaccagagctgtaccgccgccagcaacgtaaccttcttcaaccgcggcacgggtcgcattcaaagcatcttcgatccgatacttgcgttccttcaattcagtttcagtagcggcaccaaccttgacaaccgcaacaccgccagctaacttagccaaacgctcttgcaacttttcacggtcgaagtcactggtcgtgtcatcaatttgcttcttgatgatattaacccgttcagcaatggcatccttagagccagcgccatcaacaatcgtggtgttgtccttggtaaccgttaccttgccggcacgacccaattgttcaagcttggtgtctttaagatccaagccaagatcagaactgatcacggtaccaccagtcaaggtagcaatatcttcaagttgagccttacgccgatcaccaaagccaggggccttaaccgcaacaacattgaaggtaccacgaatcttgttcagaactaaggttggcaatgcttcaccagcaacgtcgtcagcaatgatcaacagtgccttaccttgttgaacgatttcttgtaacagcggcaaaatgtcctgaatattggaaatctttttgtcggtgatcaagatataaggatcgtcaaggtcagcttccatcttatcattatcagtgaccatgtactggctcagatagccgcgatcaaactgcatcccttcaacaacagagagttcagtgtcaatccctttgctttcttcaatggtaatcacaccatcgtgtccaactttttccatggcgtcggcaatcagactaccaacttctgtatttgaggaagaaacggacgcaacctgcgcgatttctttcttaccattaactttgtggctaatcttgtgcaattcgtcaacggcagccttagttgctttttcaatccctgtgcgaatgccaacaggattagcaccggctgtaacgttcttcatgccttcgcggataatactttgtgccaaaaccgttgcggttgtggtaccatcaccagcaatgtcatttgtcttggaagcaacttcggcaaccaacttggcgcccatgttttcgtagtgatcttccaagtcaatggacttcgcaattgtgacaccgtcattggtaatttccggtgagccatagctcttgtccaaaacaacgttgcggccttttggtcctaaggttgtcttaactgtgtttgccaactgatcaacgccgcgcagcattgcagcacgtgcgtcttcagagaatttaatttcttttgccattgtttttattcacctcaaaattgatcgattatttagttacgcaattgccatgatgtctttttcatgcaatacaaggtagtcttgaccttcatacttcacttcagagccggcgtatttgtcgtataatacagtatcgccaactttgacggccattggcaaacgcttgccttctggtgtcaaagcgccttcacctactgcaacaactttgccggtttgcggcttttgttttgcgttgttggctaaaacgatgccgccaactgtctgctcctcttcttcaacgacctcgacaatcacgcgatctcctaatggttttaacaaggcaatccctccacattacattttttgatttagcactcgttatgtctaagtgctaactacagaagtaactataacgagttttacggttgaatgcaaccccaaaccgtggaatgttatacttattccagacatttttttaaaggagctctttatgtcactacaaaaacatggactttccattattggtgcctatttagtggcgctgattggtaacttgctgattttccaaatcttacccgttggccgactcagcttaggtcttgctactgtgatcagtgtgctggcgatgattgccgctggattcagtgagcggcagttagtcattgccaacgccatcgaagaacctggggttgccgccccacaacaacgggttttctggggactaatcggtatcgttggcgttttggtcgctcagcttgtgggttcatggctagaaacatttttattcaaaataccgcaaactagcagcctgattcaccagcagctgtccagtatggcaactaatccgtggtatttcctagtgatcggattggctattcctgtgttggaagagctaacctatcgcaaagttctattcggtaatcttgtgaatgtcaccggtatctttggcggtgccttgatcactagtctcctgtttgctttaacgcaaccgggtggacactggttaagcgccacattggttggacttgttcttgcatatgattatcgacacactggcgcagtcagcacggctattatcgcccgccttggatctttgtgggtggtttggctttactatctcgcccacaccctataatcgtaatcgaatattaaccttgacccctgctttcatcccttataatagaaataatgattttgtgaaggagcagttcaaacatggagacacgttctaatcgccgccaacaacaacagaagccgaggcgttttcgctggggcaaattgatcggcctaatcgttgtggttggtctgttcacaacaggtgcgtatgccttgcggttatacagtcaggcaaaatatgccatcaataatacatatcatgcgaccaaacatgtcagtaccgacattgctaacaagaagccgttcgccgttttgctactaggcgtcgatactggtgctgatggtcggattgaaaagggcaactctgataccatgattgttgctgtcgttaatcctaaaaccaagaaaacaaccatggtcagtatcccgcgtgacaccgctgcagagttaattggcgcaaaggaattcaacatgcagaagatcaatgccgcgtacaacgttggcggttcggacatggcgatcaacactgtttccaagctggtcaatgtcccgatttcttactacctaacaatcaacatgggtgcgcttgaaaaagtcgtcaatgctgtcggcggtattgatgtcgtcgtaccgttttcctttcaggatccatacactggcaaccagaagttcacgaaaggccccatgcatctcaatggcaatatggcgctggcatattcacggatgcgtcactctgacccagagggcgattatggccgacagaagcggcagcaacaagtcatcaaggccattctcaaaaaagcaatttctgttggatcacttggcaattttaccaagctcatggacactatctcaaaaaatattgccacgaatatgagttttgatgatatgcaaagtattttcttgaattaccgtgacgccgccaaaacagtttcgactgatcatttgcaaggtgtcaacgcatgggtcggtgatggtgcttaccagattgcttccgacgctgagatgcaacgaatctccaacaaacttcggacagctctggggctgcaaaccgaaaccatcagcaatgaagagacaaaacaaaatgcgaagaacacgcagtttgactttaaggcaaccacggaccaaaactacattatctttaccccgtatgattgatcattcaaaaacacccgcagatttcactgtccgcgggtgtttttgcgcttaaattcaagattcaagcaagtttcttctggggtcgttcccgataccaccaccagaaaccaagagcaagaatggctatgattgaaacggtataagaaagcagctcattgtttaacagccactgaccaagcccgtatggtatgacagccaatgcatatatcatgaccacccagcgtaattttggcagtaagagaacattgcccgcattttccagcgaaatgtggtcaaataaccaccgcgtcgcaaaatagccgataatactgataaccatcgcggcaataaagtaggcaaaaaataagttgttgcctgataaccggactggattcgaccgcatcgttgaatagatcagtcgatctgctgcagttgttccaaaccacgtaccgaacagcccgaagacccccatccaaaacggtgacgcgaaaatcgtaccaatggcggtgccgattgtatacatgaaactaacaaccgctatattcatgagcaaaacacctaaaagattcatcccactcaatccgacatacatagcaggaatggcaacataataacctatgatggtgatccctgagccaagcatcatcacaccaagaagactcagaaaaccataccaataacgtgttgcaaatacccttcttcggcgaaacccactactgaaaatggctgcattaaaaccactcgcttggtcaatactggctattgctaaaccgactattagcggaatcaaatacgagacaaccgtgaaaaagcgaccactaataaggtcagacaaaagttgccctttttgatttggaataaaaagatgacgctggtcttcccgatactcttcataacttttattgttataaaaagtaaggtgatttttcttggcctcttgtttactttcttcaaactgcgctaagtccatgacgtatttttgctcgttatgataattttgtatgctttgacccaaattcaccgctgacagcaacagtgcaaagactaccatcacccgcaacaaaactttatgtcgcgatcttaccagtttcaataaacgatcttcacccatttatttcacctccgcgtttttggcgcgaaactcaactttaaataaatcagatagcgataacggcaaactctcattcagcacgggttcttcggcggcaatcgcggccttgacttcaggtgtgaaatgcgggaaaaccgcttcgatcacgcgtccacgaatggtcagaatccgaccttgttccctgatcacatcaggaatcgccttggttttgaaaactaactgcagcttgatcgcctgctgtctgacgtcctctagcgtcaagtcctgactgatccgaccggctttaacgaacaaaacgcgatctgacaagccgtctaattcgactagattatgtgaggcgatgagaaaggttcgtttaccatcagcaacagcatctaccaccaaattgacaatccgctcgcgaatcagcaaatccaacccatcaaatggttcatccagaaaaacatacggtgccccgctcgccagcgccaacgccaccatcaccaatgcctggtaaccttttgaaagactctgaaaacgttgtgatccttgcaggccgaactttttgatcagcgcaataaaccgcgcttgatcaaacgtcgcatagagcaattgataatcgccggcgattttatccagccggtatttacggaagaagagatgttgattatcaaggtaaaaaagattttcgcgttgttccggatggtcggtcaagtcctgttcatccaactcaatggtgccccccgtccgcacgatattgatgcgtcactgttcggaagatggtcgttttcccaataccgttaggcccgacaagcccgaccacctgccctagtgataaggaaaatgtgatgttattcagtacagcctgatcggcaatctttttttgcaattttgtgatcgttaaactcatgcttgtccctccttctcattgagccatgcctgcagaatgggaatgctgatccccaaactctgcgcttcaaccactaaggcatcaaatttaggccgaaatgccgcaatatcttttgtattggcctgccttaacggttcggcaatgaacgagccgcgtcctggctcaacatagatcacgccatctgcttcaagctgcttataggcctttgcaatcgtgttgggattgagctgctcttgttttgccatctctcgcaccgatggcaatttgtcacctggcagcagcacgccttgcaccacttgtgctttaatttgcaacacaaggcgctcgtagtaagccaaatgggcatacggatcagtcgccatgaccacgccccctttcgtattatgtgtactattatacgtagtacacttaaaaaggcaagcgaaaagagcaagtcttatcgaacgacttgctctcactttttttccaaacaaaaaacgccgactagcggcgttttcgacaaattatgcttctggttcttttagagtcggcccgtaatgctccaagaaataaatgagcgtctgtaattctgttgctaggtcaacgttttgcacgcgaacataacttggtacagagatgcgaatcggggtgaagttcatgatgcccttgatccctgctttaaccaaatcatccgtaatgtgttgcgcagcatcaatcggcaccgtcaaaatcacaatttcgatttgctgatccttgatctgtttgatcatttcatccatgggatagattgggacaccgctttggatggtaccagctaattcgggattaatatcaaagccagcactaatccgaatgttgtttgcctgccgaaagttgtaattcaacagcgcgtgaccaagattgccgacaccgactaacccgacattggttaaccgatcctgattcagaatctttttaaagaaattaagtagatcgacgacatcatagccgtaaccgcgtttacccaatgcaccaaagtatgaaaaatcacgccgaatagttgccgaatcaaccttcactgcgtccgacaattcagtcgaactgatcttggttgttccggaattggctagaaaattcagataacggtagtacacgggcaggcgttttgccgttgctttggggatgattgtttccgccatataagcaagcctcctgtagaagtattcccacgcagaacatgtgaactgtccaacatagtatctcttgcttatattagctggtttatagtgtgaaggcaagcggatacatcttcacaagcaaattttttattatccagggaccatcggggaacgcgcgccgatgaacgaaactatggtatattaggttctaacgattattgtgaaagaaggtatccctgtgatcattttgcaggcgcaacaagttggccgcagttttaacggcaatgaattatttgctaacgtcaacttagaaattcaaaacggcgcgcgcattggcttagtcgggcccaacggcattggcaagacgaccctgctggagatcctgactggtattgccccacccgatgctggtcaggtcacaaccatgaagaacctgtcaattggttatttagcacagaattcaggacttgattctgacaaaacgatttttaaagaaatgctgacggtctttgcaccattacaagcgatggctcggcaaatacatgacttagaagttaaactcggtgatccgcaactcatcgccgacaaagaagcttttgcggcaacgatgaaacaatacgatcaattgcaacatgactttaacgaacaaaatggttatggctatgaagccgaaattcgttccgttttacatggttttcagttcggcgaaacgacttatgacaagccggttggcactttatctggcggtgagcggtctcgattggcgctggcgaagctgctactcgaaaaacacgacttgatcatccttgacgaacccaccaaccatcttgacattgaaaccttgagttggcttgaagggtacttaaaaacctatccgggcgctattttaactgtcagtcatgaccaatatttcctcgatcacgtggtcactgagatctatgaattagatcatcaccacgcgacacattacaaaactaactatagcggctatctcaagcaaaaagctgatcgtcaagctcaagcttggaaggcttacaataagcagcaggaagaaattgccaagctgcaggattttgtcgacaagaatattgtccgcgctagcaccaccaaacaggctcaagctcgacgtaaacaattagaaaaaatggatgtgcttgaaaaacctgctggcgataataagacggtgcattttaactttaccccaacgcgaccaagcggtaatgaagttttaaaagtcgagcaggcgacagttggttatgagccggacaaacccatggctggcccgattgactttcaagtgaataagtttgaccgaattgcgatcatcggaccaaatggtgtcggtaaatctactttactgaaaagtgttttgggaaaaattccttttcttaaaggagatgccaagtttggcgccaatgtcgacgtaggctattacgatcaggaaattcaacagcttaaccctaaaaacactgtcattgacgaaatctgggacgatcacccgatgatgcctgagaaggatgtccggtccgtgctcgcggccttcctttttttggcggacgacattcaaaaaccggtcagtgccttatctggcggccaaaaagcgcggctggaactcactaaattagcgttgaaacacgataatttcttagtgcttgatgaaccgaccaaccatttggacatcaacagcaaagaagtcctagaacaggccttaaaagacttcagcgggactgtcttatttgtttcgcatgaccggtacttcatcaacgagttggcaacaaatgtggtcgctattgccccgaccggcagcactacttatctgggcaactgggattactatcaagaaaaactcaccgaaactcaggcagaagcagccgccgcagccgctgctcagccaacggcaaaaactgaaactgctggtgcgacctcttaccagcagtccaaagaagacgcccgcgctgaacgcaaacttcagcgggaagtggatgatttagagcagcaacttcaagatcttagccaacaagaggccaaaattcaaaaagcgatgactgcaccagacgtcctcagtgattatgtcaaaatgcaaacactgcagacagaactcgaaacagttcaaaaacaaacagctaaagttgaagacgcttgggaagaaaagggcattcaactggaagatatgcatgctgataacaattaaaactgctgttctttaaattcaaaataggcacggccaaagatggtccttggtcgtgccaaactccgcaatctccggccagatggggtggcgacgcatagctagtgctgtgacggcgcttcgagcccatctggcctacgattgctccgccttggcactggtatctttgagccttaaaaaatatctccgagaaaataataggcgaatgattttccttttacggaaaaatcattcgcctattgttaactgtcaatgatgttccaacaccatttttgttgtctacttactcgaagccttctcatcaatcaacgccaaggcttgccgcaaaaccttttcaccgtccatcatcccataggctcgcatgtcgataacggccataggaatattagtaccagcaactttagcggcaaactgactttccataaagcgtacttgcgggccgagcatcaggacagatacgggttcagatgcaagtttattatcagcatctgctgctgccgttgcgaaaacatcaacatcaaggccatctgcctctgctgcttttttcatccgttgtaccagcattgaggttgacataccggcggaacagaccaacataatcgttttttcagccatgggaatcatcctttcgttaacaaacttatctataagataagtctaaccaaaacagttaggcggcgtcaacgaaatcgctgtcggccttgcatttattatgaagcgtgggtaaagctcaatcctggatcagcattcaagctttctgaagcaagatgctgcttcgcccattcaatatgagcagccgcgccaatcattgcgccattatcacccgtcaagcgaagtggcggcacaatcacatcgacatctggaaaattcacagccaaggtttcgttcatggcttctttaagcccttgattggctgcaacaccaccggccacaatgagttgtttaaccggatactgatgcagtgccttttgcgttttgtgaaccaaaacatcgacaaccgccgcttgaaaactcgcggctagatcttctcgactgagctcttggcctaactgatgggcgtgatgaaccgtgttgataacagccgatttcaagccactgaagctaaagtcaagattgtcttctttatccatcgcccgtggaaaatggaaagtgtcttgaccaagatgtgccaaccgatcaacttctttaccagccggatatggaatgcccagaatccgaccaactttatcgtaagcctcaccggcggcatcatcacgtgtatcgccgatgatttcgaattccccagctgatcgcatataaaccaactcagtatgaccgcctgaaaccgccagtgccagtaatggatacgcaagcggcttcacaaaacgggcggcataaatgtggcctgccatgtgattaaccggaattaatggtaaatgatgagcgtaggcaatggttttggcagccgtcaccccaattaacaatgcgcctaccagccctgggccgtatgtgactgccaccgcggtcaaatcatcataagtgacgcccgcttctttcaacgctgcatctgtaaccaacgtaatttgttccacatgatgacgactggctacctccggaacaacaccgccaaatcgttgatgacttttaatttgtgtggcgatgatgttcgataagattgtgtcaccattttcaacgacagccacactggtttcgtcgcagctgctttcaaacgctaaaattaattcccttgctgccacattgttctcctctacaacgacgataatgatcgattacggcaatggccgatacatatcaagtgcatcatcgtgattgctgacataataaccttttttaattttcccgtcctgaaaaccgagcgaccgatacagatgcttagcaatgtcgttattcgtccgcacttcaagcgtcattttttgactgccataatcaatcgcccggccaatcatgaactgcatcaaaaaacgtcccagacccatgtgctggtatgctgggtccaccgcgatgttggtcacatgggcctcacttaaggtaaaccaggtgccaattaatgcgactaactgaccggcatcttcaacagccaaatacaacgaatgccgaactttacgcaactcagagaaaaaagcgtaacgatcccatggtgtatcatgataaatccgtcgctcaatcgctaatgctgcatcgacatcgtcttctgtcatacgccgcagtaaatactctttattgcgaaccgtgatcgtttgtggcttaaagctcaattcatcaggtgtcgtgcgatcgaaccacgatttaaactttctcaacataaacatcatgtcctctgccggggtgtgcttccaaccagttgtgttccgcctcggtcagccgcagataacgcggcacaaaatcataaacagacacaggcggcagatctttccctaattgtcctaaacgtaatgcttgtggcaagtttagccaactcggtgcaaattgcgctaatccgcccaaggtctcaataatctgagcccgaaacatagccgcatcactgccgacaaagatcaccggctggtgcaaagtggctaattcagtgagcagtagttttaatggcacgtgccgatctgtaaccacattgatcagccggcccttgttccattggtagacacctgtaaacacattgttgcggcgcgcattcataattggcacaatcatcgcttttgtatctgtgatgttggcggcaagcaccgccagactggaaacgccagctagggcaatgtttaatgtgtaagctaatgttttccctgtcgtcacggcaattcgaatgccagtataggatcccggtccatctgcgacaataatcttatccaagtcctccggctgcaggccactagcagccactaaatcatcaatcgctggcagtagttgctcactatgcgtccgttttcgattaatcgtcgtctgcgccaacaacttatcattatctaacacagcaactgacatcgcttcgtttgaagtatcaagcgctaataatcgcatcaatagaccctcccttctcatggcataatcatggcaatattctatcacaaataagagcagagcgtgagctggcgcgtttagaaacctccgagctgaacgataactgtttttccttcattccctgagttacttacacacaagcctctgagcctctggtaccaattctattctacgctttggggtttccggtactccgagttggctccgcggcgattcggggtggcgaccgcgaagctagagtggtgggactttcgtgatgctttaattgaaaaagaaaagcaaaccttacaacaggaagtagcgccaagagtccttgtcattgatagcaatttgctataaccacgcataagaagaggccaaataggaggcttaaacaaatgaaaatgatggtaaaaacgggtgggatcattttagtgtcagggttacttttagccggatgtgggtgtcaaacgtttaccatctccacagagtcctaactgttacctaatgcagtcgggactttttcgttgctgtaaaggcacaaatggctttaatatgatcaaaaggaggcgtgcacaatgcttacaacagtttggaatttactaacgattgttttagtattgatcatcatttggttaacccgtaagcagaaagtcaccacgcgattggggcggtacaatcgaacttttatgatcattgttgcggtgatccaaattattctgatcattgcgggaatgctgattatgaaggattcaatttcactgcaagctgcattatttatttgtagcttattgctactgataagccttttgctcgactataaaatgcactgattaacagcaaaaaagtgccatcactttcttggttcacacaagaaaagtgatggcactttttgaatggaggaaagatgacagtcaacaaaaataatcaacgctaccaaatcaccttgacgccagaagagaagcagcagcttaaagcactttgtcaggttactaaggaacgaccctcaacattggtgcgtcggttgattgctactgagaaaagactttatgattcaggctttttaccgtcctacaattcaaaaattgaaaagtgaggagagattaaggtgttgtggctgattctcaaatgcagtttctggatattactaggctttatctttttgtgtgagcttacaactattcggattagcggattgtgttctcgtgaagaggaacgacaggaagctcttgaaaagcatcgtcaacaagcaaaaagcgcgccctagggcgcgtttttattaggtattaacgtaccttcattttaccaaagttgtgctctgctacgcaatttaatggtgtgtcacgggacaacaaatgccgctactgggaatcgtggttcgattccacgaagcggccttggctaatgccaaaataatgaacgccaaatgccagctaattgcaggtgttttttgcgttaaagagttggcatgtaaaaattccttccttttgagagacgatttattcattataccctcccttaaaagttgtctcaggaatcagcttacatccaggagcgtgatatgattatcgagcgtacgcaagccggtaaaatatttgcaaggcaacacaatcccaactataaggagggtagacccaaaagaaaaaagatagccggaatatggctatctttgaatattctaactctcatactgtgaaggaagccgctgaagctattaaattattgaaaggaatcagccttttaaaaagtcaacaaagaaattctgctttaaatcatattagggtatcacaaatactttacaaatatgttttgcgtcgcatcaaaaaccagcaaattagacttagtgtagcagagataatcaatacggctaaaacaccataagaagacttttcaaacgggacatggacattgattccccaaaagccaaaaataattgctggaatagtcaaaacaattgatatctcggttagggttttcataatcatgtttagctgatacgaaatcatattgtttatcatattttccaaactttccaaatattggctgtaacctaaaatgattctatccattgtatcacttgtatcgtataactcatcaattatttttttagtactaaaatcaatatcgtcaatagttatgaaattttttttaatgaaatcaagcgctttatggttagctttataagttgttgacaaagctatcatgtatttttgaagagtcaataaatcaccaaacgttggtctgagtgaaccggacgttgatatttctgagtctaaatcatcaatcttttccttgactccacgaaggtcgttaagcatcacatagaaatctttttgcatgatctttaaaagtacttcctccacgaaatgattgacatcacgtaaaaccatattggataagagctcgggaatgaattttaatttttgttttgtaaaaattatcaacttatttttaaataccaagaaaacaacagatgtcgtcagattatctagatgcccaccttcttgtaccttgggaaacaaaaaacttacgagcaaacttttttcatcgttctgatctatcatcgtgtcatatgcgacttgatcatcaaacgttagtatattgcctattttaaagtcatatttatgttcagaagattcgatatattctcgttcgtcaccataaacataaacaacagaagaatttttgatatttgattctgacgaaactaataatgtatcttttgttaaggaataagttttcagcattgtaatcctcctgctttatatttttctcaaaaataaatgcgtaattgttgtggaataaatacgttatcagttttaaaaacattttgtcttatgtatgataacctgccaaaaattttatctcacacattatctagacaatcttgtctccagcttctaatgtattatctaatttataatggctctttgtcaaccgctgttgatgagaaatctttatgagaacatggtagattgtaaaattaatccgaacgctgttcggacaaaaaagatcagcttcgagggtataatgaataaatcgtctctcaaaaggaaggaatttttacatgccaactcgttacgacaaagaattcaaacaaaacattatcaacctatataagcaaggcgaatcagctgctcaactggccagagaatatggcattggctattcaacagttcataagtggatccagggccaggccaaaactcaatccggtaaatcgccagacgaaatcaaagcgatggaaaagcgactggcttcgctgtctgaggagaacgaaatcctaaaaaaagccctgggcttccttgcgcagaagtaaccaatatctttgattacattcaccaagaaagccatcaccaccaggtaaccaagatgtgccgaatcctcggtgtttccagagctcagtattatcgttatcgatccccaaaccttcaaaacgccgggccgaagatgcgggcttgtaacaacggattctgcggatctttgcggaatttaagcagcgatacggtgttatgaagatccaccatgaattgaatctggaacttcaaccactgcagcttcggtgcagtccacgacggatttcccggctcatgaaggaactggatatccactccgttaccgtcaataagtggaaagcggcttcggcttccaaaaccaaggttgaacagcgtcccaacttgcttaagcaggatttctcgaccactggtttaaatcaaaaatggaccgctgatatgacctatattcaaacgaagcgtaatggctggtgttacttatcaaccatcatggacctgcactcacgacggattatcggctattcgttctcaaaaaagatggatactgatttagtcttaaagacccttgaaagcgcggttaaaaatcgaaccattactggggacctgattatccatacggatttaggatcacagtataccagcgatgattacaatcaacgtttaactgaactacatatccgccactcatacagccgtaagggttgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaattcatagttcactgggctaccagacccccttacaagttgaaattgcaacacttacgagccaaatggccgcctgatttaatgctttccagggttcaaataagttattaatcgcaattaatgatttatttgagctgtggaaggtaaacgcggttctgaatgtctcttaaaatctgtctcaatggcagctggctgttcaaaaagattgccttagatccattgcgttctgatattcaaatgctttcagagacaattaatcgtcagctaaaactgcatgaacaatcgctggcagacttgaatgctcatctgaaaacacacgatgacgagcttggcagtcactcggtaagaatcactcgattagaagctaacgtaggcattaaaggagaagataaccatgaagattaattggaaagtacgagtattaagcgtcaaattctggctggccattgtgccagcttctttgttggtgattcaaacggtggcggcagtcttcggttacaactgggattttgctagtttgggtaaggagctcactgcagtggtcaatgcagtgtttgcattattgaccattgtcggggtagccgttgatccaaccacagagggtgtcggtgacagccagcaggcgttagcttacccggcactcatcactaccaaggcggctaagatcaaggcgctagaggatcagattaaggcgctgcaagcggataaagcggctgaccaggcagcttctgctgctagtgaagtggttccagagacgtcttctgcagcaccggcggagtcagctccggaatctgttgctccagtagctagtgaggaggcaaaatagtatgagttataccatcaacaaagaatttgctttgggtgcaaatgaaggctcatcgcaagtagctaatcgactttacattatcctgcatgatgtaggtgccgaatctggtgcgcgtgcaaatgccgcttacttcaaaaacaatattgctgctgaaattgcttatacggcatttgttgtgggcgatggcggtcaggtttatcaagttggtgaacctggttatgttcagcggggcgctgggacagtggcaaatgctaacagcccggtccaaattgaattgggccacactcgtgatcccgaaactttcaagaaggattatgccgtttatattgagcttgcacgtgatatggctgctcaatatggcattccgactagtttggatgctggcggtgctggaacacctggcatcaagtctcatttgtgggtaacacagcatatttggggtgatcacactgatccttatggttatctagcacgttggggcattacaaaggagaagctggcggccgaccttgctaatgggacaactaccgtagatgcatctaagagcgcaccagcagcacaaagcgcgcgtccacaagcaattgtaactagaaatgtcaacgtggcctacggtctgcatctgctcggtgtccgttggcttgatgaggtgaccaacttcggatctggtgacaatggttttgctggtatgcctaattataagcatgatctgctgtacatcaaagttgatcatggtagcgttaagtatcgcgtccacacagttcaaagtggttggctgccttgggtagccaaaggtgatcgcaatgatacggtcaacggctgtgccggtaatgctggcgaagtgattgatggagtccagatcatctttcttactcctactggtgagccatacaaacaagcgtattaccgcagtcagacgacacaacgggctggctggctcggcgttgtatgtgatgatggcacgagtttgccacagtacacagacacatatgccggcttgtttggagaaccgcttgatcgtttgcagatcggcattagttcgatcaatccattttaagtacattacaaaaagtcctctgctcgctaacgcgggtggagggcttatttttgtgcataaattacatagttgcaaaacacaagaagaattgtaaaatcgctgcaacaatgcgattatgacattcaaaatggtacttttagcgcaaataatctagttattttaattgcactttattttgagaaattttaattgagaccaaattgagaccaagaacgttataaacactgatactataggcatatattgttcctgttcgcggcattctcgtgatttttaacggcggttaaaaatcgaaatgcccgtgtaacaacgttttagcctttctaattgatgttaggggggctatttttgtgtgcaaaatgtgaacaagcaatgacttatgccttgatgcaagtcatcaggtctggaagctgtgttatattcgtcatgaggcgactgagcaagcggcaaggtgaatgaggagtataaacatgatgtggcctgaaatgaagcacgatcaatagttgaaagggatgatcgctggatgatttattttcttgatgaatacttacttgcaaagaactcaagtgttgaacatgctgcgttgaaacgactggctttgttcaaacaatttaagcaaccagttaagattctcacgcgtgattacgatcgtttgagtgtccaaaccttgcgcgagcttggcgttgctcagacggatgtgcgcaacatgttcgactattttcagcatgtgcccgccgaccgaccggaaaaagctgtgcataatgatgagatcaatttgccgacaatggatgaagtttcagtcgatgctaaccaaagtcaggtcacgaacggcgaccggctgcgacggcaggtcggttatattccaggaaccgtcggccatgtttattatcaaaactttttggacgatcaaggcaatcttgtggaatgcgatctttgggacgcccgagggtttaaatcggccactcagtattttggacaggatggcttgttagcctttgaacgctactatgatcttcgaggtataccagtgctcgacatttattatgctggtcagattcagatcagccggattgttttaaaaggccaaacccttaaagaagatcatgaatttgatacattgggagagttgtttagctattttcttgatcaacttgcgactgaagattcagaaacaacgatttttatcagtgatcgtccggggattggcgttcaaccgctactagcaatgcatgcggccgcaaagaagtttgtttacatacccattaatcatgttttaacacctgacaaaccgcggcaaggcgaacttgatggttttattcaacctgtgctgcagcatccccaaaaagtagatggcttaattgtacaaacgccgcagcagcaacatgatcttcatgatcgttttccgaaagttcgggtggcggcgattccagcggtgacatttgatccggctttgacagcgcgttcggcggccgccgctgcaagcaagaaaatcctgtttgtgggtcggctgtcgcctgataagcaacttgatcagctacttcgggcagttgctttggcgagtcggcaggtgtctggcgtgacacttgatttgtttggttacggtgatgaacaatatcaaaccgcgatgaggcagcttgcggatcgtttagagattggcagtcaagtggcatttaagggttaccagtcatctctggctgatcagtacccgcaatatgccttgttggtcaatacgaatttgacagatggtggtccgttggcgttggttgaagcacaaacccatggactgccagtggtgagttatcgcttttcctatggacctagtgcctgtgtgattgatcaggaaaccggttatcttatcaagcaaggacgcgtcaatgaccttgctgaagcgattgtgagactgctaaagcggccagagcagtcacaacaattcggcgatcatgccagagcactggcgcaaaagcagctagcgcctgaaaaagtctacgcccgctggcaagcatttcttggactggacagttaacccgacaaaacggcaaggaggttcaggatgtattattttttaaatgatcaaatggcctatgccaagtctggtattgaaggcgcggaaattcagcggttgcagcttttcaaagcgaaccagacgccagcaaagattgttacccggcaatttgctttagatctacacgatgttttgaaagatgcaggcattgacgatactgattttatcaatctgtttgattacttttgcgacctgctgagcacaccgtggcagcaggtaacggttgcagacgtttgccaaccgactgcgggcgtgacccgccggcgtgaagggcggcaggtgatcttcagccgcggttcacgagtcattcgaattgtttatttgcgcgaaaaggcggggcatgagcaagaggttagcaatgttcaatactttgacgtgaccggccgaacgatcaaaatgagttggtgggacacgcgaggcaaccattgtttggatcagtattttgatcaaggcggcaaaatcttccaagaacactatttggatcgtcatggtcgcacgcggcttgaaaaactgcattatttaaatcatagccagcaagaaaaattttcgtggaaattggttgattttcatggtgtggattatctatttgatgggcttcatgatttgacaaggttcttctatgatcaactgaatcaggtagatggcggctataatgtcttcgtgtgcgatcggacgacggaaactggctggggcttgttgcacatgacgacaccggcgctcaaagttttacatctgcataataaccatgttgccgggaatgaggacgtgctgcatgcgaagctgaataatttttatgctagtgccttgacccatttgaatcgctgggacgctgtgattgtgccgacaccgcagcaggcgcaggatatggctgaccggtttggcatggccacgccgattttcacgattcgagttgcttttgttaaggcggcagatgtagcggctaatcgcctcccgttttcacaacgcgaacaacatctggtggtgcatgttgcgcgattggcaccggaaaaacagcaggcaagttcaattcgggcatttgcccaagttgtgaaggccattccggatgctaaacttgaactctggggttatgccaatggtgatatggcgccgaaactacatgctctggttgaaaagctgcatctcgcggatcacgttttctttaagggttatactcgcgacatagcggccgtctacaatcgcgcacagttaggactgttgccttccagtgccgaaggatttccgctaaccttgatcgaagcacaggcgcacggattaccgatgatcgcaaatgacattcactatgggccagccgatattttggccaacggtaaaagcgggcttttgacgcaaaatggtgacattgatggtttagcaaatgcgatcattgggttattgaatgattcaactaagctggcccagtttagcgcggctgcctatgacaatgctttgcgattcactgatacgagcacatttgttcagtggcagaaactcatggcgtttgcggcaaagaaaaagacaaggctggcgacctttgagcatgttgattaggcaccggtcatggcaatgagtggcgtttttactgacatctgttcaaaaaatggtagtaagcttttaccaagaaatggaggctaaccaatgtcaatttatgattatgaggtcacattagaagatggctcgcaatatgctttgagcaaatacaagggtcgaccaatgttgatcgtgaacactgccactaaatgcggcttcgcgcctcagtttgatggtttggagaaattgtatgacaagttcaaggatcaaggtttggtagtgctaggttttccttctgatcaatttaaacaggaactggctgatggtcatgcagcggccgaggcttgccggttgaaatacggtgtgagttttccaatgcatgatttgattaaggtgaacggcaaagaagcagctccgctgtttcaataccttaaaacccaagcccatggtgaactaggcaagtccatcaaatggaactttacgaagtttttggttgatcgtgatggtcaagttgtcgcgcgctttgcaccaaaaacaaaaccagaagcgattgaaccagcagtggagaagcttcttggctaacttttgtcagttgcacgtggggctggttcacgctctgttttaaacgcgtttgccacccagagacctgcgtgtaaggaccttgggtgcaatgaccaaagcccggccatcatacccaaggccgcttacactccggtctctcccgggctggttcacgctctgttttaaaacgcgttcgcaggcccagaaacctgcacataaggacctcggacataaatggccaaaatccagccatttatgtccgaggccacttatgttccggtttctaaccgggcctgctcacgctctggacactcatgcatgtgatgcgtacaatgacatcaaaagtaagaaagcagggatgattgatggaagaattgccagctgatgtagcggcttttgttgaaacacatttggttgatcgtcgcaatagtaacgccgtgaagtgggatgttttggcaggtgaatttggccgcacggacctcctgccgatgtggattgccgataccgaatttaaagcacctcaggcggtgattgacgccttaaccgctcgcattcaagaaggaacttttggctattccattcggccacaatcctactatgatgccttcattgattgggaaaagactcgccatggcgtgacggtgcagccggaatggatgcgttttggtgtcggtgtggttaaatcgctgtatgccatggtcaattggctgaccgaacccggcgatccagttttaatcatgcagcctgtctattatcccttcatgaatgcgattaaggatcttggtcgcaaagtggtctcggttgatcttcaattaactgctgatggctggcggatagattttgatcaattggagaaaacgctggcgatgcaaaacattaaagccatgattttttgctcgccacataatccggtcggtcgagtttggacccgtgaagaactggaacggctttttgcgatcacgagtcaccatgatgtcacggtggtatctgatgagattcacggcgatttggaagttagtgggccaaaattcacctctgctttgcaagtagctgagggtccggcacgcagtcggcttgtcgtcctgaatgcaccgtcgaagacctttaatcttgcggctttactgaattcgcatattattattccggatgaaaagttgcgcacagcttatgatgatttcatcaaacagttgcatccagtagacaccagccttttgggacaggtcgccggtgaggcagcttatcgtcacggtggcgcgtggttagacaaggtgcttcaagttgtccgatataactaccaacagttgctaaccggtctgaagcagagcgctccgaaggctacagttgcggacttgcagggcacctatcttgcctatgtggatattggtgcctatgttgcgccagcaaaaattaaatcatttgttgaagatgtttgcggactggcagttgattacggcgcatggttctccccaaaaacagctacgtatattcgcttgaacttagccagcgaccccaaacttgttgccgaggcgattcagcgtttaactgagcacttggctcagccgcaattttaattgaaacagaacaaaacaccctgttaacgcaaggcatgttgactcattaccaaacatacaaggttcggtgctgagacagcgacgcttgctgatggcagggtgtttttgtgtgagtagtcttagttaacagtcactaagggtgattgatgattaaatgattatcattcatattatgatcctgtacgatttctttaagatatcgccgcagcattggtgagcgttccaaaacggcccaacccggatcggcttttaatcgcttgagttcagctttatcgggatgatcatcgcctgtgaaaaagcaccagttcaagacgcccatcagttttgcggcagcatccaaatcatgctgattcgtcacgccattatccatgagatccccatatgcaaggccttcgccatcttggagaaagagttgcttcagataccgttgataatgtagcagatcaggattttttcgttgcttggcggttaagtaaggtgtgggatcagtcgcatgcttttgataggtgattcggttaggcgtgaacgtcaccaccccataactggcagggctgatcgaaaatgcgccgctgacaacttcaatcgttggacattgcccatccggatcgcggctgatgtcttgcgcatggatgtgtccggaaaaaagcaacggaacatggtaagctttcagcaacgttttgagttgatcgctgttgtccaaaacaaatccttgattcaccgcttcattgtgggcatatagattgtggtgcatgaaaacaatcgacttgcgatgggccttttgaccagcagctaattgctggcgaacccatttcatggtctgcggtgtgagcttaccaccagtgttcggggggcgattggaaggttcgatcgtataaatattgctgtccagcatcagcaattgataattgcggttaaggttgacgcgatagctcaaactattcggatcctgcgcaactgcctgctcataactggtatgaaaaatattgcgccaatcgctagggctgatttgttctgtcagtagttgtcgtttgcccttgtaggctcgtgcccaaccatcgtaaatatcatgattgccagggatgatcaacaccttcgtaccattggcaacaagtggttgtaggcggcgcatgatactttcggcactggctttttcgccgttgaacgtgacatcaccggtgatgacgagggctgtcgggcgggcttttaaggcgttttgaaccaaagcattaatagcaacgggctgatagtccatatcttttcctgctgcagaacgtttgatttgggtataagcagtcttttcatcatgtagacttggggcaataaagtgggtatcgctgagcacccaaatggttgcctgtgaactattggtgagtgggcgatcacgatccgggtgaatttgccccaagacgattgcaaagatcagcattaaaaataacgctgctacatatttgactgctttcattttctgcctccgtacctagtttaccattgatcaaggtaacaccagcaggtcattttgagtgggtgtcaaaaattttttttgatgattaacttgttggtgacttaaaaacgttactgaccgagagcgggattatggtaaaataaagccacatttgaccacgatagcgtttagagagaggacatatacacctatgcaagtaatcgtaacggttatcggtaccgacaaagttgggatcatcgcacaagtaaccaccgctttagcagatttagatgttaatattttggatgtttcacagactatcatgcaaggtgcatttacgatgatgctgctagctaaaattccagataatggcaatttcaatacggtaaaaagtcaattggcgaccttgggtgatcaaattggcgttgagatcaaagtagcccgtcaagagatttttgatgccatgcatcggctttaatatgcgttggatcggcaatcgtacttatcagagctaaaggagccagtgatggaaactcaacaaattaaagaaaccattgaaatgatcagtgaagagaatctggatatccgaacgattaccatggggatttccttgttggattgtgtaactggtgacctgcaaaccacagccgacaaagtatatgccaaaattatggcaaaagctgccaatctggtgccggtagctgacgccattagcgacgaatacggaattccaattgtcaacaaacgtattagcgtgaccccggtcagcttgctagctggcgcggatcaaaacctcgattttcgcccgattgcccaagcgatggatcgagctgcaaaagatttaggtgtggatttaattgggggctataccgctctcgttcaaaacggtagtacgccagcagaaactgcattgatgaagagtttgccggaggtgttagacaccacggaacgcgtttgtgcgtccgtgaacatcggcagtacacgcagcggtttgaacatggacgctgttaagttgatgggcacggtcgtcaaagaggttgccatgcgcaagccgcagaatgcgatgaaactggtggtattctgcaatgctgttgaagacaatccgtttatggcaggtgctttttgggggatttcagaaggtgatgttgccatcaacacaggtgtttccggtcccggggttgtagaacgggcgatcgcggccaaaccggcggcaagttttgaagagatctgtgaaacgattaaacaaaccgcctttaaagtgtcacggatgggccaatttgtcggtaaagttgctgcggatcgccttgatgtaccgtttaacattgttgacctcagtttggcaccaacaccggcaaaaggtgactcagtggcgcaaattctggaaacaatgggactcagtcatgttggcacaccaggcacaacggcagcgttggcgttgctaaacgatgcagtcaaaaaaggcggcatcatggcggctgaacgtgtcggcggattatcaggtgccttcattccggtttctgaggatgctaatatgatcaccgcagcggccaagggtcaaatcagtctggaaaaactagaagcgatgacggcggtttgttcggttggcttggatatggttgcggtgcctggcgacactcctgacgccacgattagcggcatgattgccgacgaggctgctatcgggatgattaacaacaagacgacggcagtcagagtgattccagttcctggtaagcaggtgggcgacaccgttgaattcggcggtattttcggtactgcgccgatcatggcaattaacgatggcgatgcgcagcagtttattaatcgtggtggccgtatcccagccccgatccatagctttaagaactaacgcgtctcatttttaaacgatccgacttaggccttgttgttgctggtaattgccagtagcagcagggctttttggttgcggtgcgtaatgttttgatgaggtgaatcgtatgttcgtagccctagataaaaacaatcaacgtgtcacattgacaagtcatgcccaggcggccaatttaacacaccaaacctttcactgtcctatttgcaagcaggtcgttcgcatcaaaaacggaaccgtaatgcctgcccattttgctcaccgaagtcaaccaatgggtgagggtgaaccagagagtatagagcacctaactggcaaatggtggttggcgtcttggctcaaacagcatggcgaacaggcaacgttggaatactatgatgcaaccattcgccagcgcgcagatcttttggttgcaagtaaaacgccgagggtattggaatttcaagcaagcccgctaagcgtgccagatctgcaaaaacggacaatgatgtatcatgcgcgtggttggcaagtaacatgggtattgggtcatcgatactggcatcctgaaggcaagatacaagcacgaaagtttttgagcatcgaagatcatcggctaactttgtggcatttacagacaacggttggtgagttggtacggattcagtttggaaatgaaggccgttggctaacgcgctttcagcatgatgatccgccaactcaaacttggcaggcagaatcgacttatccgcaacgacaaattcggcagattgccatcagtttacaaaagcgggtgcaaccgtggatgacgctgcaagcagctgcttatcaacagggccgcaatttgaatggctccccatggttcgttcacagtcggccccatgtgttacggcattttggtattccggaactccaactgcgactcaaatggctgttgatctttgaaggacagccttttaccgcgactgccaaccgtcaattttggcaagcggccctgccgaatatctggacgcctttgttgccagctggcacgctcgggaaaatgatggctgcccactggctgcaagtgttgctggcagaaggcttcgttgttcaggaagatggttgtcgttatcagtggcagcgtttgcctgtttggtttgccgatcttgagcgaaaattggccatgaaaaaagactttgcttaaggcaaagtctgatgaggctgattgcttatcatgattcgcaaggtgggaaaatgtgacggtttgtgcgcttatggaaacgtgtttgtagacccagaaatcggcatgtaaggacgctgaacacaatgcctgaagaccggtcatcacttcaggccactgataggccggtttctagccgagtctgttcacgctctaaaaaattctaaagttactccccatgttttcgggccgttcggtgaagaaaccggcgggatctgttcggatgagatcgcaaagatgtgggatgagtgccgggtcaccgatttgttcgatcaaaacagcatggccgtcatctactttgcgatcggtgtcaacaatgacaagggaaggcgtttgagtgatacccatttggttagcagttcgttgatcggagtcaaagcccattttaacttcggaacgctgacgatcttcataaaacatttcctgatccagcttacatttgtcgagcatctttgccacaaaggccgcatcatattggtatcgaaccagaggtgcgtgttgttgtagccgcaacaagagcatccgtgcttttttgttgccttgatattgtgcagccttataatccaacgcaaggttgtaagctgcacggagcaactggttgcgtttagcaagattacctacgctcagttgctcacgtttcataaattgttccatgatatctaaattaagaaagggaacaaagtggacgcgcacttcctgctggaatttatccaattgtctgagtaatttctgttcagtgcccagacagacgctcccgattggattgaaaaaaaggaaaatttctatcacgttaacggcctccaattcgccaacaacaaattcttacatttactttatcagaaaatgagcagggtacaattaatcagcttgtgaatcgtgcacatgcatgaatgcgcgctgaactttgttgataactggccttttttcaatgttgaattggtgcaacaaagtatcgtagaaagcttgagcttgtggcagatcatggtactccatttccaactcaaaatcagaggtgttgtccatgtaaaaagtctgatcgagtgtcaacaaacctgctttaagatgcgctacacggcgggtcgtttttgcttgggtttgcggatgaaccgctgcggggtcaatttcacgggctgctagtgccgttgtgacttgaccggttttaagttgaccttggtcaattaaggagcgggcttcaactgaagtcagcggatcggtaatttcttccaaatcacgatgttgattcttattaggaacttttaaggtttgttccgcacgatctttaaactgacgaatgcgtaagcctaggcctgcctttttgacggcgccagtcggtgtatcgtaataggtattcatttgactgaagcccggctcaaaatcaaactgattgagaatcgctagaaaatcagtctttgttaaagttgttttaaattcctgttcgcgagaaattgacatgaactgcctccaaagacaaagggcaacggtgacgagacaaaaatatgatagaatggtggtcgtgagtgacttggctggcaagaaagctacgggttgccgtacttcttaaccagtctggctggaatatagccgtcgtttgtcggccaagcctcacacaacgtatcatcagtagtttagtatgggagggccagcaatgcaaagggactgggatagtttcttaatgccgtatgaacaagcagtcggggaattgaaaattaaatttcgcggtatgcgtaaacaatttcaacaggccaatgaacacacacccatcgaatttgtgacggggcgggttaaaccggtcagttcgattattgaaaaacaaagtcggcgttttatcagtgacgaacttttggaacaggatatgcaggacattgctggtctgcgaatcatgtgtcagtttgttgaagacatttatcaagtcgtggcactccttcgtcaacgcacagacatgaacatcgtggaagaacgcgattacgtgaccaacgtgaagccttctggttaccgcagttatcatgtggtgattgaatatccagtgcaactcatccatggtgaaaaaaagattttggcggaagtccagattcgaaccatgtccatgaacttctgggcaacgattgagcacagcctgaattacaaatataatggcgaatttccagatactttgaaggcgcggctcaagcgggcagcggaggcttcctttatgttggataaagagatgtcagatattcgtgaagaaattcaagaagcccagcatctgtttgtttatggtaaagggcaacagccacattcgaaaacaaaggatcaccatgacgataaaaaggatgagtaagatgcgtgtgacagttttccataatagcatacctgcctcaatcacggctgcccaaaagctgacgaagcttttgaagagcggtcactttgagcttgatgagcggcatcccgaggtggtcgttaccatcggcggtgatggtacgctcctttcggcctttcatcgctatgcggatcagttaaactcaattcgcttcatcggtgtgcatacaggccatttgggtttttacacagactggcgggattttgaaattgaagatttagttatcgccttaaaagaagactctggacaaagcgttagctacccacttttggatgttcaggcgacttatgcagacgcgaccagtgctcattatctagcattgaatgagtcaaccttgaagcgtttaaacggtactatgcggacggaagtctatatcaaaggcgatttctttgagagcttccgcggggatggtttgtgtgtgtcgacgccaactggatccacagcttacagtaagtctaacggcggtgctgtgattcatccgcgattggatgcgttgcaaatgaccgaaattgcgtccattaataatcgggtttttcgtaccctcagttcgccgattatcacggcaccagacgagtgggtgacattggagccgacaggtcgcgatgattatgtcatgactgtggatcagttcgtcatcaatccaccaacaatcaaacaaattcggtataaaattgcgaaagaacggattcattttgcacgctaccggcatatgcatttttgggatcgtgttgaagacgcctttatcggagccaaacactgatgcgatttgaatggcagtatgagggaccgccgctgaaattggcggcttttttaaaacaacagggtttttcccgtgcacagcttaagaaacttcgttatcaaggcggatttgtttttgtcaacaaacggcaacggcataccgcttatccggtgcgctcgggggacagaattttggtacagacagcacctgagcacgcggcagacagtgtggtgccttattcgcatgatttggccatcagttacgaggatgacgattatctgatagtgaataaaccagccggggtggcatctattccagcggttggacgccaaaataatagcatggcgaatatggtcaaggcttatttaattaaaaccaaggctgaaagtcaggccgttcatgtggtgacacggttggatcgcgacaccagcgggttgatggtctttgccaagcatgggttggcgcacagcttgttggatcagcaattgcacagtcaagactttgtcaaacagtatgtggcaattgtgaccgcacaaacacctttagcaactcatggttggatcgtattgcccattggcgtcagtgacggcttttatatgcgtcgtgttgtaaccgatactggcaaagcttctgtcacggagtatcgaacacttgaccaaaatacggctggggccatgatgcttgtcacgttgcataccgggcggactcatcaaattcgggttcattttgccgcgattggtcatgcgttgtatggtgatggcttatacagtcctgatacgcacggctttaatcgacaagcacttcattgtgcccatttgcgtttctggcagccgttgaggcataaactgattgatttacatgcaccacttccggctgatatggcgacgttagcggcgaagttgaaattatcgcagcaagattgagccgccgcacaaatttaaacaaggtatgacaaaaaccagttcccgaaaattaggaactggcttttaacatactatgattcaggaacataattagcggctccaagcgaactagaagttgcccttgtgataacctgaatcggcatcaaacttgaattgctttttgaggccattggttaaatagatcttcttgtcattggtaatgaaaattgcttgaatatgatcgctgtttttggcattcatgtattgcagaccgccttttaatcccttatcaaaggcagcattggataaggcatcgccatcaacactatttttcgagacaatcgtgactgaggccaagttgttgtcatagggatagccagtctgaggatcgaaaagataaatgtatttatggccattggagattaggtattgctcataggtgccagctgtcacaatggattcgttgctttcaggaatcgtacccactgcagtgccacgcggcgcggtcgggtcttgaatcccaacatgccaatcgcgattggtaccaagcggtgagtgacccatgacaacgacattaccgccaagatcaataatcgctgctgtgacgccatctttggcgagcacggccttcactttgtcagcaacccagcccttggcaatcccgccaaaatcaagccgcattccctttttggtcagataagcggtattatttttggtatcgagtttgacatcgcgccagttgaccagtggcaaggccttgtcgatctcactttgtgccgggacgcgcgcgccaggcaggccaatttgccacagattggtgacggctccaatggccatgtcgaaactgccattggagttttttgaaaagtagtaggctttttcaagtaagggcataaaatctttaggcactttgaccggcttgattccggcattatcgttgatcttatccaaaaccgaaccgccgcgggttaaagttgcctcggcgtcgacgtgatgaatcatggcaaatccgtcttttaaggcggattttttacctttatcataaattgtcaaagtacaagtggtgcccatgacaaattcattttgtgtgtatggggttttcaagtaagttggactggctgttttttgacagccggacaaagttagaaaaccaataaaagcaagtaaaccgatgacgaattttcgcatgttacataaccctcatttcatctttccctttgaatatcataccgcgcgttatggaaaaagaaagccctggttgtcgctcgtcaaacgtacggcagcaaaaaaggctagttatccaggcggttgcacgcataactagcctttccgtggcgtggtttattagaacgcgattagttttgtaccatgtaaagctttcacacctaatgtctcaccaattgaagcagcgttttgactggtgatcccgccgcctggcaagatgctgattttatcacctgcatagttgatgatggcttgcaggcgcggcaaagtgtcggtgatgggggtggtcaaaggaccgccgtgggtcaagatacgctcgacatcatgatcggccaaccaatcaattgcggcaaattgcttggtttctgggatggcatcgaaagccatatggaaaacaacggtcatgccagcactggcagcaatgaggctggtcatcgcgtcttcatcaattgcgccagctggtgtcaaagcaccaaaggcaacgccatccacgccaagcgcctgtgcctcaaaaagatcagcttccatgatttttaattcaacatcgttataaacaaagttaccgccacgtggacgaatcatggtgatgaggctacggccatgttcatgaacatattttgtactctctgccataacgcccttagacacagttgtgccaccaaccgctaaattgtcattgagctcaatccgatcagccccggccgcgattgctttaggaatcgatgtataattttcaactgcaatttcttttaacatgacggacctccatttactagcttagataaacatgaccaataagacaatcgcacctaaagcgattcggtaccagccaaacggtttgaagtcatgcgtttgaacaaatttcaacagccacttgatggcaacgatggcgacgaggaaagaaacaatggaacctgtcatcaaaacagcccattgttcaccagagaagccgttgccttgccacaggtatttgccgattttaagaatcgacacgccaaccatggtcggtattgccagaaagaaggaaaattcggtggcaacgtagcgagaagtcccaattagtaaggcgcctaaaattgtggcgccagatcgtgatgtaccagggacgatagacaagacttggaaaagaccaatcagtaaggcggtttgataagtgatgtctgccagagtggtgatatgcgcgtttttattcttgaggtagttttctagaatgatgaacagcaccccataaatgatcagggttgttgcgactacgagtggtgtatgtaaatgttcatccatccagttgttaagcgggaggccaacaacgactgacggcagaactgcaatgataacttttgcccacagttgccaagttgcgttgcgggctttggctgtcggcttagaaaagggattcagcttattgaaataaagcaatatgacggcgagaatagcgccaaactgaatcacgtactcgaacatattaatgaaatcctgactctgcgataatttaatgacgtggtttaccagatcaatatggccggttgaactaatcggcagaaactccgttaacccttcaacgataccgatgatcacggccttgataatgtcaaacataataaccctccaattctcaatgttaacagtatacaaggttttgcaaggcttgccacgttcaactcggaatttatagtcatcttacgtaattcagcaacttttttgggaggacgaattgtcaactcaagtgcaactttttacccatgaagacttctgatggcgtctaatgcatatattagcttaactgcctgaattatagaatttttaagcagccactaactaagctgttactttttcaataaacacagtttatcaaccgctttaatcggccccgaacgcgccatacccctaaccataacaaaatagctccgcaaagcaagtctccggctagaagactcacctcgcggaactactgtaacgtgatgccgttcagtctcgaacagctcgtgtcaattgattatgatcgcttgcgccgccgcaggatcacggtgctgccggcgatgacgagaatcacgatgcctaaaaggacaagggtaatcgcatctcgatcaccaaagctaccgaagagtaagcggcgtgacggttggtcatggcgcacatcgttaccattattcccaccttctgtacttggcagaacatggcgctggtcggcgattgtcatgcggattgtatcaccgctcttaatatcaactgcgaccggctttgcgtagtctggattaatggtatacccagctggcgctttgatctcagtcagccagtaacgacccagtttcaggttatcaaaggtgaccagcccattgacatcagtcgtgaattccttgctatagcccttgtcatttgtcagtcggaaaacggcacctgctaagacttgattgctatcagcagcatccaccttcttgatgacgagtgaattgatctgatagttggcagcctgtacagtaaccggctgctgcttattctggcttgctagcgcgctcacgctttgcgtcaggtcggtttgttctactttaaagtcgatcttgtcggtattcagttcatatttcggcaaggtcttggtttcttcaaagtagtagtcgccaattggtaagttaaatggcaagttgatctgcccggcttcatccgtgacaagatccttggcaaggacattgccattgctaccatataagtcaaaggtaatgccggccaaatgattgccaaaattaccatccgtcttttgcagctgaatggcgcgtttaaattcgggttcgataatcggatcaagagcaactttttggtcgcccttgacgttcacatcaatccccttggccagatcatctgggataacgtagccgcgtggtgcctgcgtttcaaccagcagatacttaccttcataaagatcatgatcattgaaggtcacaatgccattctggttggtgatcgttgtggtccatgcgtgactgtgatcaaccgtgccgtcttcacgataacgatacatcgcaaattgggcgccaatcatggtcattttgcccgggaagcaatcatcggttgtggtgtccgccttcttcgtcacaatgatttggccagccttcttctggttagttgcggtcagcttcagctgggtttgatcagtcttgatggtgaaatcgacactaccagcggccaaactatcttcccatcgttgcttctggacgccgcttgtcgcgttagcttgatcagcggcatccccttcataatgctcaggggcttgggtttcgactaggcgatatgaattgtccgatttcaacccttcgatcgcatattcgccatccttgagtgaggtgtcaaagctgcttgctgcgccaaaggtcaattgcccatcagtgttggtcttcatgtcggccttcaacgttttgttggttacggcatccacaagcttatacgtcgctcccggcaacagatactgcttgcgtgttgccgcatcatcggtcttcttaacccggttatcgtacttagttaaggtgacttgataaggatcgtcagcaatttgcttgtcgatggtgattggtgtcggcgtgatcgctgaggatagcgtgatcgcatgaaccgtcttgtccaaccgatacccagccggtgccttcacttctgtcaacgaatagctgcctagcaacagatcgccaaaagaggccatcccattttcgtcagtggtgatgtcacgactgtagccagcactgttggtcaatcggaaaatcgcccctggcagcacatgagctgcgtaattgcggtcaaccttttgaacattcagcgttttgacttgatagttggtgacgttgacgcgaatcggttgttgcttattttcagttgctaaactgctggccgtttgcgtttgatcagtctgcttgacttcaaaagcatgtttgtccgtatttggccgatatggtggcaaggtcttcgtttcctgaatataataatgaccaactggcagactaaacgggacattgacttggccatttttgtctgtcaccaaatccttggctaactcagtgccatcttcgcgatacaacgcgtacgtaatgccagcaattggattaccaaagttaccatcggtcttcgccacacttaccgtccggcggtaaaccggttcggtgatggttggcagcgttaaggtttgatcgccagtgatatcaacgtcaacgcccttggccagttcatctggaatgacatagccatcaggagctttggtttcaaccaactggtacttgccttcatataaatctgaatccttaaaggagacggtgccgtcattgttagtgatggtagcgtcccatgaccggctgcgatcaactttgccagcttcgtcatagcgataaagcttaaattcagcgccagtcattggttgacgatcagggaagtgatcatccttgatggtttcagcttgtttcttaagatccagctgacccggtttcttttggttcgttgcggtcagcttcacttgcgtctgatcagccttgatagtgaaatcaacactgccagccgctaagctgtcttcccacgcctgtttctgggtgccgcttgtcgcgttgacttggtcagcagcatccccttcataatgttcaggagcttccgtttcgaccagccgatatgaggtatccggcttcaacccttcgattgcgtattcaccatccttgagcggtgaatcaaaactgcttgccgcgccaaaggtcagttggccatcagcattggtcttcatgtcggcctttaaggtcttgttggccgccacgtcgacaagtttgtatactgcgtttggtaacagatacttcttttgactcaccggatcatcctttttgacgcgattatcatacttcgtcagattgacctgataaggatcgtcagcaatctccttattaaccgtaatcgctgtcggcgtttcggcagaggacaacgcaattggataaacggtgttgtccaaccgataccctgctggtgccttgatttcagtcagcgagtaactgcccaacagcaagtcgccaaatgaggcaatcccattttcatctgtcgtcacgtcgcgagtgtaaccagcactattcgtcagccggaagacagcccctggcaacacatgagttgcgtaagtgcgatcaacctttttgacgttcagggttttggcttgataattggtcacattgactttaatcggatgctctttgttttcggtctccaggttgcctgccgtctgggtttgatctgtctgcttcacttcaaacggatgcttatcgctgtttggccgatatggtggtaaactcttggtttcctgaatatagtacttgccggccggtaaattaaatggcaagttgacctgtccattttcatctgtgactaagtccttggcgatctcagtcccatcgttttgatacaacgcgtacgtgatgccggcaattgggttgccgaagttgccatccgtcttagccacttgcaaggcgcgtcggtaaactggctccgtgatcgtcggcagcttcagcgtctcgtcaccagtgatattaacgtcaacacctttggcaaggtcatcggggatgacataaccttcaggcgctttggtttcgactaactgatacttaccttcatacaaatcaggtgaatcgaagataaaggtaccatcttggctaatgatcgttgcgtcccaagatttgctttgatcaaccttgccgtcatcaccgtaacgataaagcttaaattcggcgccggtcattggctggcgatcagggaacttgtcgtcagtgatcgtttctgcctgcttcttgatatccagttgaccaggtttcttctggttatacgccgtcactgtagcggatggcgccttgttagaaatgatcgccgccacgctgccggctttcagactatcttcccaaacctgcttgtcgggtccgctggtaatcgtcgcttgatcatgcgcatccccgcgataatgatctggggcttgcgtttcaaccagcttgtaattgcctggcttcaagtcttcaaggacgtattcgccatctttcaagtcaggggagaacttgtcgccagcatactgacctgaaaagctgctagccgttccgatagtgattttgccgtcagcgttggtcttcatgcccgacttcaatgttttctgcgtatcggtatccactaagtcatacgtggcgccgggaagcagatagtgtttgttatctgtttctgattggcccttagcgcggttgtcatacttcgacagcgtgatctgataaggctcgttttcaaccgcttccgtttgaatcgccgtgcctgtatcggaagttgcgttcagatgaatggtctgtggtgccaatggcttataccctgctggggtactgagctccgtcaacgtatagtcaatcccaattggcagtccttggaaggttgccagtgccttattcgtggccgcatcaagttttgtggtggcttcaaatgtatgggtgccgtcacttaagcggaacttaacgcccggaattggcgtgccactgacgctatccttcttttcaaccactaagttggctaattgcgtgagggtctcgccgctgatacctgaaccccaataaggcaaatacccatttgcgtttgcaattcgcgcatcaggagggacaccatcacttggcttttgagtcgtttggctgccatcccattcaacgctactcgaattgtatgcccatcctgagttcttgctactggtggcatagtcgacgcttacttggtaattattaagtgggctattggtctcttgcgtcagattcccaaaagttcgcttaaaggtaatcgtaaatttattgccatctaaggcaagggtataatcatccccttcttttaacgtaatcggatcggcaatgccaaccttcaatttcacgacaaaactggtggcattgatttccgccccagtacctcttggatccaaggtatcctcaatgattggattcaccattggccgatatttatcttggatattgatcagatttacctgccaattcaagacatttttcaacttggcgtcagcactgacagttttactaattggtgtccaataactttgcgccgacttcgaagctgacgggttgaaagtaggaattgccgtggtcggttcggtatctgtcacagtcgcattgttggcgaagttaggatcgttatagttccactggttagcgcgcatcgtcttgaaaacaacccaaacacgccccgtgccgatatttggaaaatcaaaatccaattgttgcgctaaatttggattgtttttgagccatgtatttggcgtgttggttggtaacaggctttgctgagcagcatcctcagccttaagtgctgtcgatgaccaaccaccggttccataatatggactcgtcttgatttctttcacatcgttagaagaagctggattacctgtgttcgatggatcaactccgtctggtcccgtgacttcatagaatttaatcgaatcaggaatcgactcgtaattaacgccatcaaaccgcggcaaaatatcggtcaggtgcatgtggccatatggaagccccaattgattaactaagacaccccaatactgggtatcaggcgcgtcactccaagaattcttcaaggctccgctaaaggccccttcttctggtgttggtgtactactactatcaccgctggcaacgtcatcatcacctggtggcaagtcaaagaagaaaaatgcgcgattatttaaagcctttttcaaagcgtctgggtcgtgaccgacttggcctagcttcaacatgtccagcttagtatgcgtataaatcacaatttgcgaatctgtttctgcatacgcccctttgagcgtgacgacaaagccgcgaatgcctttttcctgaccattcgcattaatcggatttgtcttatccttgtcgttatattgcttaactgcagattgaacgtcagcgtcttgggtactcatatcgtaatcagtccccggcttcagcaacgttcttgcgccgtccggattctgggcgtagacaagaataccgtcattagccccatcgtcaacatttgctgagacattttcaccggagatggtgttgatgttatcggccgttggatcgttgtccagcttatcgaccccatccgggaaaaggtcgaagattttaccattcttcatgttccggaaaacgcggttggcattgatccgccaagtcatttgaccattgtaggcatcaatcttgccgcccacttttgtaatcccgcttggcagcctaactggataggtcgcatgatcgtaatgattcttctgatcattcacaatattggttaagttgtcgccatttttcggtgtgttcttcagtttcgtttgatattgaatctggaaagaagcattttccgggagatcgccgccgccaagataagttagtgtgaactcgccgtcgcctttttcagtgagcttaaagtactgcgcgatgtcgaccttggaaacaatcggcgttgcccactcgtcaaacgtgacttgaaagaccttcagggacttcgtgtctaaggtttgattgccatctgtctcgatgttgggttgatcatgctcatctttcccgctggtttgcttgccaaagcggtccgtcagcgtggcgccagctttcatggtgtccatgctgtaattccaattaattttccagttaagtgctcggaaattattggtgatatcgccagatttggtgaccgccacgccggagttgcgcatggtgacactatcatagtcataaccatcatgcgtctgtgaaccagttaagtagcgatagccttcaactaaggcactacccactttcccggtatcgtctaaagatcggtcaatcgtggccgtgtaatctacttgatacccagttgtctttttaaagccgcctgtcagataaatcttaaccgttcgtttgtcatccgataaaacagcatgaaaatcttggccggcgactaacggcttaagttcttcagaaaagccgccgagaatattgactggtgccgacgagaccttgatcttcgccagatcgctgtcgctaaaggtcagcgatttgagataatctgttccgctgcctcgtgccgtcagtgtcaatgccatgtcagcgttctttgaccgtttagccggatcactgtcccactttgtcggatcggttttgctggtttcgttcccgtttaaattaaacttcgcggtcccagcaatgccagtcggattcaagctttgtggtgtcgtcgtaggcgcatacaccaccaccggcttggcattcgacctaaacgtgattggaaactttgtgtcctgatcttttgtatggaaaaccagtgtctgattgagtgaatcattagcagttaaagccttaaagcttgctgcaatatgcactaaccaagaaccattactcgtggctttcaaaagtttgatcgtcagctgtcctgtggttgcgtcaaaatagtacgaggcgacatcaccggaaaaattgccgccgccactttcaggaaaagcaatctgctcctttggcaaggtcgttgtaaaggatgcccctgccggaaacggggtgctcgttgccggtagtgtaaaggtaatctccatcttcacagcactttgctgatcgacttccgttcccaaaggctgatcattgccgtccttcagcgccaccttcgtgaaaatattgggcagctcagtatcggcctttgcgtccggtgtcgcgcttttttcagcttctggcgtcttcgcttccgctggttttgcggctgtactactgctactgccgctgccgctatcaagtgtggctgatgcgcgactcttaaacagtagtgtcacattgcccgatgccgtgacactgaaatttttcgtctgttcaagagctgtgtaaccggaaacagactgtttttcggttgccgtgtaatttccgaccggcaagtttggtaccgtcgcctggccgtccttactaatctcgctattcgccactacctgatgcgattcattttgaatctcatacttagcgccgtttagcggtgatccttgttcatcttggttcttgatcgtgagcgtaccagtcactgcctgtgtcggattttcggctgcaagggctagtgctggcgaaatcagttgtacaatcatgccaaggatcaccgttaagtaaatccccactttgagcatgaagtgcccggttttcttgccacctaactccctcatttttctcctcttcctcctctttacaaacctacttggtatctccccctgagaccattaacctataatttatggatacattaatttacactccgctcaatatcattgtataacatttctataaatattgaagggattataaagaatatttattaaatatatatgcttatgtttattcttttcgcctagtggtaatttgcttttaaatccttacatatcaggtgttgcagccaattaaaaaatgtactgttagacaggtttattaaatatcgatttttcagaagttgacagcgttaacaatagagcttttttagcccattatcatctgctttttacttgtgcaagaagaaaaacaaatgcgaaatctgcttcatgaagaggtgaatgctatgctaataaccgtacttttgctcattgttctgtacttagttcgccagcacagcttggcaacccgttgctttcactgtctactagccgtcctctctggattaagcatccatacttggttaacttttttgcttgcctcaggcttaatcatctttagcgtggctgactggcatgagcgaacggttcctttcttcagctttactggttggtgtttgactttgctggtttgttttccccatgaccttttcggcatgatgctacttgctgtcatgattggcggtttagccgttgtgtcgcaagggcttgggagtgcggatgtgatgttaattgccttgctggcctgcgtcttacgactcgaggcagcgttaatcgtgacactgattgcttgcggaaccgcctgcctgcattggatagctgcccgtccgccgagtttgccaatgatcagtcatttagcggctggttatgcgtgctttgctttggtcaatggcatactataacgcgctcgcagtcgcagaaacctacacgtaagggccttgaagctcagtgaccaccccatgtcattgagcttcaaggccacttacgtcccagtttctaaacgctcctactcgcgctcaccaaaaaagcggcgcaagcatcttttcagatgtttacgccgcttctttttggtttaactgtcagttcacgcgattactttttgtccgtatcgccttgctggccgtcttttgctttcatttgcttttcgatgtctgaaatcgaatagacactgtcggaaacggtgccgacactctttggttcttcgtgtcgatacgttgccatcccggtaccagccggaatgatcttcccaatgatgacattttccttcaaaccaatcagcggatcgttcttgccgcgaatcgaggcatcggtcaatacccgtgtcgtttcctggaaggaagcggcagacaggaaactgttggtctccaaggaagccttggtgatccccagtagaactggccggccagtagcagggataccgccactgataattgcctgcgtattcttttccttaaagtcagcaatatcgagtaaggttcctggcaagatgttggtgtcgcctggatccatgacccggatcttgcgcagcatctggcggaccatcacttcaacgtgcttatcgccgatatcaacaccttgcatacggtaaactttctgaacttcagaaagcaggtaattttcggtggccatgacatcgcgcactttaatcaattgcttaggatcaatcgaaccaccagtcaggcgttcgccacgattaatgtggtcgccttcagcaactgccacactggaagcatatggcacgctgtaagtccgggtgtcggtttcacctttgaccgtgatttcccgtgtgtgctcagctggattttcgtcaatcgccgtaatttcaccggtcacttccgtaatcacagcttcacctttagggttacgagcttcaaagatttcctgaacacgaggcagcccttgcgtaatatcttcgccaccggcaacaccgccagtatggaagttccgcatggtcagctgggtaccaggttcaccgatagattgcgcagcaacagtcccgacagcttcgccgacttcaacttgttcgccagtggccatgttacgaccgtagcacttctggcagacaccatgtttggtgttgcaagtgaagaccgaacggatcgtgacggattcaaccccggcatccacgatcatctgagcagtatcttcgtccatcaaggtattgcgcttgacgagcacttcaccactcttcggatccagcacatccttcatggtgaaacgaccaaccagtcgatcatacaacggttcgatcatttcattaccttcacggatagcactgacaactaagccacggtcggtaccgcagtcctcttcacgaacaatgacatcctgtgcaacatcaaccagccgccgagtcagataacctgaatcagccgtcttcagcgccgtatcggtcatccctttacgagcaccatgagttgacatgaacatttccatgacggacaggccctcacggaagttcgagataacaggcacttccatcatcccaccgtttggcgcagccatcagaccacgcatgccggcaagctgtgtaaagttagaaatgttaccacgagcacctgaatcggacatcatcgaaattgggttgttcgggtcaaacgaatcaaccagcttctgctgaatatcatctttggcatcattccagatctggataacccgatcatgccgttcctcgtcggtaatcaacccacgacggaactgcttggaaacagtggcaaccttcttatgggcagcttccacaatttcaggcttttccttcaagttagtgatgtcggcgatcccgacagtcaagccagagttagtggactgcgtatagcccaaggtcttcatatcatccagcaaatcactggtccgctgaaccttatagaccttgaaaacctgcgcgatgatgtcagacaggaagcctttcttgaatggatcgattaacggtgcatcttcaaggtagtcgttgatgtcttcacccttatcgatgaaatacttatccggcacaccattgacgatgttatcctgcgtcggttcattcaaatatgggaagtctttcggcataatctcgttaaagatcgccttaccaacactggtgaccatgatcttttgtttctgatcatcggtaaacggcttgtccgtaaaggaattagtcgcaatcccgatgcggctgtgcaagtggacataaccgttttgcaaggccatcaacacttcgttggtgtccttaaagatcatgccttcaccttcgcggcctttttgttccatggtcaggtagtagttacccagcacaacgtcctgtgatggcgtaacgattggcttgccatcttttggtgccaaaatatggtgtgcagccaacatcagcatccgtgcttcagccatagcttcgtcagatagcggtacatggatcgccatctggtcaccatcaaagtcagcgttataagcttcgcagaccagcgggtgcaaccggatggacttcccatcaacaaggacaggttcaaatgcctgaatcccaagtcgatgcaaggtaggtgcacggttcaacagcactggacgttccttgatgacatcttcaagcacgtcccaaacatcatcatcttggcgatcaatcttgcgacgagcattcttgatgttgctagccatgtcgcgcttaaccaattcgcgcatcacaaatggcttgaatagttccaatgccatttcacgtggtacaccgcattgatagaacttcagccatgggccgacatcaataacggaacggccggagtaatcgacacgcttaccaagcaagttctgacggaaccggccttgcttccctttcagcatgtgtgacagggacttgagcgggcgattacctggccccgtaaccggacggccacgacgaccattatcaatcaaagcatcaaccgcttcctgcagcatccgcttttcgttttgaacaatgatacttggcgcattgagatcaagcaggcgcttcaaccgattatttcggttgataacccgtcgatacaagtcgttcagatcggaagtggcaaaacggccaccttcaagttgaaccattggccgcagatccggtgggataactgggatcgtgtccatgaccatccaagctggatcattaccggattccttgaaggcatccagaatatccaaccggcgaatcgcacgggtccgcttttggccttgggctgacttcaggtcttcctttaattcggcaacttctttatcaagctcaacatcctgcaacaattccttgatggcttcagcacccatcttggcattgaaggtttgaccgtattcttcgcgtttttcacgatattcacgttcggtcaggagctgctttttctccatcggcgtatcgccaggatcgatcacaacgtaggacgcaaaataaatgatctcttcgagtgaccgcggtgacatgtccagtaccagacccatccgacttgggatgcccttgaagtaccagatgtgggtaaccggtgcggctagttcgatatgacccatccgctcacggcgaaccttggaacgagtaacttcaacaccgcagcgatcacaaacgattcccttataacgaatccgcttgtacttgccacaggcacattcccagtccttggtcggtccgaagatgcgttcatcgaacaagccgtcccgctcaggttttaacgtccggtagttgatggtctcaggttttttaacttccccataggaccagctacggattttatctggcgaggctaagccgatttgcatactttcaaacttattgacatcaatcaaagggctaacctcctatttcttatcgtcggtactgttggcagacttaccgtcagttgcttgtgctgcggcttcgtgagccttcttttcttcctgctgagcagcaaacttcgccaaggcatcgacagaaacaatgtcatcctcgtcgtcgtccatgtcccgcagttcaatttcttttttatccgcgccaaggaccttcatatccagacccagtgcttgcaattctttgacaagcacacggaaggattctggtacacccggcttaggaatcggttcgcccttaacgatggcttcataggtcttaacccggccaaccacgtcatcggacttgtacgtcaggatttcctgcaaagtataagccgcaccataagcttcaagggcccaaacttccatttcaccaaaacgctgaccaccaaactgagctttaccaccaagtggctgttgggtaactaaactgtaaggtccaatggaacgagcatgaatcttatcgtcaaccatgtgagacagtttcatgtagtacatgattccgacagaaacacggttttcgaatggttcaccagttcgaccgtcatacaagacagacttaccatcagatgccataccggcttccttaacggttgcccacagatctttatcgttggcaccatcgaaaacaggcgttgcaacatgaatgcccaagttacgtgcagccatccccagatgcaattccagcacctgtccgatgttcatacgacttggcacacccattggtgacaagcagatgtcaactggggtaccgtctggcaagtatggcatgtcctcttcaggcacaacgacggaaaccgtccctttgttcccgtgacgaccggccatcttatcaccgacctgaatcttccgcttctgcgtaatataaacgcggaccatcatattcacaccaggagacagctcatcgccggcttcacgagtaaagatcttaacgtcttgaatgatcccgccgccgccatggggaacccgcagcgaggtgtcacgtacttcacgtgctttctcaccaaagatcgcatgcagtaaccgttcttcagctgacaattcagtaacgcccttaggtgtaaccttgccgaccaaaatatcaccgtcacgcacttcagcgccgacacgaacgacaccaaattcatccagatccttaagggcttcttcacccacgtttggaatttcacgcgttacttcttcaggtccaagcttggtgtcacgtgcttcagattcatattcttcaatatggattgaggtgtaaacatcatctttaacgagtcgttcggagagcacaatcgcatcttcgtagttgtacatgttccaagtcatgaaggcgatgatcgggttttgtcccaatgccaattcaccattttgcatagctggtccatcagcgatgatttcgtcaacatcaacatgatcgccgatggtcacgattggccgctggttgtagtttttaccggcgttactacgcttgaatttcatcaagttgtaggcatccaaggcgccatcttcacgacgaacccgaatttgcttagcatcaacatattcaacggtaccagcgttattagccaaaaccgctgtcccggagtcatggcctgccttgtattccatcccagtcccaacaagtggggcatgcggattaaccaacggcacagcctgacgttgcatgttcgcacccatcaaagcacggttggagtcatcgttttccaagaaaggaatgcaagccgttgcgaccgcaacaacctgtttaggtgaaacgtccatgtagtcaactttgtctggagagatttcaatgttgttatccttgtgacgagccagaacggtttcgtcaacaaaggaaccatcgtcgttcaaaggcgagttcgcctgcgcaacgatgtagttatcttcttcatcggcagtcaaatagtcgattttgtcggtaactttatgcgtatcccaagaaacacgacgatatggcgtttcaataaaaccataaggattaacaaccgcataagaagcaagactgttaatcaacccgatgttcgggccttcaggcgtttcaatcggacacatacggccataatgggtgtagtgaacgtcccggacttcataaccggcacggtcacgcgtcaacccaccaggtccaagagcagacagacgacgcttatgcgttaactcaccaagcggattcgtctgatccataaactgcgacagttgggaactgccgaagaattccttgatagaagctacaactggccgaatgttgatcaattgttgcggcgttaccgtagcggtatcttgaatggacatccgctcacggacaacacgttccatccgagaaagcccgatccggaattggttttgcaacagttcaccaacagaacgaatccgccggttacccaagtgatcaatgtcatcaattgaacccaagccttcctgaagattcaggaagtagttcattgatgccaaaacatcagcggggacgatgtgcttcacttttttaccaatatgaccgttaccaatcaaattgatttctttatcaggggtcacttgtgagtatactttgatactctgtaattcgatcggatcagtgacaacgccttgatcggaaggttggtaggtgatggtcttgaaatcatcgcggtcaagatatggtgccaacttgtccatcacttgacgatcaaccttggtgcccttttgcgcaatgacttcaccagtatcaggatcggccagtgtttctgccaaaacctgattcaaaagccgggtcttaaggctcagcttcttattcactttgtaacgaccaaccgaagcaagatcataacgcttcgggtcgaagaagcgggcatacaaaagagaccgcgatgaatcggctgtttttggttcgccaggacgtaaacgttcgtagatatccttcaacgcttcgtccgtacgggaatcatccgtgttcttatgcacatctttttcaagcgtaagcatcaaggaatcattgtcaccaaacatgttgataatgtcttgatcggaaccgaagcccaacgcccgaaccaattcggtcagcgggatcttccgtgtccgatcgattcggacatacgcgatatctttggcgtcagtttcatattcaagccaagcgccccggttaggaatcacggttgtgccataagtgacacgtgagttcttgtctgtttcgctatggaaataaacgccaggtgaacggaccaactgagaaacgatgacccgttcggcaccattaataataaacgtcccttgtttggtcatcagcgggaagtcgccaaagaacacatcttggctcttaatctcgcctgtttcatggttggttaaacgcaaggtcacatgcaacggtgcagagtagtttgcatcgtgttgacgtgcttcctcaacagtatattttggttccagcagttgatagccgacaaattccagtgacagtttcccttgaaagtcatcgatcggcataatatcgtcgaacatttctttgagaccttcatcgaggaaccattggtaagaattcgtttggatctcgatcagattaggaagatccaaaacttccttgatccgggcataggaccggcgtgtccggtgcttaccataattcactaagtgtcctgccaaattattcaccccttgtaagattttccggctcaggttgattgtaaaaataatgtaaatattgttaagtttacatgacaacgaccatcccgcagacattttgagcaaaaaaaaaccaaaaacagatcgaccttcaaccagcctgctgtttttgctttttcattagccagaacggacaatagatcgtcctgacagcctgtccaaaccgaaatgcgattagattcataatacgcgtatcaatcaacgatgtcaagcggaggttgatccgtgctgcgcaagcaaagccaaaaagaaatcgcagcctaacagccgcgatttcttcattatcaacactaggctttaacgggttcttttgaagcaccgttttctttttgcttgcctttgttctctttaacagtaaatgtcagcttgccttttttagccccaatttggatcaaatcaccggttttagcttggcctgtcagtaaaagttcacttaactggtcttcgacaccggtttgcagtgcccgccgaattggacgtgcaccgtactcaggatcgaagccggcagcggcgacagcgtcaataccggctggggtaattttaacgtcaatcccttggtccttaatgcgactaagcactgtcttcgtcatgatcttaacgatttcatgcagctcagccttgttgagactgtggaagaccacggtttcatcaattcggttaaggaattctggtcggaacgcttttttaagttcgtccagcatccggctcttcatggcgttaaagtcagcttgtggatccttggcaccaaagccaacagtcttatcgtcacgaatagcggttgcgccgatattgctggtcatgatcaaaatcgtgttacggaaatcaacccgccgaccttttgaatcggttaaatagccatcatccagcacctgcaacaaaatgttaaagacatctggatgcgccttttcaacttcgtccaacaacacaaccgagtaaggcttgttgcggactttttcggttagttgaccgccttcgtcgtaaccaacgtaaccaggggccgcgccgatcaaccgactggtactaaatttctccatgtactcagacatatcaacccggatcatggcatcttcagaaccaaacattgcctcggctaacgccttagccagctccgttttcccaacacctgtcggcccgaggaacatgaaggaaccaattggccgcgtcggatctttcaaaccagaacgagcacgccggatagcacgcgcaacggcggaaactgcttcgtcttggcccacaacccgctcatgcaggatcttctccaagttaaccaaccgatcggattcttttttctgcaactgggtgactggcacaccggtccattgagaaaccacttctgccacatcgtcgcccgtcactttaatgtcagttcgaacgccactttcattaactggttcaggcgtgtcggccaacttcgtttttaaatcagcttcctgagtccggatgttcgcagccgtttcgaaatcttgatggtcaatagcgtcttctttatcagctaccagcttggccagttcatcctgaagcttgtcggccttcgtctcaacattggccttgtccaagcgaaccttcgccgcactttcgtcaactagatcaattgccttgtcaggcaagaaccgagtcgtgatgtaccgtgatgacaaaaccaccgcctgatgcagcgcttcgtcagtaatcgtgacaccgtgatgcgcctcataacgaggacgcaagcccttcaaaatttgttcagcttcttcttcagttggttcgtcgacttgaatcgtcgcaaaccgccgctccaaagcagcatctttttcaatatacttttgatattcatctaaggtcgtggcaccgatcaattgtaattcaccacgagctaatgccggtttcaaaatattggaagcatcaatagcgccttctgcaccgccagcaccgatcaaagtatgcaattcatcaatgaacaaaatgacattgccatctttataaatttcatcaatgatcttcttcagccgatcttcaaactcaccacgatacttggtgccagcgacaagtgagcccatatcaagcatcatcaaacgcttgttgaccatgtcatccggcactttaccagacacaattttttcagcaaagccttctgcaattgcagttttaccaacaccaggttcgccaatcagtacagggttgttctttgtccgccgtgccagaatctggatcagccggcgtacttctttgtcacgcccaacaaccggatccatccgattctcgcgcgccatttgggtcaaatcccgcgccaaaccatctagcgttggcgtaccttgtccatcttgacgagcaccgccacgtgccattggacgacgctttgctgcagtgtccgcaatccccatcttcttgaaaaccatttgacgcgtcttcgaaagactgagaccaaggttttgcaaaatccgtgctgccaagatgtcatcttcacgtagcaagccaagcaaaacgtgctcggtaccgatctttaaagcacctaaccgttttgcttcgtcacccgcaaacgccaaaatttctttaccttttggtgagtaaggcaaataactatcactagcttgaccagcggcatcaacagtcccataccctgtgaagcgctcgatctcgtcatggacatcattttcagtgacccctaactgacgcagcgtcttaccagcgataccatctttttccatgaccagtgccatgagcaaatgttctgtcccaacagcatgatgatggaagtacttcgcttgttcctgggctaaaagcaatacatttttagcactaggggtaaataagttgtccataagcacgctcccttttttaaaaactgatgataaactgtttcatctttcataccgcaaacgatccaaaaatgcaaggaaaaaacgcgatcgtagatgctcttctgccccttggtcgaagatgcccaacgtctcatgatccatcaccgcgagcatcaggttgccagactggcgggcgatcaacccgttatcaaacaattcctgaatcaaatctcgggcatcccgcatccgcaaacgacttggaatatgctgtcgcatgatctgaatgagatcctgatcatctgtcaatttgaccttcacgattcgaatatagccaccgccaccacgtttgctctctacgatataaccgcgagcaggtgtgaatctggttttgatcacataattgatctgtgaaggtacacaattgaaacgacgagcaatttcagcgcgtctgatttcaacagccgcttcttgcgccaatatcgtttttagataggtttcaatgatgtccgaaatgttctcacgctgcatgtcattcaatcctttttgactttgaccaatcttgactattacacattatactgacatctgtccgtttatacaaatttatgactttgaacgcaaaaaaagaccacgactattcgtgatccaagaatcgggaagacaagattcgaacttgcgacccctacgtcccgaacgtagtgctctaccaagctgagctacttcccgaggaagcggaagacgggattcgaacccgcgacccccaccatggcaaggtgatgttctaaaagtcatcactttttatttcttaaagtgacaacttttaaggctattgtacggacgttgtaagagaatcattgtgccccacagcaacaggagcgagccgatcgtgaaggcgatcaataccatgaagccgaggttgacagtgctattggcaatgccgccggtgagcgcgttccggaaattcataatggagtaggtcattggcaggaatggatgaatggcgttgtagaactgattggtgatctccatcgggaacgtcccgccggcgccacctaattgcagcatcaaccccaccatcgccacaaatcgaccaggattatcgaatgccattgagaggaacataatcagatacattgacgtaaaggagaagaggatcgcggtcagatagaacaagccgatgttgtcgaccttgagaccggtcgccatcatcagagttgcttcgagaactgcggtgccaagggcaacagctccgccaatggctactttgctcaggaaccactgagttgccgtcccgtctgctctggaaaccttgcgaattggataggcaaagttgaaaaccaaggcgccaacgtaaagtgccagactcaaaacgtatggggcaagtgcatggccgtagtttggcacataagaataatgcttttgcgctgtcttggtgggtgcagcgaacatctttgccgtatcaccggttaacgtaatgccattgactttacgggcgctgctggtaagtgtcttagcgaacttcttgtcgccgtcttcaagctgactggaaccagatttgagtgtgtcgctcttgtcattgatttgaccggttccgtcggcgagttgattgacaccggataccagtgtcggcacactagcgtttaattgattgacaccgccagcaacttggctggcaccattggttagctgaccgacaccattggtaagtgtcggaacttggtcatttaaggtaccaagaccgccggacacttggctggaacccgtgtagagttggttgataccactggtgagagcaggaacttggctgtttaagctaccaaggcctcctgaaacttggttagaaccggtatagagctgattgacgccaccggtaagtgctggtacttggctgttcagagtaccaagaccgccagaaacttgactagaaccggcgtaaagttggttgacgccgctggtgagtacaggaacttgatggttcagagtgccaaggcctcctgaaacttgactagagccagtataaagctgatctacacctctaactagtggctgcttaaaaattctataattcaggcagttaagctaatatatgcattatgggtcaactttttataaaatactggtatgtttggctaattatcgccgttttgtgtgtttgcggagaacggtggttgcatcgtaaagcctaaaagttttgcttattagccctcgctaccggggctatttttgtgcccactgcccgaaaggcgagaggggctaattcttccagtatcctatacgtgaaagcaatatgaatccaataaatatgatgaggccaaagataatatttgtcgtaaagacccatacaaacacagaaacaactaatcctattagcaacatgcaccccgcattactttcacgagctttttgctttctgatgccgttagcaactttattttcaaaatctttatctttatttgccaagtataatcaccaatcccctcaacaggtcatttactgctgtcatcgctagtaagatgcgctactacatcttttattttttcgctgttttggtaaatatcgattggatgtacgaaatcaatttgagtatcagcatcatcgtgcaattcaatccagtttctatttttgcggaagtagactcggagtatccattttctgatattgtcatcaagcaaaacattaaagtagctcttgttatcacgatagaagacgcgctcttcatcaagctggtcacgaagaattattttgacagttgtgtatgcctctatttcagcaggagtcgtcactatttcgccgtcatcgggcttttcatcagtgctttcgctttcttcatcgttttttgattctgcctttgaagattgtgtaataggagtggaactaactgatgagttaagagcagaacttagtttgtcattcacttcttcttgaatcgcctgtacaaagccagcttgaattataggcgtaaattgttcaatgttcgtttgggtagcacgttggttgaacaccttagataaaataaaacggacgtattcttcatcgaccgactttaactgactagtaaggtaatccctgaattgatttgtatattttagctgtgatgccgatgatgaaatactgtcctcatcaaagttgtcttttacaaatctgaagagttcggaaatttgactatctcgtagtagacctaggtgaatggttaagaaaggttctgagtccatcttattctcattatctagatcagtgaaaaacctgtattcctcaccatttgttaaaatgccgaacttggcatctgtagttccaaaatatctaaataattgggaatcatggttatttaggtcttcattaattgccttgcattcaacaaggatttgaagttttccgttgatgacaatagcatagtcaactttttctccctttttaatgccgacatctgcggtgtattctggtatgaattccagaggattaaaaatgtcgtatcctaaagactggaagaatggcataataattgaatttttcgtagcctcttccgtttttaagctgtcttttaactgatcaactctcttagcaatggttcttatcttttgtgtaaattcgtctttttccatttttaatcctccgtcaatattatttgtgacctaatgtataacttcgaagtagcgccacatccaatggggtagttcatactgatccagaacagcattgtaattcataggagaaacttcctgatcgccgaaaacaagctcaaacataaaacagtttgcttgatactcgttgtcaccaaccataggctcagctcccactctgctaaaaaagttggtgtctagccctcgatgcattttgcaatgaccaagctcatgggcacaaaccgctgttgcctgacaatcgttaagcgacaaggacaatactatcatcggcacacggctaatttgcatgctatatcccagtatgttattgcctaggtctcttcgacgaatagaaacgccgtcacgtttagcgagcttaaaagggtcactagttccgtatcgattagacatatgatcagcagcagctagcgcttcactttccgaatatcccaatagaagtcaccccccaagtcactcttcgctaccgcgatacttcttgggggtgaacttcttttttgctagttctttggccaaaatgattgtctgtctcattgaggcttctaacaaagcacggtcttcatccgtaagttcgcccccatttttgaaataattaactccagttttcccagtaatgccattcatagcatcgttcagaatggcttcaacatctttgtagtccttgtctgtcaatgaatagtagtggcgtttatccgagtttccaagaagatagtcaatggaaacatcaaataatttagacatttttcttaggtcttcgttgcttacaccgcgtctatcattttcccagctagtgacagtgctttggctcacgttcattttttctgcaagcattggctgagtcattgagtgctctttacgcaagcttgcgatacgttctccagtagtcatataagcacctccacgattagtattatatgttgtactcttagtaatggctataaatatcaaaaaatatgtacaaaaagagttgacatgtacagttagtaactgtactatatgtacataagcaaaggaggtcataacatgaagttaaagcaggctcgagttcgatctggaatgagtcaagaagagctagcaaaccgtgttcatctgtctgtctctatgattcagtcaatcgagaacggacggcgagatggctctacaaaaacattgattgctttggcagcagcgcttaatacaacgccaaacgatcttttgtatggaaccgataatactattagtacaagtaaacacattcacgcccagcgagaggaggcagtcaaatgaacgagaatgagcgcaaacaaatagcgcaaacagcccaaaaacttttggaagaagcggcccagctgattgcgctatccaataagcttgatgaactaatcggtcatgtcaatgacaaatgacgattgatcaataccattctttattgcgtcaatggttcgctgcgcagactccttgtacacataagtttcactcgtggcaaccgtttcgtggttggctgacttgatggcaaagaagtactggttgttttcagatctgtagattacaaagtgcattttaatcacctccttcaaagcgattatcccacttgaaggagaaacaaagtattgaaatttcaaacagtgctgtcgttagttcaaagatggtctggtttttagaattttcaactaaaaaggagatcatgaacaacatgaacaaacaattagcagacttagtacgaggcgttctttctggggaatacaaggtggtagaaactagaaatgccaatcgcgaccttgatactgatggctttaccgataaaccactagaagtatcagaatttactttcgacgtggtcagaaacgccccttatttatcagggaaaccagtattgaaaaagtaaaaggactagttgctaaaccaggccatctttgaactaacgacagttttcaagttaaggaggtgagcaacatggatcgacagcaaatgatcgaagcgctgatgagctaccgcgatgataagcccaaagcttgattcctgctttcttgtttagctagcactaacaagaataggtcttcatggcctttttggtctagtcgtcagggtgttgcacttgaattgtaaactggggggtcttttttcacattttctgggtggtaactttaattatgcaatctagggttgcaaatcattggccaacaacggcctgttaagacggcattttgtttagcagaagggaaaagctaactttttgcccaaaaaagccgaatagcagtcatcgtgctattcggctgtgaccggatcagttattgtcggtagtcttcttttggttaaataaggtaccgactgctgggatgctaccgagagaatcaatggcagtgcttggcagcacaactgtgttagcggtgccctttgccagcgcttcaagtgcttcgacattcttgtattgcaagtacagattgccgttatcaatcaggccggcattaatcgaattgatctgatctttgacggcatcggcaatgagtcgctgactttcagcatgaccttgcgcctgcaaaatctgagtttgtttgttggcttcggcttcaagaatagccgattgtttttcaccttcagctttggcaatggcagcctgtttgtggccttcagcttccatgatgttggcttccttttcacgagaagcacgcaacagtttgttcatggaatcctgaatcgtggcgtcaacttggatggaatcgatgttcacccgatcaacattcaggccgtaaccagcagtcgtttcagcaatttgctggaacagcgtttggttaatcgtttcggttccgttcaagacatcgtttaaatccatattgccgataataccacgcaagttagcgcgggtatcttgcaccatagaaagaacggaatccttgttttggtaaacataagcattaacgttggtaatatgatatttcaatgtttcggaaatgcggacgacaacattatctttggtaatgacttcctgttcgtcaaccttcaacggaatttgcttcatgttgacaatttcggtaatccgataaattagcggtggcaccatgtgaaaaccaggctctaaggttgctacatatttacccaaccgttccacaatgccgacttcaccagtatggatgatggcaacgctggagaaaagaatggcaacgacaatgactaggacaacaacaattaacgagatcaaaataatgctattcataaaaatcactccttcaaaacatctaagcagatgtctatgaatttctactgatacgggtgacatgtattaggaacttggcgtggcattaataatgcaaggcatgttccggttttaccacgctgagatacaacggcgaaatagcgttgacaacgaccttgtcgccagcggctgcatcatcttggactcgataatgataatgaatgccataaagggtgatttcgccactcgcggccgaagttggcaacgtaaaaatcgttcctaagagccgttcatcaagcatttatccgtctccttcccagttccgcgattgcgtttggtggaagcctcatcagctttgcaaagcaatcgctatcacacgctaattctaaagcacgggtgagggaaagacaacgatgacgacttcaaaaagcaagttatttgcttatgttggataaaattactattgtttttgcctgcttctattcttattggcctttacttaacagactgtgacgttgataaaaccaaatttcgcgaaaatgattgactttgctccaatggtaaaaaaagagcgtgagctgacccgattagaaaccggcgtgtaagcggcgtcaagtgttccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaatcgcatcggcgattttgaactagatacagtcgttggtcctcgtgggcatagtaaggcagttttattaactttaatcgatcgaaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaaatttgcaaggagaaccgcctcaaatgataaatttattcttcaacaccagttggcgtagagccatttttttatacattgagtggtgcttatgcctcatcgtcacgaaacttggttggcagagcaagaatgacaatctgaacgatgatgaggagtaacgcaattaagcttaacggcacattacccgcatttcgatcaagagttgatagaaatgctgatacgacgttgaaagcaatcaaccaccatggactaacgcctgcatctttgaatcgccgccaaccaactgtcaacgctggcagagctaacattgaccacgcgtaaatgatggcgaaaagaatgaaaacgatgatgattgcaccagtcccaagcgaattcacaagatggtcaatattttggctattaaatccgctaatggccgcgccaccgataataattgaaataattgagaagatcataaacaaaaaagtagggatgatgataatcataccaaacaggatactccaccaatattggctgcgactggattcaccagtaaagtcaccaccgcggatgaagaagtccttaactgctgtaccaaaaccaacatcaatcgtaccgcgcgtgttaggttgagccggaaacggtacaactttctgttctcgactcggcaacaatagaatgaccaagttagcaatgccgccaattaaaggaaacagcaatgccaaccaccaactcatgccgctaaccgctagtaacgggccgataaaactaatgataataatacccagataccaccacggactaactttggcgtcacgataacggcgaatcgttaagctcaattgtggatagccaagatacccaaagattgaaaataccaacgttgtcagcgtgaacatgatattgctgcctaacgaatgactatccatgagagaaaatggaatcgcaatgccgaacagaacaccagcagccaaccctaataaaaattgggcaaggaaaagccaccaatactgtggtcgtgaactaacacccttaaagtcaccggcccgaaagaaaaagtccttaatagccggcccaaaatcgttttctcttttcatcgtgcctcgcctccaagtatttgttaaggcgagtataccatttgcggtcgtctcaccaaaactttataaccttcataaacttaagaattttatgcactggcttcggcatgccactgaacaggttgatcacactgctctcatcatgcctttttcaccttgcgatcggctagccgcaaatccagcagttcttcaatgacattctcccaatcttctggtcgcggcggtgacagccagatgacttttgaaatgtccgtatcatgataagcattgaccaaatccgtgataatcaatttagtttctggccggacttcgttggtcaccttgacgttcaatgttgaaaagtacttgatgtcgcgttcaataatggtgttgtactccttgcccagcgtgaaatcaacacacacataaagtggctccagcaccttgttcaaaggcacattggctgccaaggtcaacaaacaatggtaaaacataaacttcgactgattcctatccaacttaaccgaccgtgcctggacaaattgctgacaatagtcaaagaattcgggatacattctaaagaagtaactgacttcaatgtgatcatcaaagaattcactcctaaacggcaaggccaggacatcaatcaaacacttgttgacaacatattcgatattggccttctcagacaatgtcaactgtacatcaaaattggcttcaaacccttgaatgaaagcccggccgtgctgtttgattgtatcgggaaaaacgatctcctccgacgtaataatgccaataatagcaaggaacgtcccaaaataatcgcactcgctgtcaatcgtctggtcgcttgcggtaaaatgcgcctgataaatcgcaataacccgttttctggtttccagcgtgcgctcgcgaatattgcgcaccaaatcaacaatttccggtgatgtggcaatgacatgcccttgctggaatctaaccaaactgatcaaaaaatacgctttagtctcgatgagctgactcattgacggcgttgcttctgtcatcttcagcaactgcaacagctcatgcagcgtactgcggacattgtcatcaaacccggtttcatcaatatgcgcaaccaccatgattttcgtcagaagcagtctaatcgccaattcatcaccggtcagcttgccatcattactcagcacaataccccaacctttgagcgtatcccgcagagccgtataccgtttgtacataaaggcataactgccaaagtgttcctcagcaaattcggtcagattaaatgctggcggttcgtgcatcagcgtcatcaagatcttaatttgaagtgactgctttagataatgttccaaaaaaaccgatgcattcgtgttgtgatattcatgcaagataacggtagtgttcgtcacttcgatcgcaaaaaaatcactcaagtcgaatgctgcaatatcttcagcaatctctttggtctggcgtttaaaaagataatatgaaatctgcaatttatcttgcaactcgctgttcttcaatttgcgattcggatgctgatcaagataatacagtaactgaagtttcttttgatcgttcttttccatcagttcaagtaatttcacaaaatccaccttgtttttgagatcgtacctgtacgtgccagcaatgttttccctgcaaaacggtaagcaatattggccaaatatgcttgttgttgcgttgttttcccactttgtttgtacctgtccacatcaaaaattcgcacactttggtcatcggcagtaaacatgtccgataaccaaatgtgcaaattttgttgggctgctttttcttccgcttcagtgtccttcacgaattctcatattccttcttagtcaacctagtgtcacgacaatgttggtgcatcccatgcggacctaggttcgacacaagataacgtttcaagatgactgttccaattcgccaacgtctcaatgttgccattgattcattcgcagccctgtccattagttttatcgactaatttaatcactgaatacttacgaatattgtaccattattcttatcctcaattttcaagtcaagtgcaacgatgataacgaattcttgatagtggtctggagaaccgcctcaaatgataaatttattcttcaacaccagttggcgtagagccaaaatatagtaaacattaaatttagagcggtttactgaactgttgcgcctgctacagcgttatcaacaagttgcttttcacttggtgtttggtaaaatttttggaccagtgcgtcaaccgtataattttgctcgatgttagactgtgcaaaactgaatactttaacgttgttgccttctatagtgaaagtcatttttgactcaccattatgacgggaaatgtatagcttaccctcagagtctttcccataaacgatggtgcttggttcttgaagcatttcagaacccccacgggctgcgtaaaccatcattgcaatttgtgaattgctaacatccactgtcttaggcttataactcgacgtttgacctgtggttgagcttgaagcatccgaagcgctcgacttagaactactttcagcactgacggtgttcgttgacgactgtgatgagctaactatagactgcgaactcgcacgtttagaagaagaacgcttggatttcgtagtcttcgttttagagcttgaatccttctgtacctgcgaagtgggaacgttatttgttgatgctgcgacatgccaccaccagccacccaatcctgcaatagcgacaactaagacggcgatgatccaatatctttttttcataaatatccccctaataggctaaatctattaacattatgccataaaaaacgtgtcgtttcagtttatacaaaaaatttcatagaggtctaaactttaaagaatcttagattttgttctacaggattattttgaacttttctaaggaaaattcatagtcacaagagttgttacaagtttgtatcactgcccgccaaatatagaattatggtataatttgctgatgtgttcaagaaatggcttgcagcagtaggttgaatccagtttgagagggttattgtatgaagcagaaaactgattggagcggagttcgtcgatggttaacaatcattgttgacgttgctctgtttaatttcagcatgtggttttcattttatgtgcggttctggccgcaaattccagatcgaaatttctatacttatgagcgctccgctgtttatatttcggcgttatttctcttagttaactttcttatcggtgtttatgtttattataaccgccgaattagcgacatcgttttcaacacagtgctcgggcagggagtcacagtgctcggcctgactatgattacctttattggtcgatggtttgcatttccccggacgattctggcgatttcattcctcgttagtgttgttgttttggcagtttatcgggttgcggtttactacctttacgtgcattttaccgcagataaacacgtggcagtcgtttcttataaagaggaactaccatcgattttggagaactttgattcagcaaagaacaacaaacacaaagtaacttatgttatcacggatcattttgttgaaaacaccaaaaaaatattagataaagttgacatattctacttgacgacaagtctttctgatgatcaacgacggacaattattgacatggtgatcaaacgtgaaaagcatatcatgttgccttcaacatttgataacttgttgatgctccggccaaacatgatgaactttgaagacgagagcattatgggtatcagtgagttcagaattacggcagaagatgccgctgtcaagcgcttttttgatattttggtagcactgttgttattagttgtcacatcaccgctgatgttgattactgccatccttgtcaaagcaacatctcgcggcccagttatttacaaacaaacgcgaatcacgttgaatcaacgagagtttaaaatttataaatttcggactatgaaggcagatgcagaagctaaaacgggaccggagctcgctaaagatcatgatccgcggattacttccgtgggcaagtatttaagaaaattccgcttggatgaacttccacagatatttaatgtgctgaagggcgatatgtccgttgttggacctcgtccagaacgaccattttttgttaaccagtttaatcgtgaggatcctcattattatctgcggcacaatgttcgagctggaattacaggctatgcacaagtctatggcaaatatgcgtctgattatcacagtaaattaaaatttgatttgctttacatcaaggcatatagcgtttttcttgattttcgtattctactgcaaactgtgaaaatcctttttgacaaagtctcttcacaggggctagatgaagatcaaacaccacaaatggcaaaactgcacgagattgttgtggaccaagatattaagcatctcgactaagtgggagatttaaaaatgcagagaaatgaaatcagcgtattgatgtcactgtataaaaaagaaaatcctgcttttttagttgcttgcttggatagtgtgttagcacaaacgttgttaccaaaggaaatcgttatcgtcattgatgggccaatcacatccaaattgcagcaagtgcttgacgaatatcaatctaagagcgggcttttgcgattgttgccacaaaaagaaaataagggattaggatacactttggcaattggggttgaagcttgtcaatatgagctggttgcgcgaatggatacagatgatttaatgttgccgacaaggttagaggagcaagttaactgttttaatcagaatactgatctggcaatttgtggcacaaatattgaagagtttattgaagactcatccaatatcatcagtaggaggcttgtgccagaatcaaatcaagcaattcgtcaattttccaaaaaacgtaacccatttaaccacatgacagtgatgttcagacgttctgatatcttgaaggttggtaattatcaaccgatgcaggggtttgaagattattatttgtgggcaagactcttgaaagcaggttacaaggcatataacattcaagacttcttggttaaagctcgtgtggggaaagacatgtataagcggcgtggagggtggcaatatttgatcaacggcgttcgagggcgcattgctgtttatcacgccgggttggggaatttctttgattttatagtcactactggggtgcatatcgtcgtaagtctgatgccaaacagaatccgagcgaggttttatcaagaagcattgcactaataacgtggtgggagggagtctcttgtatagtcaggattcacagcttaagaaagttcaagaacgaaccctaaagattgctaaaactatcgccgatttttgtcaaaagcataatttgttgtgttacctttgtggcggtggtgctattggtgcgattcgcgaaagggggtttgttccttgggatgatgatctagacttcttcatgccaagaaaagattatgagcgtttttgccaactttggcagatggaaaagcctaagggttatgtgttggagcgaacatcacagcactttattaaccataataactttacgacgattcgcgatccagagacaacatttgttaaaacatatcaaagaaatttagacattgttcatggcattacagtagacgtttttccacttgatcgagcaccaattggcaaatttcaacaaaagcgtcaaaagttatgggcattaatttacgctctgtttaatgaacagattgtccctgttagccatggtggtcttgtcacaggtggtagtcgtttattactcagtacattcagatctccgaatcagcgttatcatatttggaagtacgctgaaaaacagatgatgcggtatgacgacaagaacacaccttgggttactgaattgtgtgttggacctaaatatatgggcaatcgttacccaacagaggactttgcttccgccgtgtggttgccttttgaagacgttaaattaccagtacctgttggttatgaccgatacctccgtcacgtgtttggtgactatatgaggcgtcctaaggttagtcagcaagttccacaccatgatgcggtgtttgttgatccagacactccatatactaagtatcgtggcatttactatttgacaaaaggagaaaaataaaatggcaacagcaattgttatcgcaggtggcgttggtaaacgaatgggcatggaaatccctaagcaatttatcatggtaaatgaaaagcccattattatctatacattagaatcattcgaccgccatccaaaaattgaccaagtcgtggtcgtttgcaaacatggctgggaagataccatgtggggatacatacacgaatttggtatcaagaaagtcaagtgggtgattcctggtggtaaaattggtcaggaatccattaataatggtgtccagttcctcaatgataagtgtgaggatgaagagacggttgttattcatgatggtattcgaccacttgttgatgaattggttctgtcggatgtgattgttaagtgccaagagtatggcacagcagttacttcgctgccatacaatgaacagatctttatcaagaaaacagaagaaacaactgagaaatatattgatcgtaatacactgcgtcgagttggcacaccacaagcttacaaatacggcatgttacgagatgcatacaacgaagccattgccaaaaatatcggcatgactgattcttcttatacgaatacgatgatggttgatcttggccatacgctacattttgccgctgggtctgataagaatattaaattaacaaatacagacgatctggcgttgttcaaagcctatttacgcgagaaggagctgtgagctgaatgttaacccagaatgccatgtatctaagtgacttagataaggtcatcaagggtcaaaaggactggtctgccttagatggccggtcttttttgataattggcgcatccggcatgattggcacttttttgattgacgttttgatgcgtcggaatagtcaagcaaatgctcatatcgaggtctatgccatgggccgcagcagagaacatttaacgcaacggttcttgcattatcaaaacatgtcgaacttccatttggttgtcggtgatgtgaccgatgccctgcctgatgatttgcaaacagattatgtgatcaatgcagccagcaatacgcatccacgggcatacgcaactgatccaattggtaccatcacaaccaattttttaggcaacgaacaggttcttaagcatgcggttgcacatcctgaacagagaatcttgtttctttcgagtgtagaagtttacggtgagaaccgtggggatgttgaaaagtttgcggaagattattccggttatctcgatcccaatacattgcgcgctggttacccagagagtaaacgggtcagtgaagcattatgtcaggcatatattgctgcgcatcatctcgacattgtcattcccagactaagtcgcgcattcggtcctagcatgaagctggatgactctaaagcatcgtcccagttcatcttaaaagccgtcaatcaggaagatattgtccttaaaagtaaagggacgcaacattattcttacgcttacgttggggatgttgtttctgcccttctgtttttactagttcaaggcaaaactggagaggcctataacgtggctaatcctgacctagatttgcatttgcaagagtttgcgggtgcacttgccacaatggtcaatcgaaagctagtctttgatttaccagacgatgttgaagctgccggttattcgaaagcgacaaaggccctgctggatactagtaaaatcaacactttagggtggcagcctttgtttgatcgcaatgagtcattgaaacacactgttgaaattctgagaagtgagttggaaaccgatgcccaaaattagcattatcgttcccgtctataatgttgaaaagtatttgcagaaatgtgttgattctattttggcacagtcgtttcgtgattatgagcttatcttggttgatgacggggccacggatgcaagccccagcatttgcgacgattatgcggagaaagatcaacgagtgaaagtcatccacaagcaaaatggtgggctcagtgacgcgcgcaacgcgggtattaatgttgccagcgctccatttttgggatttattgacagtgacgactatattgccccagatatgtatgaacaactatattttgatatgattgatgggcaggcagatcttgccatctgcggtatttacgatatctatgaaaacaaggacccaaaacagcttccggaagtaagaaaagttttgaccccagagcaaaccttgaaaatgattttggatgcgaaacttatttcagtccatgcagttaataaactttatagaagagagattttttccaaaatcagatatccagtcaatgtcattactgaggatgcggcggttatcattcccattttgcaagcctgtaaaaaagtggttatcaatacaaagcagcagtattattatgttcatcacgttggaacaatttcgtctcgttcgttttctgatcgtgatctagatacgattaacgtatgggagagaaatgaggaaatagttaaacgcaccttcccagcgttgtcatatgcatgtcacacacgtgtttgttgggctaatttcttggttttagacaagatcatggtaagtaagaactggcgaacgattgcggttagaaagaagattattctgtttttaaagaagaattggcggttcatcatcaagaacaaccggctaactaagggcagaaagttagcgtttctagctttagtgattaatgaagtcttatatagacagatcattcttcaaacgaaaacaactttaggagattaaattgattaaaggctcgaataatagaggtggcgagaacttgaaacgcagtcgtttggattactcaattatgaattctggcatttccacattgatatatgtgcttcggttggtcatccaattcgttgcccgaagcttttttattcgatacttgggcgaagtttatttagggctcaatggtttgttcacaaatatccttagtcttttatcagtggcagaacttggcattgggacttcaattatttttgctttatacaaacccttagcggtccaagatcatgagcaggtcaagtcattaatgaggctttataaaagagcttatgaagcaatcggacttgcaatagccgctgtcggattggcaatcatgccgttcttaaagctgattgttaataaagatcaacattttgaaaatttgtatttaatattcttgctttttttggctaattctgttgtcagttacttctttacttataaaagatcgctaatcacggctgaccaaaaggcttatattgtttcgcttaatgattttctgtttttgctggtgacaaatgttttccaaattgtctttttaatattaacatctaatttcattgtctatctgattatccaaatcatttcgaccatcgcttcaaatattacaatttcgattattgctgatcgaagatacccatatattaaggaaaaagatgttcaaaaactagatgcggggtcagttaaagaaattaaacgaaatgttattgggaatgtttcatcaaaaatcggcggacagattgtgatgggaaccgacaacattctgatttcggcgttcgttaatctatctgctgttgggttgtattctaattacacgttgattgttaatgctatacagaatgtatgtacacaaattactaactcaattacagcgagtatcggtaattatgcggcagaaagagatgctcaatcaagctatgtccttttcaaaagacatttttttattaaccacacactagtatttttcacaacaactatgttattgacaatgattaatccatttattacgtggtgggttggtgaaaaatataatctgacatttttgacggttgtgttgattgttgctaattatgcaattcaggtttatcgaaataccggttttgcgtttattgaatcctttggacttttttggtatcaaagaacgaaggcatttattgaagctgccatcaatttatcagtttctttaattttgttaggttggtttaaattggggatcaacggcgtcttgttaggcaccattgtttcttcatttggatttgtcatttggtatgaggcatatgttgtgttcaaacatgcttttcatcgaaaccttgcagaatttgccaagatgttgttaaccaacatgatccaattagcagttgcaactacgattgtttacagtgtcacaaattatgcattgagtttgacaaatttaactggcattgttggcttggcacttcgcgcagtcattgcgctattggcaaccgttgtcctctatgctgttttgtattggcgtaatgatggcacgaaatatctacttagcattgtaaaacggatcttgaaagttggtgcttaaatgaggcttgctattattagtcctgagtttggttttggcggatcgaatatggttgctcgtaatgtagggcaacaattagagaaggaaaatgaagtttttttcatagcttatcaatttgatcgagagcctttgcattcagaccatttttatttcgtcggtaaacatcgtgatagagcaactcgtacaattcaaaagtttgaaaaaggcttgagcgtattaattacgcacaacttttctcctgcaaagtattttaagcaagagatagagacgacgattgaactactgaaacgggaaaaaatcaagacggtgattttaaattcgtttattgcagggacacttttctgtgaggcaatcaagaaagaaattcctgatgcgaaagtcattacttggttacatgaatctgtcgaatttggcaagcatttgacaaggtattatcgcaaccgatttttatttgccgttaaaaactccgatgtgttagtttgcttgacacatgaagccctcaactattataagcagtttaacaataatattcgaatcatctataacccgattgatttgcctgatcatggtcttgccaatctaagtgaacacattatttcgtttactgcgaggttaaacgtgcatatcaaagggcttgattacctttgtcagattgctgctgatctgcctagcggttggaaggtccgggttgctggggaaggatctgctgaggatgttcgagcttttaaaaagttgatagatgaatctggagttggcgataagttagattttgttggtgccaagaaagggcaggaactagtaaagcattatgagagtagttctattttcttgtcgacctcacgcactgaagctcttccacttgtgatgattgaagcactttctttcggcctgccaattgtaagttttgatcatcctggggcacaggaaatcctagaaaaggggcaagttgggctgcttagtccaattggcgatactgggagcgttcatgagcacttgatgaaacttataggtgatctggacctcagacagcaatttggtgtaaaatccataggacgctatcaagattttaaaactcaaaccatcattcaaagatggtatcagattcttaatgacaactaggggagagtaatttggaaaacattcgagaaggttccagagctgggtcagtaattactgagtactacctttacatactgttcgtttttttgattttgcggtcgattaactactatagccttataccgtcagtctttgattctattgtgtttgcactgttggcagttgccggaggtgccatgattgcttggaattgcttagactttttacgtcataagtcattcgtttcttacgattggtggcttataggattcttgatcgtgatgtttatttctagtctgttgaacagacattatggtgtttctggcaattttaaaacaattgtgtggagtgctatctacttttttctcatatatgctcttgcagccaacggacggcttagcaagtatttttatcaaacagttattagaatttttggatgggcgtatttcttcgtgtcgctagtcagtttcggcatgtatttaattcaatatagttatcttcgccctggcaccattgaaacacgtatccgtatcggtttcctggaaggtcgactttttggagcatttggggatccaaacttcggtggtatgtttgcactgatattggtcatcgtttgtatttacggcattgtcgtaaaaagtcatgtttttcctagatggttcctatttacaaacctttttttacaaacctttgttttagttttaacagggtcacgatcagcaatattaattggtgaagccttggcagctgttgttttcgtggctctggtggctagatatttggcggctcgtggcaccaatttattagtcaatattgtagctagcgttattacattggctgtcagtgttgtggcattgacgttctttgttgctagtctaaaatggctgcttgaaaaattaccaccactgtttgaattcttacaaattcatcgaccgcatgggcgcgaggttgtatcactaaaacgtgcggacgtagctgataacagtgatatttccaatatgcgtttttcaatttggtcgagtgccatcgaaatcttcaagacaaaatggatttttggcgtttctccacgtaatatggttgcctatgcaaaagatatgcttcctaaaagtctaattgcccagcaaggattcaagactcataacgcttggattgatgtactggcatctactggtttggtcggttttgtgacgatgattgggttttctatcaagagtgcttttatggctttgcgttcacttcaatttggcaaaaagatgctctcggctgattctaatgtccaattcctaatcgttgcatcgctgattggcttcacgttcttcgtcaatgtcattttctttacaaatgatgtatgcagtttcatcttctggatggttctagggaatatgtattttcaattccgccagcggcaaagtgcactttcttaagcatctgcgttgacatgcaacgccctctttcaagcgttgcctcaggataaattgatcgttaaccatttttaagccggttgagtttgcaagaagcattctcaccgacttttttgtcacatatttttaatctttcttctttgacaagcgatgcggaaatatcatagactaacggagtagctaaaactaagttaaaactgaggaggtaatgacgaattttgaaaaaagttagtaaattggggttcttttttttcattggcgtggggattttaggcagtacacttataacatttggggtatcgccaacacattcagttcaagcggtgatgtcgactaataccaacacaccacgaaaagattttgtcgatgtttcttctaacaacggatccgtttctgtctctgattatcaaaagatgaagagcagtggtgttactggcgttgtcgttaaggtcacagaagcatcaagttatcataatccatttgccacatcacaaattgcgaacgcacgagctgctggtttaaaggtatccgcttatcattatggttggatgaattcaaccacagatgctagaagtgaagcagattattttgttaataatgcagctgcagatggcattggtcgttcagataccatggtacttgattttgaagaaccaaaagtcattgggcaatcagtggatcatacccaaaatatgcaggcatttattgatgaagtaaagcgcctcggatacaacaatgtcagggtatacacgggcccatgggttatttccaaaactaatatgaatacggctagtcttggcaagaagaatatgtggattgcggcttatccaaatgatagttcactttatgccaatagagctgactattctgattatggcgcttggcagtgggcatcggacttgaaatttcctggggtgactgactttactggtagtccccggcagtttgatatttccgctgattatacaggcattttttctaatagtgcacctcaaggcccatatatttctgacggccgttatgtaacaattaccagcaaagattatgatctatggtcgagttttgacttcacttctaccactcactctggagcagaattgttccagaaaacattccgtgctgagggccactataatcatcaaaatggcagcacttactattctctttatgatgcgaaaggcaattggcagggatatatgaatgctgctggggcaacagttgctagtggtgctcaaggcgcttggctgccatttcaagattcatatcaaattaagggatcatacccaatttggactgatttgaattcttggacggaaaaacaggatgacaacaagtatactggacaaacagttcaggcgaccggtatgtatcatcattttaatggtgcaacgtattattctctataccaaggctccacttggatcggctatatgaatgccgatgggttaacgaaagatcgcccggaaggaccttggttgcctaaatctggttatgtcaccatgacggatgcttcagctaacttctggagtaattttagtttcaacaatccaactgctaacgctaatgcttatcttcaccagacgctagttgttgatggccagtacaaacactctaatggacatacctattattctgtatatacggcgcaaagaaaatgggtcggttatcttgatgctgctgcaggtatctttaccacccatccagaaggcgcttggcaaagtcagagtggttatttaactttgacacaacgaaatagtccgatttcaagtaacttttctggaggacagattgcgaataccgatcagtttttccagcagacctttcaaatcggcggtgcatatcatcatgctgacggcactgtttactactcgttgtacagaaacaatggtagctggttgggttacgtgaatgctggtgcaggcacatattcatcagagagtcaaggtgcgtggctgaacttttcatctggcgctacggtatctcaaccaggatattatttctggagtaactttaactggaactatattggcaaaaactcaaacatgctttatggccaatcagtaaggattaacggtgtctatcatcatgttaacggggctatctactactctgtctatgatttaaacggccagtggattggttatgttaattcaggggcaatttcgcttaagtagtttgttagtgtttttttcaaagtatgttatggagcccatggacacagtcttaaaggtatatctaaacattgacgaatccgccaatacctagatataccttttttttagccttttcctcaaaaaatttaaggatgacaattggctatgaggatgtagtattcgcggcgggacaacgtttgttattcaattgtttcttaaaaattgtttttgtttaaaattaagtttctgttatcaaggctccgtgttataattactgatgttttcaaattggggaggggaaaaaatgagaaaagctaaaattattcggacacgacaggtcgtttcaccgttattgtcatggcctttttggtctatttaattatgtgttgcacttagattgtaaacgcgggaaagttttttcgtggtaagtcaacccaaaatgtttttgttaattcgccacaggtgcaacggatgtggccacatttttacgtgcagcttttattctgtcctctgtatagtattgcgcttgcgcattgaataaatcgcgataaatgccggatttagccatgagactggcatgcgtaccatcttggacgagttgaccatggtcaagcaccacaatccgttgggaaaaacgggttgagctcatgcgatgtgacacatagatggcagttttcccttcaatgagctcgtcaaaccgttgataaatttcatactcggagatgggatcaagagcggcggttggttcatccagaatcatgatcggcgcgtttttgtaccacgcgcgggcgatggcgattttttgggcttcgccgccagagacatccacaccatcgtcacttaacgcagtcgtaattggggtatcgattgtctcaggcattcgcttaacccgatcggccacatccgcaacagttagtgcttgccaaacgcggtcacgatcaggctgggtcgttgccgcaacattttccgcgatgctataagcaaaaagccgaaaatcctgaaaaacaacccccagtaggctgcgatattcgtcttcatcgtatttttgaatgtcgatatcgttaagggtgatcgtgccttcagttggtttgaacaggcgcacaagcagtttgatgagggtcgttttaccactgccgtttcggccgaccaaggcaaggcgttcgccaatattcagcgtgagattgatgtgccgcagcgcccactcatcgctgcctgggtatttaaagctcacatcatgaaactggatggcaaattcgttgtcgttgcgcttctcgacaggcagcgagccggacttttcgtgatcaggcagggccagaaaatcgacatagaattggaggtagtcaaccatattcacatacatgccaacttgctgaagaaattggtaggccgcggtcataagttgttgaaaatacccaaccgcgatcatgacgcagccgattgcaaggctaccgaggagggctttggcaccgactaagatatagagaccgatgacagcaacggcgatagcgagatttggccagtgaccgtatttggctatttgccagtcgccatcccaaagctgttgtaaggaattgtcattgctctcgcgttcacggttcatcacgagatcggttgcatggtaaaggcgaataacttgatgattaaaaatgttttccgtgaagttgaagaaataggtgaagcggcgattattggggatgatggtttcgattaactttagttgaatccgatcactatgatgaacgctccagatcccgacaacaactgggaagaataacaagattagaatcatgaatgggtagcggacatcattcagccaagcaatagcagcgactggtggtttcatcaaactaaccagtgtggcaataccaaaaccaattgcaatcagcagtgaaaagaagtcctgcaaacctgttttcatgagcgtcgataagccgccgttgtatgactgcccagcctgagccccggcatatgccttgcgcatgtctggatcttgcagcgtgctgtagctaacagttaatagcttttcggtcacagcgcgatcgagtcgccgtttaactgcagtttcatgatcctcggcgcgcttgttaaaccagccgccgcacaattgtagcaaaaaacgaacggccaaaaagataccgattaatagcatgacttgttgtaatgatgcccgttgctgtagctgattcaacacgagcccaagaaaggcaatgttgagataagggattcccacggttgtgagggcacgcataaattcaactggcagagcggctgagtcgagttcataaatgacccgaaccacacgtaaagctcggactaccgtattacttgccggcttctttttttcggcgtctttaaaggttgtcattggctggaacctcctttgcttcaggttgatagtatttactttgaatatgatacatttgcgcataacgaccattgtttgcgatcaattggtcatgcgtccctgattcaagcacttgaccgtgatccatgaagagaatggtgtcacagaaacgggttgaggcgagtcgatgcgagatgaacagagaagttttccccgaggctaattgagcatactcttggtaaacctcgttttcggcgatggcatctaaagccgctgttggttcgtctaacaccaagacaggagcatctttatacagtgcgcgtgctaacataagtttctgggactgaccgcctgaaagttcgatgccatcatcgcgagtgtatcgggtcataggtgtatgagctttttgtggtaacgtcgcaacaaaatcagctagacccgcgtcttttaatgctgactcgactcgttgaagttgcggcggattcgtcaatgccacgttgtcagcgaggctcaatgctagaacgatggtttcctgaaagacgggggcgaaaaatgaaaaacgagttgctagtggtaatagatcggcgtttaagccgttgatcagaatggtgccgcttgttgggtgtaacaagcccatcatcaaacgagcgagagttgatttacctgcgccattgacgccgacgatggcaagcttttggccggcttctaacgtaaagctgacatccttgagactcgcggttttagcttcaggatagcggaaggttacatggtcaaaatgaatggtgaccggtcgctgccctagttgtgtttgttcggaagtggtgagcgggcgagccggtgttcgcggcttaagcgtcataaattcgcgaagttcttgcagatcgatactagcagtttgcagaccgttaaagtctttcaacaactgatcaagtagggtgatgaaaccgtttgtcatgccaaacatcaaagtaaattgagcaatggatagactgccttgggtgacagcaataaccaaacttccgtagaccaaggcatcgcggcataatccggcaagttcgccaacctgtgtccctaagaaatgccgcaatgagctgcggcgttgccaagcatcttgaagtgaaaggagtcgatcaagatgggtgtgataccaaccggccatcccaaacatccgaatatccttaccgttttcaagcgcataggcattgcgggagatataagcttgctggcggctgagcttattccaattgacgttgtttgtttgataccacttgcggtaccagctcagcccggcataactgatggcagcgctgagaagaaccaatgcaaacacccacggaatgacggtcgacaaagttgcaaggaatactaacaaggtcgcgatatcaattaaggagccacggccataaatataaatagcctctgcaccagcatatgtccaactcaaccctttactgaaagcggtgtgcgccaacccttgaactttgccgctgctgatttggtcataatccagatcccattgtttctgatgaaagtccatctcaatgacggtacgtaatttggtgcttttaacgttatcgtgggtcattaaaagataatcaacttcactggtaatagctaatcccaagccggttaaaccggctaaccaagcaaattcccccaaagttgcatgctgcacgatggcaccgaccaacaatgccggggtgaaaactcccagcaaggctgcagccgctttatcaatggcgagaccggttgcggtccaagcaagtgacggttcatcttttcgcaagtaagttaagtaccaccttaagttgttgaacaacccgtattttttcatgtcgatcacctcgttgatcttaatctagcaaaaaatcggccactcgcggcagattatgcgtgagtggtcgatttaacggcgtgaatgggaatcgcaatctcggtgacaaagacggaagcttcatattggcgattgatcatgccattatacttggccacgagtttgttgacgcgccggataccgaggccgcgtttgtcacttttggttgaggcgtactgataatcgatttcttgatcggcaggccgggtgttggtaacggagatgtaaaactgttgcttgacgatgccgatatacaaccgcagttggcgcggctcaccggccggttgctcactgatcgcttcgatggcgttatctaataggtttcctaagatgacaaccaaatcgacatctttaattaacggcgtgctgccgacaatcactttttcattgacggggatgtgcaaccgttcggccaatgtcagcttagcattgacgatagcgtccaacatggcattgccagagtggactagcggatcaacttcgtccagtttgtcttctagttcgtcgagataggctcgggctgcctgcgtattctgattatctaagtaagctttgagcgcctgtagatgatcatggtaatcatggcgccatccgcgcatattggcataaagttcctgcacttcttgcgaatattgggccatcattttatcgaggctgcgggcgaatacggcgtcctgatcgttgaggaattgacgcattaagacaaactccaaggtgccggtcaaaacggtgctgcagaaaagcacaaaccgcacacttggcagcggccaaagccaccaaccacccaaggccagcaatgtgacagccagattcaaaccgcgcacaggccaattttgttgtcggcggaaggtccaccatagaagcaggcaacagccaactgtcaacaggccgaatgcggctaaccaccaccattcattcactgtcatgagccaacccccgaaaatgtttaaagaaggcctgtttgacaagaggcgcttgttgtcgtgaaaccgggtaactggtgccatcagccatgacgacggtgtttttctcgagttgcgacaaaaaattgaggttgatgacaattgatcgatagatttgaatgaaattttcgtcgagttgaggaagcaactcttttagttgaccagcgaccgtgtacgtcattttctgggtgtgcacctgcaagcgatgatcggttacttcgatggcactgatatcatacatggcgacacgctgaatgccgttggcggtggtgaaggccaacagctttggttgcgtttgcgcggcgactttggtgatgagatgctgcagcttgtcacttgtaatcggtttgatgacataatcaattgcgttgacatcataaccgtcaaaaacgaattcatcatagttactgacaaaagcaatcgccgtggccgcgtcatgttcccggatctgtttcgctaacgtcatcccatccatgcctgaacctaacttgatatcaagcaacaacagatcagccggctgatcagcaaaaagaaaggcctctgcagttggataggccgtcacttgtaaaggctgcgtgggcgtggtcagttggctaagcaactgagttgttgcttgtcgcgtggctgcctgatcgtcaatgatggcaatgtgcatggatagaagcctccttttctgaatttagttcattgtactgcaactgtaccaatcatttggtcgcttttccagaaagctagctagggtgagtcagctttttttgactgctgacacttcggttgctaccgagctgccccgcgctcacaaaaaaatcgcccgaattgtgtcggacgattgggtggtaaacttcgattagtgaagctcaaccttcaaggccaattgcttgttggcaccagcagatagcgtggtgttgccgagcttggtgtaccagtcggttggttcgccagcttgatctggcagaccatcgaatggctcaacggcgatgaaaggtgcctttttatgttctgggctccagatggtgagatatgggaagtcgctgatatcgagggtgatgctgtggtcatggtgcggtgatgcgagggttgccttggcaatttcgctgttagcgagaatcacgagaccaccatcaagaagatcatgtgtcaggggcaaacgattgccttctgcgccggggatgtcctcaacatcgccattgcggaatggcacagggccgatgctgaatcgttgtagtgggctgtttaatggttcaacagtgaggtcgtaatcgtcgaaactgccatcagctttcaagccgacattaaaggcagggtggaaccctaaagcaaatggcattgatttagaatcgtcatttgtgaccgtgtaatgtacgctgaggccgccgtccgtcaacatgtaagtgacagccaaggtatactcaaacgggaacttcttcaatgtctcagcattttgatgttgcgtgaaggtgaccgctgagtcgctcttatcgctgacatcaaagtcatagtcacgagcaaatccatgctgactcattggataggtttttgcgcctaaccgatattgatcctgattagacttcccgatagatgggaacagaataggcgcatgccgattccaaaaagtcttgtcccctgtccagacatactcatagttgtcggctttatttaccagcgactgcaattcagcaccgcgctcggcaatgcctgctttaaatttgctgttttcaattgtgatcaagttgaattacctcctaatagacgaaaacgcattcaataccagtctaccactggatcactgacctgcaatgattgttagcaagttttttgaacttcattttgatgtttgcagtggtcacaaaaacatgtccgcagtcataaaaaaagaaccgatcatcatgatcggtcctttcttgcaactatggttaaagattaaccttcaactttgtcagtccaaggggttgcagtttctgcaagcaccttgttcaaacgatcgatgttagccttgccttcggtctgcagccacttcttaccagcagcttcgccttcagcagcatatggcttaacacccggcttccaagttgcacggccacagagaacaccattaaaggctgaacctgcttgcttagcaaacttgagttcttcaaggaacaattcgttggtgacaccagcggacaggaagatgaatgggagatccgttgcatctgactgttccttgtaatacttagcggcttcttccttgctgtaaacaggggtaacgccgtcatcggtgtagccttcaacaaacttttgatcaactggaacttcaagcttcaaaacagaaacattgtattgcggcttgctgaattccttggtgatcttgatgaccttttcaggcttagctttagcccatgcagctgtaccagtttcgttggtcttaccatcgtaagaaaccaattcaaggaacagtggcaggtcattagcttttgcttcagcaccaacacgttcaacgaaagcatacttgcgatcattgatagcgtctggttcatccggatcgatgtagagcaagaacttaacagcgtcgccgccttcgttcttaatgcgcaaagcactttggttgtcgatcagatctgggaaacggccaggttcggtagcatcgtaaccagttttttcatatgaaaggagtaggccagacttaggatcgcgaaccttagcagccggcaagccatattctgggtcaagcagaatagcgctggcgtatttggttaattcttcagagactgccttcttgaaatcaacaatcgtggtttcatcagccggcttgttagctgcagctgcaagcatcttcttcagggaaccgcgttggtcaatggccaaagctgagatcacattgtcatcgtttgacaattgcttcaagtgcttcaactgaccagcagtaagtttaacagacatgtaaaaatacctcctaggtaatccttaaatgttcagtacctccttagtatagaacaaaaaagaagtaatagacatttttcgcggagcattttcatgaaaatcaaagaaaaagcgcggataataaatggtttcttgaaatgatcacccgacgatgagcctaggcaaactgcgtgctatactctaaacatattgagaatttgtaaagataggtgaaatgcatgactgatttgatcacgccagagctggtctattttctgaatacacccacgcaagcagctttttttaaaacgattagcacaacacttgttgaccagcaaattatggcgccggctgggaaagaagcgttgatcacacgcgagcagacatttccttctggcatgcaactaaatgaagtggcagatggcttgccgaatattgccattccgcatttggaaggcgaattagtgaaacaaacgcggttggtggttgttcattttgctattccggtcgccttcaaagatttagccgatgctagtcggattttaccagtgaactgggtgttcatgctcatgaatgctgagccgcagaaacaaccggaacgcatggcacagttgattcgcgctttaacgcaatcgccagctgcgcaattgaagcgactatttgctgccaaaaaagccgctcaagttgtacggttgctgacaccgcttatgacagaagcataaaagaaagttgagatcgcatggatatttttgattcacacacccatttgaatgacacgccctatcaaggcaaagaagccgagtatatcgaaaacgctcggcaacttggtgtcaagaagatggcgattgtcggctctgacacagctttgaatgccggcgcattggcgttggcccaccagtatgacaatttatatgccattgttggttggcatcccgagtctagcaaggattatgacgcggccaaagaggcattgttaatcaagcaactggcggattctaaagttgtagccttaggcgaaatcggcttagattatcactgggatacctcgccacgggaaattcagcgacgggtttttcgtcggcaacttgagattgcacgttcgttgaaaataccggtgtcaattcacagtcgcgatgcctttgacgatacctatgacatcttaaaaaaggctcatgttgaagacttcggcgcgatcatgcatagcttcaccggcgatgcaacttggggtcaacgttttctggatctgggtttatacatttcatactctggcattgtcagctttaaaaatgcaccggaagaacatgccagtgccaaaattgtgcccaatgatcgactgttagtggaaacggatgcgccttatctcacgccgacaccctatcgtggccggcagaatcaaccgggctacacgcggtatgtggtggaggccttggcgaaattacgtgaaacgacgccggaagtgattgccaagcaaacatgggacaatgcccatcgcatctttggattaaaggaaaaagcatgacaactatcaaacaagtcgtggtcgttgaaggccgcgatgatacgaaaagattgaaagaaacttttggtgccattgacaccattgaaacccgcggcagtgcaattgacgaggcaacgctcgaacgcattcggcaagcacaggctaaacgcggtgtgattgtgctgaccgaccctgatttcccgggtgagaaaatccgcaaaactatttcccgcgcggttccaggggtgacgcatgctttcttgccgcgtcgtgaaggcgtgccggatcataaaggctcgttgggcatcgaacatgccaagcctgctgcgttgcgcgcagctttgcagcatctttttacagaaatgccagatgcaccgcaagtgattagtcagcaagatttgctcgctgctgatttagtcggtggtgtcggtgcccgccaacgtcgggaacagttaggcgagttgttgcatattggctacacaaatggcaaacagttgcttcgacgactcgcagagtttcaaattagccgcgcagcttttttggctgccatggaccaagtagatggaggacagcatgacaaaacctgaaaaagttgcgcagccagcggtcaccaacgctattttaaagcgccatggtttccatatgcgcaaaggcttaggtcagaattttttgaccgactccaagattttgcaaaaaattgtgacagccgccgatttgacccctgaggatgatgtgatcgaaatcggcccagggattggtgctttgacccaattcttagcggacagcgcgcatcaggtggtggcacttgaaattgatgataggttgctgccgattctggatgaaacattggccgattatcctaatgcgatggtcgtgaatgaggatgttttaaaaaccgacctaggcgcattggttgccgagcattttgatggcaagcacaccttaaaggttgttgccaatctgccgtattacatcaccacacccattttgctccatcttttacgcgcacagctaccacttcatagcatgacggttatgatgcaaaaagaagtggcagaacgattaagcgcaacgccggggtcaaaagaatatggtagcctgagtattgcagttcaactcgttgcgagcgtggcaactgctttcacggtaagccgtcatgccttcgtaccggcacccaatgtcgattcagccattgtcaccttgacgcagcgcaccgaaccgcttgcagctttaaccgatccagccagttttgatcggctagttcgcggcgcttttgcttcacggcgaaaaacactctggaataatcttgtggtcttatttggcaaaactaacaaggctgccattcgatctgctttaacaaccgccgccattgaccctggtacccgcgcagagcggctttcaattgctgattttgctcggttagatcgtgctttgcgagcggcggatttaatcagtcaggctcacgcttaagcacgataaatttttactaaaaacaccagcataaatcgcttgcagaaataagaaacgcgtggtataattgcaaatttcttgctttcgtgctatgatagactgcaagaggtgaagtgcatgccaatcacactagcaagcatcaaacggaagctcgatggaaaaatcggtgagaacttaacggtcgttgcacaagctggacgcaagaaagtgacgcggcgacgggggactttgaaagaaacctatccggctatttttgtggtcgatctcgaccaagatgaaaatgcgttcgagcgtgtctcctacagttacgcggatctcttgaccaagtcaattcagatcaccttcgaaggcgaagaaaaagcctcataacattgaattgttttaacaattaaatctgttataagaagacctcgatgtgagttgcatcgaggtcttttgctgttttgcatttcggatacggaaacagtaagttacgcatcgttacgcgatttttaccgtgtatcggtgaaaatcagcgcataaaacagtatactaaaaataactatacggtcgatgcatacaacggggcttgcggtgatagtgattgaccggcaagcgtatgggtcgccagagactggtggttggatggaactgatcgaaaaagcaccggccaagattaatctcagcttggatgccttgtatcgccatgacgacggcgaacatgagtggcagatggtcatgacatcggtcgatttagctgactatgtgatgattagcccgcatcgcagcattcaggtttcgacagatagcggcttcctacctgaagatccgcgcaatctggcctacaaagcagcgttggcgctgcagcgtcacgccaatatccgtcaaggtgcgcggattcatattgaaaaacatattccggtcgccgcggggcttggcggcggctcaagtgatgcagctgccgttttgcgagggttgaattcgctttggcaactcggctatagtcggtcgcaattagcacggatcggcttaagtgttgatagtgatgtcccttactgtgtttattcagagacggcgctcgtaactggtcgtggtgatgtggtcaccccacttggcagcttgccgaatttttgggtcgtgttggcaaagcctcgcgtttcagtatcgacgccgaccattttgaatgccattgattatgacgccggtctgcgccatcctgatacgcaaacggtggtggcaggcattcaaaatcatgactttgcacaaatgacgagtggcatggcgaatagccttgaagccatcactgctagtcggtatccggaaatgaccgccctcaagcagcggctacaaaagtatggtgccgaattcgcgcaaatgtcaggcagcggcccaacagtttttggcctgtgccaaaagcactccagagccatgcgggtttataacagcatgaagggcttttgccgcgaagtttacctattacggccattttgtttatccgccacgggtccacggtttaggggttgatttttaggtaacgctaaaccatgatggggataggaaaatggaggggcggttgtcatggaacaagttcaaccaaacaaggcattcttctggggcattttactgaatacaatttatattattgctgaagtagcctttggcatcggcattggatcggtggccttggtcgcagatgcggttcacaacttaggcgatgtgttgggactcggattagcgtggttcgcagattggctgtcaggacggcatcctactgtcgaacggacttatggttataagagttcttcgattttggcagctttggctaatgccgcgttcctattagtggctatgggtgccatcattgttgaggcggtcacccgactctcacaaaatgcacctgttgaaggcggctggatgatgctcgtagccggtgttgggattattgtcaacggcgctaccgccttgctattccatggcggttcgcaacatgatttgaatattcgcggcgctttcatgcacatggccgccgatgctggcgtttcgcttggcgttgttcttgccggcggactgattttgctgactggctgggaatggcttgatcccgtgatgtcgatcttagttgccattgtcgttttggttggcacctggaatttgctgcgcgatgcggtcaaccttgccatggcagcagtgccaaaagatattgacccagtggcggttaaaaagctcgtgaatgcttacccaaccgttgcttcttgccacgacctgcatatttgggcattgagcacgaccgatgtggcgctgaccgtccatgtcgtgcgcacgaccacagttggcaatgacgacttcctcgatgcgctcagcctctctttgcgcgaaagctttgatattgcgcacacgacgattcaggttgagtatggtccatacgagccgcaaaataaaatggagaacccttattaatcaagtaattaaaaaaacgttgtgtccgcatggccaatacgagcacaacgttttttatgtggttgtcaaatgattcattctacgattatttttttagcgcagttgtttacgggcattgtaaaagcgtggatagctgcggtaaacggcaataaagctaccgatactggtggcgcccagtaacataaaggtgaccatgatctgatacatgatggctttggtgggatcaatacccgcgaaaatcaaccccgacatcatccccggcaagctgaccaaccctaccgtttttgctgaatcaatcgtcggcgccatcccagttttaattgcattgacaatgagcgattgactggcttgcttgagatcagcgccgagtgccaaacgttcaaggacctgttgccgtaaatcattgaattctgtattcaaactgcgataagccaagccaattgccaccataacgttgctggcgatcatgccgcaaattgggacgatttgtgacgggacaaaacggatggctttgaccgcgaccagcatcaccagcgttaacccagtcgcggtggtgatcgccaacaaactcgtcacgagcgcatttggaattgtcccggcgcgttttttagcgttccaagcggcgttaaaaatgatgaccgcaatcatggccaacgtcagccagacagtatcggctttgatgatgtaggtcaggacgaaaccaacaacagtcaactggatgacagcccgcacaacgccgataatcaaatctttggtcatgccgagatcttcttttaggttgatcgctagtgcaatcaagaccaagataagtgctagcaataaggtgatgggtgacacaatgagctgattactcatgagcggcctcctcgaattgtccggcaactagccgcagcaattgtttcgcggcttgaatctcgccttcatcatgggtgacgcggatcaaggtgatgccttggtcattttgtttttgtaataaggcatgaatgaccgttttggtgtcaggatctaacccagcagtcacttcgtcaagtaacagcacttttggcggaaagaaaagatgccgcaacaacgccactcgctgacgttcgccgccggaaaggtttttgaccggatcgtcgagcatggttttggctaaatcaacgctttctaaagcacgctcggcttcttcacggggcattttttgatgacgaatggtgaatggaaactgcagatcatcagcaacggtgccatgaaacaacgcgggctgctgcgcacaataagaaacttcgcggcgataactgatcggatcataatcgtcctgcggtttgccattatagcgaatgattccgctcgttggtgttagcagcgtcgccagcagacgaagcaaggtgctttttcctgaacccgaatgaccggcaatggtaagatctgcaccccatggaatcgtcagattgatgtcatgcaggatcgcatttttttccggcgcaaacgtcacatgactcagttcaaaacaattcatgacttgccctcctcattttttctctttataatcattctaatatagaatggcgtaagaagccaatcagacgtagcaatttttcagttaaaaagaaacacaagatgagcaaatgcgaacgttcgttgaaaaaacaacgcaaaagggtcgaaattttcggttaaaacgtttatacttgttgagattatcacgcaatgttagtgtagtgctaaatattcggtgttaggagcgaaatgatgaaagtaagacgaagtgaccggttaattgatatgacccggtatttattagaacgaccgcataccttgattccactgacttttttctcaaaacggtatgagagtgcgaagtcttctatcagtgaagatctggctattgtccggcgaacatttgcccagcgacagacgggcattcttgaaacggtgccaggcgcagcaggcggtgtgcgctatattccgatcatgggagaagatgaggcggaaaactttattgccgcaatgtccaaacgtttatccgagacagatcgcttattgccaggcggctacgtttatctttccgatctgttaggaacacctagtgtgctacggcaaattgggcgattaattgccacccaatatcgcgaggcccatgtcgatgctgtcatgacggttgcaaccaaaggtattccaattgcgcaaagtgttagtgagtatctgaatgtgccgtttgtgattgtgcgccgtgactccaagattacggaaggttccacagtgtccgtgaactatgtgtccggttcatctgcgcgaattgaaaagatggaactgagtaaacgcagcttgccagctaactcaagggttctgattgtggacgacttcatgaaaggcggcggcaccgtcaatggcatgaaggccctgattgatgaattcaatgccaaaatggtcggtatcacggttttcgctgaaggtaagttcgacggtgatcggatggtcagtgaatatacatcattgattcgggttgacaaggtggatactaaagccaatacgcttcatgccacagctggcaattttctagatcagaatcgtcaactactcgaggtggctggtcaatgagtgcttatctcggaccggtcagaactgcgatcatcacgtttccgtttttagcgctggtgttggcattaccatttctggtcgtcgtttatcgacggtacggtgcctttagctggtggcgtgcagtcgtgatctactcgttcgtcttttatctgctatcagcctactttttgattattttgccgttgccttcgcgagcagcagttgcgcagttcaccgggcctaaatataatctggaacccttcatggcgttgcgttatttcgtgcatacaaccgtgttcgtgccaaccaatccgcatacttggttggcagcgttaaagcaatccgctttcattcagccgttctttaacgtcgttttgacgattccgtttggcttttacttgcgctattacttcaaacgcagcgtgccgcagattattttgatgagttttggcttaagtttattcttcgaactgacgcaattgtcaggactctacggttattatccgcgtccgtatcgactctttgacgttgatgacctgattttgaatacgacaggcggctttttgggcggtgtgtttgcgccaattctgatgcgcgcgttgccgtcacgggacatcattgatgcgaaaagtcaggcgcgcggtgctcaggtgactttggctcgccgatttgctgcgtttatcattgatttctttctcttcagtgggattattggcgtgttaattcaaatcttgctgcatttgctgggactggatcagctaccaggttttctcggcaattatgtcctgccgctattctttgtctttgttctttggccagcatttaatcaagggcagacactgggaaaaagtcttgtacgaatcaaaatagttcggacaaatggccagccgattgggttctggcgtctctttttacgtgagagtctgctttacgggctggctttgccgagctttatgggattgaattacttttttggcgagtatttcggcgccttccatcgaaccgaaatcaatttagcggcgctgggattctttggcctcttgtcgctactctttctcatcaattttgcatgggaaatcatttcgcgtcatcaccgtttcttttacgatgcatggaccgataccacccaaattagcaccttccagtcacaaccaaaagatcctgttgctaggcaggattcagccaatgacgatgacatacaaaagtcataagccaatcatagtcaacaacagacccgtggcaacatgggtctgttgttgtggacagccacagacacaagccacccacttgttgtcagcttcccgtggctgggctatcatgaagacagaatattaggattggagcataaacatgtcaaagaaattcaccattattcttgcggccggtaaagggacgcggatgaaatcaaagtattacaaggttttacagccggtctgtggcaaaagtatggtcgagcatgtggtgagtcaggtggaagccatccatcccgatgccattgtaacaattgttggccatggcgcagaagcagttgaagaaacgctaggcaagcgcacgaagtttgttttgcaatctgaacagttgggaactggacatgccgttttacaagctgaaccgttacttggtcaaaaagaaggcgcaaccctcattatcagtggtgatacgccattgtttaccgccaaaacgttgaatgatttatttgcttatcacgaagccaagggcgcaaaggcgactattttgactgccagtgctcctgatccaaccggttacggccgcattattcgcgactcagacggcaatgtcgtgaagaatgtagaacaaaaagatgcaacaccggaagaggcattgatttctgaaatcaataccggcgtctatgtctttgacaaccaggctctgttcaaggcgttgcatcaagtgaataataataatgcccaaggcgagtattatttgccagatgtactaggtattttgcgcgacgctggcgaaaaagtggctgcctatcagatgccagattataccgaatcattgggcgtcaatgatcgggtcgcattggcgcgggcaacgcgcctgatgcagcagcgcattaatgaacagcatatgcgcaatggtgtgaccttaattgacccagcaacgacttatatcgataccgaggtcaaaatcggtgccgataccgtgattgaacccggtgtttacctgaaggggaaaacagtcattggcgaagattgccatattggtacccactctgaactagttgatgccacactggaaaatgatgtcacagtaactagttcaaccatcgagcatgccgtgatgcacgctcatagtgacattggtccaaattcgcatctgcggcctgatgctgacatcggcgaatacgtccatctaggcaattttgtcgaaattaaaaaagccaagatcggtgcccgcaccaaagttggtcatttaacgtatgttggcaatgcgaccctgggaacggatattaatgttggttgcggcgttgttttcgtcaactatgatggcgttcagaagtgggaaagcaagattggcgatcatgcctttatcggttcaaattccaatattgtggcgccagtggatgttgctgaccatagctttattgctgctggttcaacgatcacaaaagatgtcccgtttcacgcgatggccatcgcccgcgcacgacaaaccaacaaagatgatttttggaaacgcctgccgctggcaaaagatccagattggaattaggttataattctattcatgtgcttgctttttttcgtcagtccgctaagatttctgtggaacaatttttcgcagcccataacaattcgtggaggaacatatgtctgagcaatacggtgacccgagattaaagatttttgctttgaattcgaacaagccgttggcagagaaaatcgctgccgaggtcggtgtgaaactaggaaagtcgtcggttaagcggttcagcgatggtgaaattcaaatcaacatcgaagaaagtattcgtggggatgatgtttatctcatccaatccacttccagcccggttaacgacaacttgatggaactgttgattatgatcgatgctttgcgccgcgcttctgcgcatacgatcaacgtggttatgccttattacggttatgcccgtcaagatcggaaagcccgttcacgggaaccgatcacagccaagcttgttgccaacatgttagaacgtgccggcgccacacgtgttttggcgctggacctgcatgccgcgcagattcaaggatttttcgatattccggttgaccatcttgtcggcgccccattgttggcagattacttcttacggaatcactacgatggtgccgacaccgttgtcgtgtcacctgaccatggcggtgttacccgtgcccgaaaactagcagaattcttgaaggcaccgattgcgatcattgacaagcgccgtccgcgtccgaatgttgctgaagtgatgaatattgttggtaatgttactggcaaacaatgtatcatcattgatgacatgatcgacactgcgggcaccattacgctcgctgctcaagcattgaaggatgccggtgcgaccgaagtgctcgtggccgcgacccatgccatcttctctggtccggcagttgaacgcttgacccactcagctattgaaaaggttgttgtgactgactccattaatcttccagctgacaagcatatggataaactggatgtggtttcagttggtccgctgatgggtcgcgccatcatgcggattcaggaaaatcgttccgtgacaccgttgtttgaaaatcggtttacgaaatagtactaaaaaagctgcacctatattcaggtacggcttttttatttacctgcatcattggtgttgaagcaaataaacgacatatagtcgcaagaaagtcatataatgtgaaaagttgcatagcgactatcgtgtaaatgcttgattggtgatgttggtgacctttttctattccgttctactgctggatccaccgttagttttgtttgccgagacagtaaccaactacttgcatcaaacaaagcgtcattagattaacagccactgagattagctgaaaagggggcacaaccggcagatgcgaatgggattagctcacgatcagtttttgttagtcaaacaaggcagcaaaacaattgagatcagactcaatgatgaaaaacggcaacaattaaaagttggcgatacgattgtgtttgaagacaccacaacggcacaaacacagcgcaggacagtaagtgcactggaaaaattcaccagttttgctgagttgtatcacaaatatcgcggtccgcaggtaggcagtgcaccaacggattccgaaacgaaaatggttgcagatacgtatcagctatacacagcatggcaggaagcaagctttggtgttttggccattcatttacaaccagcattttaatgacaatgacaaaagcgacagtcatcatctgaaatagattaggatgactgtcgctttttatgtgcgttgatgatcaataaaccagacttttgaatgctttcttagaagtcaccaatgactgtcattttttcaagctaccgctgtaaatactgtgccaatttatcagagcagttttaagaagatggtagcgatgatgactgaggcgacggaaactgtggcaaatccgccaaccagcatcttcggcatcatttgttgggttaagtattcctcttcatcttcggttgttgccatcgctcgcgccacttccgaagtcaggatgtagtccgctgggaagccaaaaagagctgtcagcgagcaagaaaatgccatttgccaagacataccgaatggtttagcaagtagccgcgatgctaagaacatgcccagaacgcccaaggcaattaggacaatgatttggaggacaataccaccaagcacagctggcgtggtggcactcagttgaccaaagacataggcgagcaagccgtacatcaaccagttaaagacgccagccttgttcaaagcattgtcctcaagaaaaccgatttgatgcgcgataaccccgaagattaaacaaaccacattagaattgatgacattgtttgtcaatgtcccaaaccctatttgttgaatttaaattaatgtacagctatgaaaccccaagctcttggtaaagaaccaagttgtcaaacaagcgttaatattcaattattcatataaaaagtggccccgcgcaaatactgcaacgaggccactttttatatttatgggataaagcgttgtacaagatgattattttaggttattagacctgttgatcttgctttaacagatcgcgaatttctgttagcaattcttcttgtgtcggaccagctggtttggccggctttgacggtaaaatacggttaatacctttgaccagcagaaagactacaaaagcaataatcaagaagttgagcacgtcattgataaaattcccatatgtaaacttggcgcccaatatcgtgaaataaagcccgctgaggtcagctttgcccgcaaacatggataaaatcgggttgataaggtttttagttaaagaggtgactaaaccagtgaaggcactgccgatgatgaccccaacggctaagtctagcacgttacctcgcatgataaatttctgaaattcttttaacataaacagcaactcccttcaaaattagtatactgaaatcaacacttatgctgcatctctgcggcttatcccagatgccaaacccgtaagaattcagcaatcgcaatcaagacaatgaggccaaatgcgacagcatgccgtcgcttatatagaaccactaaggcgaggtattcgcgaatcaccgcattgggtaggaagtagaacgaagtcgcgccgccgacaccattggcggcaatgccagccatgcgggcaaagatgcctgcgcgaaacaaatggtaattatttgtgaaaaagctagccttataaggtgattcaccaatttcttgagtaatgagacgtttggaaaattgcatattttccaatgtggtggttgactgatcctcaagaagcgtgtcaccttcagggatgccttttcctaaagcgtatcgttgcatggccatcgcttctgagatggcctcatcgctccccttaccgccagaaaaaataattcgcggcgctggtcggccctttttgatttgtttgcgatagaacttgatcgcagcatcgattcggctcgccagcaacggtgaaacttggtcgccatgtaacaaaccggcgcccagcacaatgagaaatgtacgattgtgcggttgcggacgaaagttatacagaatcaaaactgtaagaaaattatacaacgttaagagcacataaaagccgccgagaccaaaaaagattgcaagagagaagtacaacggatcaggaatgaaccggcgaccaaaagaagcagcaatttcgatcagcaacaaaccaattgcaatatataaagtcagcatattgctcaatgaatgaccttcacgccgccaaaccagaatggcattccacaacaaccagaataaatgcaacgcaaagagcaaggcaacgatcaaaataatgatcaggaacaatacgccggtgaccgatattagcaacaaattgcctgaccttaaaatggcaatcgctaacgccacaagaaacgtgaccgcaaaaaaattaaacaagacaccattaatcaaccgtcgcggctccacggtgaaactaaaagcgaagatgacacctaatacgatcggtatcgcaaaaataataaaaagttcctgagctgacattggaaagtctccttgtgtagaggttaaaaaatgattagggtataatgtgattaaaagcggaggtaatcaacatgatcgatcctgtgtttggccgaaaagatccaaagttagattatcatacccggattggcgcatatggcgtcataccggatcatagtggcgctcggttgctgattctgcaggcacccaatcacgccttattcttgccgggcggcggcgttgaggaaggcgaaacgccagaagtcacgttggcacgcgaactgttagaagaatttggcgcaaccgttcatgtcacccaaaagttgggcaagtcatctgaatatttttactctcatcaccgtcaaacagcttactatcatccggcaaccttttttgcttgtgatcaattggcgcttgtacaagatccgctggaaacttttaataccttgatgttaatgccgattgacctagtcctcgctgagctgaaacgaccgacccaccgttgggcagttgccaaatggctagccaatcaacctaagcgataaggcagtcatcaatcgttaaagtgtggatcaatgagaccgccattcagcagataatgctggaacttttcataaattggcgaaaacaggttactgtcttgcgtggctagcatttcttttggaaagtagaaccgtttgtcaccggttgcccgaccgctaagtgccgcgactaacggtgatagggtggagagctcctcaagcgccccatctttttgcatgatctcgatttgcgtttttggatttgcggaagctgggtcgtattggtcatatggtaagtcaaaactatcattttccgctgtgtagtagtgcgggtcaaagccggctgatgctaccaaatcccttaagcgtggcaagagataggctgtttggtcagtaaaggtcacagacttcagtggtcggcggttcaagaagcgatcagcaaaatcgcttaagatactgtctggataatctagccagtaagtgaagtaagtgtttaacacgccatcgtcgagtttcaaatagtcggtgaggttaaaagtttgttcaaaaaatggcacgagtagccgcggcgaaaagccagattcaaactgaccggactcatacaggaatttggcacgttttagcagatggaaaagaatgacttccatgccacgagacacagggtggaaataaacctgctggtacatctgaaaccgactgacaacataatcttcgaccgcatgcatgccgttggcttcataagcgatgccatccgagtatggtcgcatgactcgcagaattcgcgaaaggtcgaagagaccatacttcgtgccggtgtaataagcatcgtgcaacaaataatccatccgatcagcatcaatctgactggagatcatttgcacgacttgcggattcggataggtgtggttgataaccgatgcgaccatctcaggaaattccggaccgacaccacgcagaattttgttcacgttcgtatgcggatccgtgagaattgctcgcgtaatcgcctcgtgatcggtgtcgaaaatgtgctcaaatgtatgcgaataggcaccgtggccgatatcgtgcagcaaggcggcacacaacacgactggccgttcggcgtcatcccataggccatcgccaggtgtttgtgtcggatagttgttgacaaagttgtcacacatctcacgggcaatttcataaacaccaagtgaatgggcaaacctagtatgttcggcgccttgaaaaacataatcagaaacgccgagctgtttaatgcggcgtaatcgctgaaattctggggtattaatcaggtccagaatgacacgatgttgcacatggacataattatgaactggatcgcgaaagactttttcgcgaggtaacttttcaaatagcatcatgttctcccatcttttttaggctgcgattgcgcgtgtgcaaatcggcagtcgcttctgtcagcgccttatggtaagctggatcgcgcaaaagggttggcattgaattcatatcagcggcgatgccagtgtcagccaaggcatttagcaaggcgaccgttgcttgctcaagcgttaacggtcgtcccagcaagtcgctaagagtcgtcatggtttcggatcgaatcacggggaaggtaaaatgtgagctggcagcagccttgccttcatgatagaatcgccgaagcaaggcacaacgagcgtcttgattaccgaaaatactgcaataaagcatcacaacgatgccggcgcgattacggcgttgggccatgcccgcaaacttttgtccgcgaacacttaagtcgtatttaccgggacaataagagtggacgatttcagtggtcgcaattggcagactcggaaacgcggtgcggaaaagctgagtcatcaactcgtatgcgccgttaattgaaagctcgtcttcatttggcaaaaatagcgatacattcaaaaccccacggtctgcaatgaccgctaaaccgccagaattacgaacgaagaaaccatagccatcacttgccaatacccgcaatccacgaccgagttgcggcaattttagatcttgcatgcctaggatgacggtttggtctgccgtccagaaatgcagcatcaaaggcgggtgcaattcaggatgtgccaataacgcgttagtatgggcaaaactgagcggcgcctcgtcttttgtaaaattttgctgaaaaattgctgcctgctggccggccagtgttgtcaagtccatcacgcgccttctttctatatgatagattacttatattataactaaggtaacaagccacgtcagttggaactgcattttcattgcgtatcttgcagtaagtgatttgaaacatggataattgttacgactcgaccagtttgacccgtgggcgtacaatagctgttagaaaggattgacattatggatctttcacaaggagtgccgattcaaattcaccttgagacgtttgtgacgcagggtgaggacaatgagacacatgtttttgacgaacctggaacgttggtgcagatgggaaacgctttatacattcgttaccaagaagttgacgaagatgctgggaccagtatgccggtgacgatgaagctgcgtgaagatggcgatgttcagttgtcgcgtggcagcagcaacggcgacactcagctgaaactgttctttgccaatgaaaagcgcgtgctgacgcgctatcgcacaccgtacggtatcattccggttgaaacggtcacgccacggattgacgtgcgcatgacaactgaacctgtggcaggtgaagtctatattgaatatcaactttttgctaataaccagcacttgggtgattatcgattgagattgcaattcaacgcctgagcgtgtatgatgaaaaacagactgtataaactgtggaaagggcgtgtatcggttgaaactcaaagcatttgccaatgccgataaatcagaattatcaatgatcgaagtagcccatgagatcctcaaagaaaaaggggataccatggcgttcgttgatctggccaacgagatccagaattatcttggtaagcgtgacgaagaaattcgtgaacgtttaccgcaattctacacggatctgaacgtggatggcagtttcatttctttaggcgataacgtttggggcctgcgcgcttggtatccatacgattccgttgatgaagaagttaaccatccggaagatgaagaagaggcaccacgtcgtaagaagcgtaagaaggtcaatgccttcttagcagacgttgccgacgatgatgacgtgatcgactataacgatgatgatcctgaagatgaggatctcgacgcagatagcgatgacgacgatgatttcgatgacgatgactcaggcttccacgacaaggtcgggaagacgactgacacagacgatgacagtgatgacgacccagatgatgggctgccagatggtatcgaaggtcagctagccgaattcggcgatgacgacagcgacgatgatgatgataacgatgacatcaccgctgacttctctgatgacgatgatgacgacagcgattcagatgatgatgacgatagcgacaccaaaaaataatggctcttcgtcaagtagagttgatagatcttttgtgaagcatctaggccttaattcttacacgcaggtttctgggctggcgagcgcgttaaagttaagcgcgagcagaagcgcttagaagccggagcataagggggcttgaactcaaatgaaccgaacttggccatttgaactcaaggtcctgatgtgcaggcttctgcgactgcaagcgcgttatgaagacgaagacaagagccttcatgaaagcatgagctagcatgtaggtgcactgcctttgtcgaacatcattagtctagcatacaagtctaatttaattcaggaaatcccagactggtacgttaattggtgttgctttaagtgctgcttgatcagctggatcgagcagatctttgcgaacgaccacttcataaacatattggtagaaccaagatgcatcagcaacaaaatagccatcgtgaccgttgtctttgccccaagaattttcgactttccatttggtgacctcgccgtcaacaacatcagcgccagtcagcgtcatagcatgcgacatttctgcttcggtggtcacaattcgatcagttttgtcgaaatgaagatccagatcgaataagtcactgtagttatacagcccgcctttaagcgtgccagatttgcgatccatatcagcgagcacatcattgccgaaccaaacggcttcaccggcctgtagctgggttaaagccagttttttcaactggtcaggtggtagattcagaatggtcaggggatgaccgccgacaacggtgttcgctgaagcgatggtatacagctgatgatattttttgttcggctccggatcactcgcaaccacaacgtaatcgtcaaaatgccacttcacatattttttgaagaaagactgcggggtcaggttggtgtcgcggtggtactgcttcttatcatcgcgatattcaaagtcaaattgggttggcgggttgccaaaagtataagcgagaatgcggtaaacaacgctgagaaattcgcgttttttagcggcaatggcgtcatcgccagcgttggcctgtttcaactcacgcaagactttggcatctttgcgcagcttctcattcaaaacgctgttgagttcaaccgttttttcgctgttgtaggtttctggcatgattgacttagggactagaccgtatttttcgatcagtgcttcagcctgatcatagtgaccgccatcctgatccgggccactcagataatcggcaacttcgcggtcatcaagcggtttatcggccgttgctaaaatgttttcataaaataaattagctttttccaaacgatcaaagaaggcgttgtagttttgtgaaaactcgaagtccttaatgccgaattcatcagcaatgccgtagcgaacggtgttgagggtggcaaagagccaacagcggccacttttcttttggttagcaacggtaccggtatcaagatcaagagaaaagaccggtttcatatcttcgccgtcaatgggttcgcgacttgcagcttgtgggccaacgttttgcaccgcacgagctgtggcgccggcagccggctgtttggctagttgggcttgaaagtctttaatttgatcaaatgtaatttctgacataggcgatctcctttttattgcattaaagaaaccttacctcattttaatttgaatttaaagatggaaaaccaatggatcattgagtggcacaagctcgttaatctattcaacaaaatgctgcagattctcagaagaagaagtttcggggtattttacttttaataagcacttactaaaagtataatttagactatgtccagtattatttggacatacaattatctagttaggtgggtttaagcttatggttaaggcatatcagaactattttaagcatttaggcaacttttctggcacggcgtcgcggcgtgaattttggtggccgtggttgcttaatgttatcgttggctatgtcatcatgacgattttatttaatatttttggcatgaacgtcacgcgtgttttgaattttcagcctggaaaagaaacctttcttgcatcactgattaatttcattatttttattgccaattggtcgctgtcagttcggcgtttgcatgacacggatcgccgtggttggtgggttttgctttggtatgtgccaatcatcggtcaaatctggttattgatttacttcctgttaccaactaagaagaatcgctggaatgatcggctagcatagacgattgtcgcctattacccggttgcaggtttctaagggagtctgattgcgctcataaaaaaagccgctcatagcggctttttttgttgctgtgatgatgtcggtacggcggacgattaagcttcttttgttggccgcaagacatcggcatattcggggtgattgtggaaagcatggacggcgtatgaacaaagcggttcaatcgttttgtcttccttgcgagctgcagccacgactgtttcaatcagctggccggcaatcccttgaccgcgcaagctttcgtcaacaaacgtatggtcaaccgcccacgcgtgaccgtcatcaatgtcttgaaaagtgacttcggccattaagcggccgtcccagtccgtgttaaaaaaacgacctggttctcgttggaattccatggggcacctccttgggtcaattcgtgatggtacaggtaaacttttagaggattcttaagcagcttcagacgcttacatgtttgcctgtttaataacctgtctactaccccaaatctatcaggaacgcggtataattacaaggagggaagccctttcaccatggccgtgccatgtgtccgcatggtatgatactttggacactatttaaatggaggcagctatgaagacccgaggttttgagattgtttcaaagtatcaagatgaagatttaactttgccgacccggcagacgaagcaggccgctggttacgacttttatgcacgtgaggacttcgtcttaagaagtatttggcggtacgactttatccggcttttccgcttgattaaaaatgagcacccactgaccaataaagactttgagcgcgctaagaaggtgttgaaaccttacttggtgccgactgggatcaaagcctatatgcagcccaatgaagttttagtgctagcgaatcgttcgagcagtccattgaagcatggcttggtgttgccgaacgggattggcgtgattgatgcggattactataacaatccagccaatgaaggcgaaatctttattcagctacttaattttttcccgcgcgatgtcgtgtttaaaaaaggcgatcgcatcggtcaaggtattttcatgccattcttattggcagacggcgatgaaggcggcctagccaagcgacaaagcgggttcggttcaaccgataaagcgtaactattgaagggataatatggcgaaagcaaaaacacaatatgtttgccaaaactgtggctatatttcagccacttatctaggccggtgcccaaattgcggcggctggaacaccttagtggaagaaaccgtcagttcaagcaagtctgtgccgcgacaaacagcaaccggcagtagggtaaagccgacgcggatgaacgatgtgacgatcaccaaagaaacgcgcgtcaagactggcttagatgaactgaaccgggtgcttggcggcggagtggtgccagggtcactggtgctgatcggcggggatccggggattggtaaatcaaccttgctattacaagtgtcagggcagttggctaataccggcggaaccgttttgtatgtctctggcgaagaaagtgccagtcagatcaaaatgcgggctggccggcttggcgtggcaaattcggggatgtacttgtatcccgaaaccgacatgccgagtattgaagacgtcatcaaccaaatgcagccggattacgttgtgatcgactccgttcaaactatgaatgtgccagaaatgaattcagcggtcggttctgtggcacagattcgtgaagtgacggcagaactgatgcgcattgccaagtccaaaggggtgaccattttcatcgttggccatgtcactaaggaaggggcgattgccgggccgaagattcttgagcatatggtcgacacggtgctctattttgaaggcgacatgcaccacacgtatcgaatcttaagatccgtcaaaaatcgatttggatcgaccaatgaaatcggcattttcgaaatgcatcaagacgggttacaggaagtcgccaatccctcggaaatcttcttggaagaacgcttggcgggggcaaccggttctgcggtggttgtttcgatggaaggcacccgaccaatcttagtcgagattcaagccttgatcagtccaacgatgtatggcaatgctaaacggacgagcagtgggttggatcacaatcgagtgagcttgatcatggccgttcttgagaagcgggctaacttgatgttgcaaaatcaggacgcctatctcaaggcaacaggcggtgtgaaactcgatgagccggcgattgacctcgccatggctgtggcaattgcgtcatcttatcgagataaggagatttcaccgacagattgttttgtcggtgaaatcggattgacgggggaagtgcgccgcgtcaatcggatcgaagaacgtgtcaaagaggcggccaaattgggtttcaaacggatttttgtaccccgtaacaacttgcaaggctggcatgcgccaaaagatattcaagtcattggtgttacaagcattgccgaagcgctgcataaggtctttaattaaactaagaaagggggggcattttatgaagaaacgaattatctatatcatcttcggcctgattggcattggggtcgggatgggcaccttgccgccgctttgggatttgatcggctgggcagacaaccattttctgaacaatctgttaattgacggcttgattggcggcgttgttttcctgctgttggcaagcctcagcgttggttggattctaggtcggttgaaagtgttggagaagacactgaacacaaagtcgccaagctacttgttgttcggcagcttatccacgataatcggcttgatcttggcggcaattatttcaattccgttctatggcttcgttgcaccgctgaatatcttcctaccactcatcatcatgctattattcggttacttgggttttcgggtgggtacgacacgcagcgaagaatggcggcggcttttgagcttccgtaaccgccgaactgcagatacggaaaatgatcaggtgttagaacgtaaggtcggcgatcatttccgcaagtacaagttgctggataccagtgtgatcattgatggtcgtgttcaggccatcgccaaaaccggctttatcgaaggcaccatgctcgtgcccaattttgttttgcatgagcttcagctaatctccgactccgcagattccatgaaaagaatgcgtggtcgccgaggattggatattctcaatgccatgcaaaaggataaagacattcatattgagatgtatgaaggcgatttcgaagatatgaccgaagtcgacagcaagctgcttaagctcgctaaattgctagatggcatcgtcatgacgaatgattttaaccttaacaaagtagcccagttccaaaatgtgccagtgctcaacatcaacgctttagccaatgcgctgaaaccagatgtcattcccggtgaaggcatgacggtcaccgtcatcaaatccggctctgagcgccagcaaggggtcgcctatctggaagacggcaccatggttgttgttgaagacggcaagttctacatgaacaaaccgttagaagtgattgtcaccagtgccttacaaacggctgcagggcgcatgatcttcgcaaagccagcgcatcagcaaaaggcaattcgggataaagagagataatctgttaagtcatgaaagaaggcggcttcagatcccttatcgggaactgaagctgccttctttttttgcttttcgggaactgattcaatctctgattcatttgaatttcctcaaagtcaatcaatgattggttctcggagatgaaatgtttcttttaatttacttaagttgagttccttctttaccaaaaacaacagttgtgcaattttagtatgctaaatttaggataataaagatgccaaatagagcatgtttaaagtctaaaatggctgagcgcattggaagggcagtgacagcaaggtatgttgaaaataaatcagctcgataagttctttggaaagaagcaagtattacatcagatttcctttgagataaaacgcggtcatattgttggtttaattggtgcgaacggtgccggaaaaaccacgatcatgaaggccattttgggaatcacggcgtttgatggggatattcaattggatgatcaaaacatcaccgtggataatcatagtgctttagagcatgtgggcgcacttattgaatatccaggtttgtatccttatctgacaggccgagaacaattgcttctttttgccaatggtcctcagcggcatgaacgcgtcaaccaaacgattgaggagttgcatcttgcagcgtatgcggatgttaaaaccaaaaaatattcgctgggtatgcgccaaaagcttggaatcgcacttgcattcgtcaatcgtccagaactggtgattttagatgagccgatgaatgggctggatcctaaagcgaccatggcgcttcgtcagttgattatccgtaaacgtgatgaggggaccacctttctcatttcaagccatattttgagtgaactgcaaaaagttgctgatgatgtcattattattgatcaaggtcgtttaattattgatgcgactatgagtgagttattgaagaaaagtcaaacatacttttggatagcgactgatcaagatgagctggctcagaaattgttagcggaacagggctacgtggttagtaatgaagagcaaggtttaaaaattagccgatcgtcgatttctagcattaatgacctgttaaaactattatggcgcaaagatattgtcattaaagatataaaagaaacgcaaggagacttagaaaaatctctactggatgttttggcatcaacaaaataaaaaggaggcgtcattttttggtcaccttagttaagcaagaaagttacaaactagtcaaaaggccttcattattcgttttctggttcggtctgacccttttccaagttgcaattgccgtgtacttattaacccaccccaatgcttctaaccctagttcattattcatcaacagtttttaccccagtttacaattcaagtgcaacaccctgacgactagaccataaaggccatcttacttggttaagtcctcgaccgattagtactggtccgctccatgcatcgctgcacttccacttccagcctatctacctgatcatctctcaggggtcttacttccatataggaatgggaaatctcatctcgaggggggcttcacacttagatgctttcagcgtttatccctgccgttcatagctacccagcgatgcgcctggcggcacaactggtacaccagcggaacgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacttgtcagtctcgcagtcaagctcccttatacctttacactctgcgaatgatttccaaccattctgagggaacctttgggcgcctccgttacattttaggaggcgaccgccccagtcaaactgcctacctgacactgtctcccgccacgattagtggcgcgggttagagtgttcatacagctagggtagtatcccaccaacgcctccatcgaaactagcgttccgatctctacggctcctacctatcctgtacaagcggtacaaacactcaatatcaagctacagtaaagctccatggggtctttccgtcctgtcgcgggtaacccgcatcttcacgggtactataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttccgaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactataatttcgctccccatcacagcttgtccttaagactgcaagcatttcactcactgtcagacttgctgcttgggcgcacatttccagccgtgcgctttccttagcctcctgcgtccctccatcgcttaaacaaaataaactagtgcaggaatctcaacctgcttgtcatcgactacgcctctcggcctcgccttagatcccgactaaccctgggaggacgagccttccccaggaaaccttagtcatacggtggatcagattctcactgatctttcgctactcatgccggcattctcacttctaagcgctccagccgtcctcacgatcgaccttcaacgcccttagaacgctctcctaccgcgcacccttacgggtgcacccacagtttcggtattatgcttagccccggtatattttcggcgcagtgccactcgactagtgagctattacgcactctttaaatggtggctgcttctgagccaacatcctagttgtctgtgcaacgccacatccttttccacttagcataaatttagggaccttaactggtgatctgggctgttcccctttcgacaatggaccttatcgctcactgtctgactcccggagtaagatcaatggtattcggagtttatctgaattcagtaacccttgatgggcccctagttcaaacagtgctctacctccatgatccatcctccgaggctaaccctaaagctatttcggagagaaccagctatctccaagttcgtttggaatttcaccgctacccacaactcatcccagcatttttcaacatacatgggttcggtcctccagtgtgtttcaccacaccttcaacctggtcatgggtaggtcacttggtttcgggtctacatctgcttactcattcgccctgttcagactcgctttcgctacggctccgacttttcatcttaacctcgcaagcaaacgtaactcgccggttcattctacaaaaggcacgccattacccattaacgggctttgactaattgtaggcacacggtttcaggaactgtttcactccccttccggggtgcttttcacctttccctcacggtactggttcactatcggtcactagggagtatttagccttgggagatggtcctcccggattccgacggaatttcacgtgttccgccgtactcaggatcctggacggagggttcgacgtttcgcttacagggctttcaccttctgtggcgcagctttccagctgacttcgactacgtcggactttggtaactccaatgtccagtcctacaaccccgagaagcaagcttctcggtttgggctcttcccacttcgctcgccgctactatgggaatcgagttttctttctcttcctgcgggtactgagatgtttcagttccccgcgtctgccgccgaccagctatgtattcactgacaagcaatacactgatgtgtactgggttcccccattcggaaatctccggatcaaagcttacttatagctccccgaagcatatcggtattagttccgtccttcatcggctcctagtgccaaggcatccaccgtgcgccctttgtaacttaacctgtactgacttgcgtcagcggttatgcgatgcgaatttctttttcagaaactcatacaaatacgctgtgttctcggcaatttaaaacaattaatacaatgatatccagttttcaaagaacaaagtgctccgcggcgattcggggtggcgaccgcgaagctagagtggtgggcacgacttcaagcccgcaaagcccgcggtcttgaagctcggtcttggtctaagcggagaaaaccacccgctttaggaaaaggccgagctttgagacagcgcgccggttttgcgcgttggctcaaagtcgtgcccagtgcgttccagcccagccgccgcggagccagctcgtcctaccggtgttccaccagccgctgcaacaaaaaaccgacctcctgttttgcttataaaaattataaataataactactattatctttgacccgcgaaccagcactcccgtaaaattttaattgtaataaagaatgactgtgacattatcaaaaaaatattcgaggggagtgcatctttatgaatgcatttattggatggctgaatcggcatgtggtgccgatcgcggctaagattggatcaattcggtggttagttgctttgcgtgacgcgtttattgcgatcatgccagcgatgatggccggcgcagtttcgacagtcttgaacgttttaatttgcgatattccgacccagttcaagtggacgggcattgttgattcaatgcaatggctgatcggcattaatgcgatggtctggaccggcacactggcgattctaggcttgctgtttgccttcacgttcggctatcaattagcagtccagtaccaagttgagccggtaactggcgggattgtggtactaggcgcattcatcatgagtttaccgcagaatttcacagtcgctttaagcagtgcacttggtaaaggcgctacaaagttgattaccgatgctggtggggttgttgatggcaagaacatcagcatgtggggttacttcaactttggcaagttctttggttcctatggcttcttcaccgttatgatcataggcggcatcgccatgaccttatacatctggctcatgaaaaagaatgtcacgattaagatgccagaggcggtgccgcctgctattgcgaaggcgtttaccgggatcattccagcaacggctgcgttgtatatagccggtgtgatcaactatctgattagcttaaacaaaacaacggtgatcgaatttattgctaccttaattcaggaaccattgctgaatatgtcgcaaggtttctgggcagtcttactgatgacactgttggtgcaaatcttctggttcttcggtctgcacgggaccaatgtgctcggaccggtgttggattccatttggttgaccgcgcaaattgctaatatgaatgcgttcatgaaaggtgaagcgttaccgtttatttggacccgaaacgcctttgatttgtacgcatggatcggcggcgccggcagtaccttactgctgctgattgccatcctcctgttttcaaaacgagacgatcaatgtaccgtggcaaaattatcaattgccccaggctgcttcaatgtgaatgaacctgtgatgttcgggttgccgatcgtgctggatccgatttacttcatcccattcattttggcgccagtggtcatggtctcaatcgcttatggcgcccacatcctcggctgggtatcgccagttaagaatcaaatcgtctggtcaatgccaccgtttgtcaactcgctgattgcaaccatggactggcgtgcaccgattctacaggcagtcaatatggtcatcggtttcttgatctatgtgccattcgtcaaagcagccaacaagctggatcctgagttgaccgttgacgaaccggtgatgaaaaaagaaaaacgcgtgaaggagacaggcaagctggaaggtgatgctgtttgaaaaatgtaacagcaaacttgatcttgctcaatctcagtatggccatcgtgatgttcagtccattattgccagcaccatggcagatcgttggctgcggcatcggcattggtttaacgattgtgttcttccgtcgctatgttcagttgatcaaggcacaaaagcaggaggggcgcgatgaagatcaccatgaatctgccggttgagccggcggtctttttcaaacagttacagctctcggcattggcagacattcgcacgcataccggccgggaacctttaccgggaagtttgcgcgggtttagctatgctaaaaaatggccgaatggtcggcgggcgcggctggagattaccgacatggagccgaacaaagtctatgcttatacattggcaacgccgcaagacgactttcgcgttagctatcgcctagtgccacttgcatcgggaaaaagtcggttggaatatgaagagtccttagtcgcaaaaacggcgcgaggcacggccaacaatcgggtgagcggcttactgatgggctggtttcggaaacgccgattcaagaaaatggccttgaagatgtgtcaatcttaaaaaagttgcctttagaggtgacaccccatgtgtattggcacggagcacgaagcaagcaatacaagacagtgaaacaaaaaaaatgactcgacagaaggaggcgaaaaaatgggacagattgggatcagtctctacccagaacaaaccacggtagcgaaggcgactgcttatctagaaatggctcatcagcttgggtatcggcggctgtttacatcgctattgcagttgtctggcgaaaaaggccgcgatcagttggccatttttaaggctgttgtcgccaaagcaactcaacttggatttaaaacgattgtcgatattgcaccaccgttattttccgagttggaaattgattatcatgaggtagattgcaaatttaatccgaatttttggacaaatttgtcagcataacctgatgctccgcggcgattcggggtggcgaccgcgaagctagagtggtgggcacgacttcgagccaacgcgcaagtccggcgcgctgtctcgaagctcggccttggtctaagcagagaaaaccactccgctaagaccaatctcaccactgagcccgtcgccgctccgccaactttctgctttctatcctagtattcgagctagattgcccatggcactgcttcttgaagcgtttaagacagtggcaggcgcctgcgaagttaacgcgaactaccgttatttcaccagctcccagaagaaagatgaacttgccagaatataacacaccttaccttgttgcacgtgaacactaggtgttacacttactcatatcacattcaattggaggcataacatggctgatttatggcggacaatttctgaacggcacggcgagttgcttagtgccttggggcaacatatcgaaatatctttaattgccttgatgatcgccgttgtgattgcgattccattggccgtttgggtccagacgcatcacaaaaccgcggcagtgctgctgcaagtgactggtgttttgcaaaccattccttcgttggcattgttagggttgttgattccgtttgtgggtatcgggacgctgccagcgattattgctctagtggtgtatgctttattgccgatttttcaaaatacatatatcggtttacgcgatattgatccttcctatgaagaagcagccgatgcgtttggcatgagtcgattgcggaagttgttcaaagttgaattgcccatcgccttaccggttatcttgtcgggcgtccggactgcaatggtcatgattattggaaccgcgacgctggcagctttgattggcgccggtggcttaggcacgttcattttgctaggtattgatcgaaatgatgcggcgttaactttaatgggtgctttggcagcagcgctattggcgattgtcttttcgtggctcttaaatgtcatgcaaaaagtgaattggaaagtcagtgtcggggttgtggcaattgctatctttggcatggtcggcagccaagtatacgcttatgtgaccgcaccgaaggaaactatcacgattgcgggaaaactaggcagtgaaccggatattttgatcaatatgtacaaagaactcattcaaaaagctgatcctgatgtcggggtcacgttgaaatcgaactttggacagacgagcttcttgtacaatgcgttgagaaccgataagatcggcatataccctgagttttccggaacggttctggcaagtttgacgaaaccatctgccgctcagcaacaacaggtgacggctggtaaagataattatccacttgcaaagaaactgcttgctaaacaaggcctgagttatctcaaaccgatggcgtataacaacacctatgctttagtcgttaaggaaagttttgccaagcgttatgatctgcataccattagcgatcttggcaaaattgcaccatccattcgcgccggatttgatttagagttcattgaccggcaagatgggtataaaggcatccaatcaaaatacggcttgcagtttaaggtggattcaatggatgcttccttgcgttaccaagctttagatcgcgggcagatcaatttgaccgatgggtatacgactgatgcgcaattgcggcaatatcatctggtggcgttgcaagatgataaggggttgtttccgatttatcgcggtgcgccattgatgcgaacggcctttgccgaaaaacacccgcaacttgtagctgcattgaacaagttggctggtcaaattacggaaaaacagatgcagaccatgaattatgccgtgagtgtgaagaacgaaaaggccgcaaccgtggctcaccgctatttggttcagcatggcttgctgaaggaggtgcgctgatggcattgatcagtcttgaacacgtcacaaaggaatatgacggcaagcccgtggtcaacgatcttagcctgaaggtcgatcaaggggagttatttgtgctagtcggcacctccggcagcggcaaaaccacgacgctgaaaatgatcaatcgtttggttgatccaacgagcggcgtcatcgaatttgccgacaaaccgctcaccagttacaaaatgcgcgacttgcggtgggatctggggtatgtcctgcagcagatcgccttgtttccaaccatgacagtggcgcaaaacattgccgtgatccccgaaatgaagggctggtcgcgccaaaaaattaggacggcaacagacgagttactcacaacagttgatttgccgccagccgagtatcgcaatcgcatgccaagcgaattatccggcgggcagcagcaacgcatcggtattttgcgggccttagcatcacggcctaaggtggtcttgatggacgaaccgttctcagcattagatccgatttcccgcactcagcttcaggatatgctgctgcatttgcatcgtgccttgaagaccagtgtcatttttgtgacccacgatatggctgaagcgatgaaacttggtgatcggatcggcgtgatgcgcggtggcaaactcttgcaggttgatacgccggaagaaattgcgactaatccagctaatgatttcgtggcggatttgttcaagggagcgcaagccaatcagggtctgcaggtcacgctcagtcagttagcaccatttgcagcggatgtgtcggcccggcatgcggttggcggcaacttgacgctggccgaggcgttgccgcttttagatgcgcatgaggcgttgcgcgtgaatagtgaacatggtgcgtttgtggtcaatacccatagtgttgtcgcttatctcgcaagtgcatttgtcgatcagaacacagagacgaaggagtgatcgtgatggcttatgattatggaacgattgtgattggtggcggcccaggcggcttagcagcagcttacggtttagcagcaaagcaaaaagtattagtcgttgaaaacgatttgtggggcggcacctgtcccaactatggctgcgatccgaaaaaaatgctgtatcgcggtgtcgaagttaaaaatgctgccttgcgcatgaatggttttgggatcagcgggacggcgaagattgactggccatccttaatggcattcaagcgcagttacacagctggtgtgccagcgggaaccttgaacggattgacccgtactggcatcaccactttgtatggccatgcccagcttttgggcgaacatgctgtcaaagttggctcccaaaacgtgaccggtgaacatattgtgattgcaactgggcacacgcctcgttatccggacattcctggggccaatctgcttaaaacgagtcgggattttctggaccttgatcagttaccaaccagcattgccttcatcggagccggttatgtcagtgtcgaactggccaacatcgctgcagcggctggcgcagatgtgcatatcatcggtcattctgatcggttgttacgggcattccccaaagtcgctaccgaagctttaaaaccattgcttgccaagaccgggattcattttcatcctaacgtcgaactgactaaaatcacgcccttaggtaccatgacccatctacatgctgataacttcgatttgaatgttgacatggcaatcactgccatgggtcgtatcgccaatgttgccgacctcgggctagccaatgctggtattaaggctgatacgcgtggtattccggttgacgaccatcttcgcaccgcagttgagacgatttatgcaatcggcgatgtcaatttgaagccacagcctaaattaacaccggtagccggcttcgaaggcagctatgttgccaagcagattttaggcgatcagaccccgatcacctatccagctattccaaacattgtttttggtccgactgagttagccaaagtcggtgtgtcactggagacggcggaagcagcacctgatcaatacaccgtcaagcacaacgagacaacccactggtacacctataatcgaattcaggatcctgacgcacaactttggaccattgtcgacaaaaaaaccggccgacttgccggtgctgtcgtcttagccagcttggctgaggacttgatcaataccttcgcagcggccattgatgctggtgaaaagccgagtgatttaaacaagatctatgcttatccaagtgcgcagagtgatttgcagtatctgctgtaaaaccaatgataagtcacagatgtaaccttgcattgacatcactagcgaatttagctaacctaaacccatattcacacaaacgatgagtagcttatctaagtggtctccagagagtcggcaatgctgtgacgtcgatgaccatggtaggcaaagttgggtcgtttgcgttatgttcggtgggtgcgccttaagccaagagaggtccgcaaggcggacaagttaggtggtaccgcgcgcttgcgtcctatgttgttatgacataggacgctttttttacgataacgcgctcacagtcgcagaaacctgcgcataaggaccctggacgcaatggtcaaagtgcgaccatcacgcccaaggccggttacactccggtttcacccacgctggctcgcgctcacaatataaggaggaaacaagtatggcaaagaaaatcattttaacaggtgatcgaccaacaggacggttacatattggtcactatattggttcactgaaaaatcgtgtggaactgcagaactctggagaatacgaaccgtttgttatgattgccgatacgcaggcattgacggacaacgccaacgatccagaaaaaattcgccactctttgctggaagtggccttggattatttggcggttgggattgacccagacaagacgacgattctggtacaaagccagattccggctttgtttgaattaacggcctactacttggatctggtgacggtgaaccggctggaacgtaatccaaccgtgaaagctgaaattaaacaaaaagcctttggtgatagcgttccagcaggtttcttcatttatcccgttagtcaggcggctgacattacggcgtttaaggcgacaacggtgcccgtgggtgacgatcaggagccaatgctggagcagactcgtgagattgtgcgcacgttcaatcggacttatcacaaagatgtgttggttgaacccgaaggctattttccaccaaagggtcttggccggttgccagggattgatggtaatgccaaaatgagcaagagcttaaataacgggatctatttggcggacgacgctgataccgttaagcagaagattatgtcaatgtataccgatccgggccatattcacgttgaagaccccggtaaggtggaaggtaatgttgtctttacctatcttgatattttcgatcctgataagcagcaagttgctgagttgaaagcccagtaccaacatggcggcttaggggacgtgaagatcaagcgctacctgattgatgtcatggaggcagtgcttgaacctatccgcactcggcgggagcactatgccaaggatatgggggcggttgctgatatgctcaagcaaggttcggctaaagccaatgtggtggctaatcaaacgcttcaggaagttcgggatgcgatcggattcaactactttaaatagtcaagttccgtcttaagccggatgtcgaaaaccgtcgtcatggtagaatgatggtataagcaggaaatcgatgataagcgtgagcagctgtagcctgccttttcacggaaataccgttgttttctgacggctttttccgtgaaaaggcaggcaattgtgaacgcattagaggggaattcatatcaatgaaaacgaaacgattaagtccagttgcggtcacaagtattgtccttggtgtgattgttgctatctgcctgatcttcggaatcggcacctacaactcgttagctaagcagaatcaggccgttgaagcgcaatggagccaggttgaaaacgtcatgcagcgacgggctgacttggtgcctaacttagttaatgcggttaaaggcaacatgggccaagagcagaaggtttttggtgacattgctgaagcccgcaagtcgtatgctaatgcaagttcgacaactgacaaagctaaggccgatgatcagttgaacaagagtgtgggtactttgatcaacgtgattaaagagaattacccgacactgcaaagcagcaatcaggtgaacaccttgatgacgcagcttgaaggtagtgaaaatcgaatctcggttgaacgtaagcgatatattgatcaggttcgtgattataaccagagtgttgtgaccttcccgaagaatatttttgctagcatgatgggcttagggaagaaggacaccttcaaagcaacaccggctgcccaaacggttccaagcgttgatttttcaacgaacagctctagttccgggaagtaggtggcaccatgcacaggcacttagcgtggtttgttgccgcgctgacgggtttgttgttgttcactggcgccgcgcagccagtggcggcagccgaagatctgccggcacggcccaccgagcattactatctagatcaagacagtgtgcttgatgaaagtaccaagcaactgatcgacagtaagaatcagtattaccaaggcactaaacaacagccgcaaattgccgtagcagctttaaagtcgacccatggcgaccccttgtcagactatgcaccggatcttttccagaaatggggaattggcaagaaaggtaccgataacggggtacttttgctttatgcgaataacggcggtaagcagaacatgcgcattgaagttggttatggtttggaaggcgatttgcctgatgcgctggctgggcgaatcttgaatgacaatctgaaggacatcaagtcacatgatcctaaagaactgaatcaggccattcgcaaggttttcaatgcggttgcgacagtcatcgataagaaatacaagttccctaaagatcaaaacacggtttctgatgagacgatgaatcaatatcgcaactcaagtcaagacagcggcggcaactttttgacgaaaattattttcatctttatcgctgtcgtcgttgtggccatcatctttggtagtcacggcggcggtggccgtggtggtcgccgtggtcgaggtgacagcagcttttggctctgggttattctggacgcgctgctatcttctggccgccgtggcggcggaggcggcttcggcggtggtttcggaggcggctccggtggcggttcaagctggggcggcggcagttccggcggcggtggtgccgatgtttgattgcaaatatatttcaattaccagacagcgagtcgctgcctggttttttgtgctatggttgttgaattagtcttttgtgaacgggaacgagcgcatgtcatatcgcttatcagtgatatccgatgacggacaggtagtttacgtgtgcaatcccgttgttgaaaagtgcgatcctgattgggtgagcacacgatcatttttggaggatttgttaatgcggaatttgaccatcggtaagccattgaaattaatcgtgctgttcacgattccattactgattggcaatctttttcaacagctttatagttttatggatgcgttgattgttgggcggacgatcggtaaggatgcgttggcggcagttggggcaacatccagcattgtttttttgattattggatttgcgcaagggaccacggctggactttctattttgacagcacaggcctatggtgctcatgattatcgttgtgtgcgacgcagtttcggtacgagcatttggatcacggttgggatttcactgattctcaccgtagcagccgtcacgatgacacgaccattattgaccgtgatgcagacaccaccggatatcatggatggttcgattgcctttgtgcgggttatctatttcggcattattgcatcaatgagttttaacttgttaagcaatatgctgcgcgcactgggcgattcaagaacaccgctgttcttcttgatcattgcgaccattattaatatcgtactggacttttggttcattctcgggtttcattccggggtggctggtgctggctatgcgacggttagcgcgcaagtgatcgcggcgttgctctgttggatttacattcgcatgcggataccgcttctgatgattcggcgtcgtgatttgcgctttgattggcacgatattgttcagcatttaaaagttgggcttccgatggggtttcagatgtcgattatcgcaattggcgctgtcattttgcaggtgatgttgaatacattaggcaccaatgcggttgctgcgtatacggcggctggacgaattgaccagttagcgaccctgccgtcagcctcttttggggtggcaatggcgacgtttgctgcgcagaatctgggtgcgaaggaatatgggcgaatccgtcgcggagtttatcaaaccttgatggtgaacgtcggcttatcggcagtgctgggtgtggtcattattcttttcagcaaaccattagtgaatttgtttctcgggccgaatcaaccagctgtgacggccttagcccagacttattttcacttcaatgccagcatgtactggttgttggcgattcttttcacgattcgtaatttgttgcaaggtcttggccagacgttggtgccaacggttgcgggattcttcgaattggggatgcgcgcgtttgcggcgatcttcctcgttgtgccattcggctttgctggtgcatcggcggccaacccgctggcgtggttcggcagtgtgctggtactagtcagctcgtatgttcggacgatgcggcgcattagacagcaggaagatgaattggctgggcaccaagattaaaaaagcgtttgattgatcgccaacgggtcagcccgttagcatcagtcaaacgctttttacgctttcatgctcttttaaacgcgttcactggcgcagaaacctgcacataaggaccacaagcacactggccaaaacccggccaatgcacttgtggtcgcttatgctccggtttctaagcgcgccagttcacgctctgcttttaaagtgtttgccatagacttctaaatccgcttctccttctggcaggatagcgatggctggcaaatggccccagtggtcataaccgaatttggtgaacaagttgcgactggcttggttatgcccaaaaattcgggcgagaacggtggttaagtcgtgcttgggtgcttcgcggtcaacaaaggccaatgccgcgctgccaacgtggtgaccacgggcggccacatcaaggtataaactgatttcggcagtttggtcataagctgagcggtcactataagccgacagtgtcagccagccaacgattttgtggtcaacttgaatcatccaagcgggaaaatggttattgtgagccgcaaaccaagcttgtttctcagcgactgtttgcggctgcaagtcagcggttgcttgatgggtcgggatagtttcattgtaaatggcgacaatttttggtaaatcactggttgtggcaggggtaaattcaatcaacgtctgatgacctccattttggttaaaatgtgatgcggcccgtaaaggttgctaaacttgccgtaccgttatggctcatagcctcgagcaatggtttcacacgatcacgcaaatcggtgctgagcttgagttcggtcaaaagcgcattggttgttgcaatctcccagtgagcatcatctaaagtagggtcttcgacgatggtgccagcggtgtaggtccatgtgttatcatgtgcgatttgtgccaaagtgtccggcgtgatcaacgtgcgaatgttggcgacatcacttggagcaatggcatacagcaagccttgaatcatagccgcctgcagatgcccaatttgatccagcgcagttggctgcattgaccactcggcgacatcaacgtgatcacagacagctgccatgtttttgaataataaggcgagggcgttggcggaagcaaagtaccaaagactatgtgccaggacaacccggtcaaaatgctgattggcgatgggcccaagatcatccgaaagattagtgttgaaatgaaccgttaagcgatcaccaagcggtcccgcaagcaagtggttccatgcttggccaagcgtcagcggggcgccgtagtcaggtgaggcgatgtcaatgccagtcacatgcccggctgagccgacttgatcagccaaaatggcgctcaggtcgccttgcccacagccgatttctagaattttttcgccgggttttacctgccatgccccagcaattgcgagtcgatgggcagtttggcgacgctgaatggtccttgcattggcggttggaccaagtgccatgagatctgtaatgtagtcgagtcgtttttccataggattttccttttaaaaatgtgttggttcatgctttgtctaaacgcgtttgcagtcgcagaaacctgcgtgtaaggacctcgggcacaatggtcaaaggccgaccatcgcacccgaggccgcttacacttcggtttctaagcgcgactcctcacgctctgtctaaacgcgttcgcagtcgcagaaacctgcgtggacctcaagcagactgaccaaagcccggtcaatgcacttgaggccgcttatgcgtcggtttctaaccgtgccagttcacgctctgtctgattatggcaggtcgtttccggcggcgaagtagaggtcataccattcttgccgggtcaaagcaatgtcgccggcttcggcgatggcgcgaatgcgagcgggtttggtggttccggcgatgacttgcacatcagctggtacacgcaagagccaggcagcagcaattgcgttgggattggtggtatattgatcggccagcttttgaagtaagcatttaattcagggaatttatcgttgtcgatgaggacaccttcaaagaagccatattggaaaggactccacgcctgaattgccatatgatgctgctgactgtatgggagaagaccgccatcatgatcaatggaacgggcatctgccatgtttgtatgcatgccggcatcaatcatgcctgtgtgcatcagggaaaactgcaattgattgatgatcaatcgttgcggcaccgcctgttggagcagttcaatctgagcaggattgaagttggaaaccccgaactgccgaactttaccttcattttgcaattgcagaaaggcttcagcaacatcttctggttccatgagcgggtcaggtcgatgcaatagcaagctgtcaacatgatcggtaccaagtcgtttaagactgccattgacagcatccacgatatgctctttggagaaatcatagcgatgggtcgcttttcgatcattgacaataccgaccttagtctgaatcaggacttgatcacgtgtaaaactggccttcttcaacgcatcgccaaaaagctgttcagctttaccattgctgtaaacatcagcattgtcaaaaaagttaatgccaacgtcataagcagcatcaagtagttcggttgctcgtggccgatcgagattcggcaaacgcataacacctaacgcaatggcagaagcgtgcagaccagaacggcctagatcaatcattttcataatgagcatcctttcagaattgttccatgatgctttaagattatcacaaaagcagtgatgattgcgtgagaaagcaccctcaaggacgagctaatttgaggctatcgcatgcttttgtgatggttattaagtctgtggtattggccaatgactgactagccagcagtcgagtctgctattggttggaccaaatgttgaagaaagcgctacttatagcacattcagtaaagattgatgccgatttttggtaaactaaaggtagatagaccgattgtcagtaataaggcttgtctaaaaagccatgcaggcggtgtttaccgtgctatcatggcattagagcatgatgacaatcaggtagcaaacgaaaagaaatgggtggaacgagaatggcaaataatatacaagggtttgtgatgatcggtgcacaagcaatcgtttttagcatcacaaatctgcggacgctgaaaacaattgaacgcggtagatatccagttgccattggggatgatttttatgcagaacatgaaatcttgcccgatactgttgatacgatcgtacaagcgtttgatgccatcaatcaaatttttaaagactatggcgtaccgactgttaatgtatttgcaagtaccagttgggccgaagctgataatgccgagtttgtgcgtgatcagctttatacgcgaactggctggctcattaaaactacctcactatcagaagaagccttttttcgtacccaagcgatcatggtgaagtttccgcagtttaaatcgattacgcaaaaaggcacggtgctgatcgatatcagttcagggtcagttgagttgactaccttcagcaatggcgtgtttggcttctcgcgtaatctgtcacttggccctttgcgagtgtatgaaatcatgagtgatgtccaacgctcggtgacaaattatgttgaagtgatgcgcgactatatcgacagtcgcttgctcgactttatgcggctgttgccacaaggtgttgagtacaccaatatgattttaatgggtagtaatctgtcgatttttcaaaatatcattccggaaggcaagcatcaggtagaaactgatcggccagggtttgatttattatacgatgaagtgacaaaggcttctgaccagtaccttgcagatacctatgatttgacttctgaccaaacatcactggttttgccgacagttttgctggtgtatcggttggttgaaacactcaacagtcaatctatttggatctcagatcttaaagccattgatggaattgaagtcaatgcagcacatgaaggcggctttaaaaagctgggctttgatccaaatgaagaaattgtcatcagtgcgaataatttggcagaacgctaccaagttgatgaagcccatatgcaagccacacggacggttgccttacagctgtttgatcgattgagaaagttgcacggcatgggcaaacgcgagcgtcttttgcttgaagtcgccgcaacggttagtgatattggtagttacattgaaacacacaaacattacgcacattctaattacatcatcaaagcatctgaaattatggggctcaatgatcttgaagtaaccatggtggcaacgattacacggtttcacagctccattacaccgcaatcggacttaaagaactttccaacaatgtcgaccgaaaatcgcttagttgtggctaagttatccgccttgctacgcgttgcagatagtctagacgcatctcgccaacagaagattcagcaattacgggtttctgtcaaaccaaatgaagtgctgttaacagccagagccgatgatgatattgaacttgaacgctggacattagcacgcaaaggaaagtttttctctgaggtattcgggctagggcttgagctgaaaggaagaaacattttatgaagaaactagatttttcaaagccgcgttattttaataaccgtgaactcagttggctggcattcaacgatcgggtactggaagaagcccgggataagaataacccgttgcttgaacgggtacgtttcctgggtattacgcaaagcaatcttgatgagtttttcaatattcgcgttgcgtcgctgaaaaaaatggtcacagttaattatgatcagccggatgcagcaggattgaaaccgcaagagcagttagacgcaatttccgaaaccgcccacgcaatggtggagaaacaatacacaacattggttcgttcgctgttgccaaaaatgagtgctgtcgatattcaactgctacatgcatcagaattgacggagaaacagcacgattttgtctcagattatttccattatgaactgtatcccgttttaaccccgatgggagttgatccgacgcggccgttcccatttcttggcaataatagtctgaatttggccattcggctggttcggcctgatgataaaggcgataagtcacggtcgtttgcgatggtacaggtgcctgatgtttttccgcgggttttgcggctgccaggcggcgacaatgtctttattttgcttgaagaagtcgtgcggatgtttgtcagtgagctgtttgttggtgctgacatcaaagaaacggctacatttcgggttacccgtgacatggacatggatgtggccgaagaggatgcatctgatttgatgaaggagattcaatcccagttgaaaaagcgtcaacgcgggaaagtgatgcggcttgagattgaagctggtatgagcaagcatttgcgcaaacgtctcatcaaggctatgaatgtgaaggatgaagacgtttatgaaattcatggtccgattgatctcaattttctcagcaaattagtcaaacaagtgcacgatcataaagatttgctattcaagccattcacaccgtacatggatccggatttcaagaaagagtcgatttttgatgtcattaaggatcgcgatgtcttcatgcagcacccatatgacagctttcagccagttgttgactttattcgcgaagcggcattagatccacaagtgcttgcggtaaaaatgacgctgtatcgggtttcaagcaaatcgccgatcatccgttacctgaaaaaagctgcagaaaatggcaagcaggtcacggtattggtggagttgaaggcgcggtttgatgaagagaataatgttcattgggcgcaagaattggaacatgccggttgccacgtgatttatggtttggtcggtttgaagacacattgtaagttggcgttggtggttcgtcgcgaagaggaaggcatcaagcgctatatgcacatggcgaccggaaattacaacgatgtgacggcgcggctttataccgacatgggcttgttcacttgcaacaacgaaattggcgaagatgcgtctaatattttcaacatgctttctggcttttcggaaccaccgtattttcacaagctggtcattgcaccactgggcatcagagactatctaatggatcgaattgatgaagaaattactgctgctaaggcggggcgcaaggccttgatccagatgaagatgaactcgctatctgatacggccatgatcgagaagctctatgaagcttccaatgccggtgtcgagatacatctccttattcgtgggatctgcaacttgaaggttggtattcccggagtttcagacaatatcacagtacattcgattgtcggacagttgctggaacacagccgaatttactacttttatgcggatgggcaggaaaatgtttacctttcatctgctgacttgatgaaccgcaatctgagccgccgagttgagctgctgttcccgattttgcaggacgatattcgcgaacgcatcatcaaaattttcagtatcatgtgggcagataacgttaaaacgcgaattttacaaccggacagtacgtgggttcgtgctcaattacgcggggttacaaaactcaatgcacaggcatacttcattgaacatgctgaagccatgggtgaagcattgcgacgtgaggaagttgatgatgctcctgaagacttgcatgcaacgcatacttttattccgataaccgcacccaaggaggacgatgacgcatgacgcatcattttgcagtaattgatcttggcagtaactcagctcggatgacgatctgggaaatcgagcaagaggttgtcaagccgatcaaacggctcaaagaaatggtgcgattgtctgaggacatggggccagatcgcgttttgcagcccgcagcaatggatcgcaccctgaaagccttgcaggggtttaagacggagctaaataagtatgctgatattgatttaaaggcggttgcaacagctgctctccgccaagccaagaatcaaaaagaattcctcaaacgggtgaagaacgaagcggggttgatcatcaatgtgattccgggaacgcgtgaagccgagtatgactttttaggcgtcatcaacaccttgccgattcaaaacgccttaattatggacacaggcggtgcctcaaccgagttgattctggttcaaaatcggaagttgcaacatctggtatcgattccttttggctcggttaacctgtccgaacggtttttgaatccggatgtgatttcggcgccggagtattttgccttaagtacgtttattcatgagacttttaacagcatctggtggctgcggcgagcacagaatttgccgattatcgcgcttggcggaagcaatcggacgttggcgaaaatcgaacgacgaaaggaaaaaatggctgattttgaggcgattcacggctatcggatgccgacaaagcaggccaatgcgatttttaaggaaattcttggtgcagatttggccacgcgggagtcaattccggggctgtcaaagtttcgcgctgatattatcgtgggcggtttgatgccggttatctcgatgattcgttatctagactcggatcgtctcaccttctcacagtttggcttgcgagaaggcgcgctgtacgatcatttgaacacgcgtgcagtgacacagcgtgagcattagttaatcattgcttaaaagtctggtaaacatgctgacggggtgcgctgaagcagcgataatgaaggtaccaatctaaaggagagcgtgagccagcccggttagaagccggcgcataagtgcgctcaagtgcgatgactgggtcatggtcattgtgcttgaggtccctatgcggaggtttctgggctggagaacgcatttaaaaggatggattttactcatgaaaaaatttatgaaatggctaggtctggccgttgcaggcttggccttgctaaccgcagcaccgcatgtggtgcgagccgatacttggtcacaaccagtggcaacaattggttcctcactgactgctgatcaaaaaagcggcaccttgagcactttacaaaatgctgccggggtcaacaatgccagtcaactgaccgtgaatggggccacactggtgaagtacctcaatccttcaggtagtacttttactgaaagctcaggcgtctggtctagcgcgttggttcaaaagactgataatgggggcattaatgtcaaaatcgtcccttataatggcaccaataacatcaccaccatcaccgctgatcaatatcgtaatgcggcattaaccgctggggttagcaatgccaacctctacattaccagcgcggttagaattgatggttcaggtgccttggcaggggtttatgcggcttttgctcaaaatggcgaaaatttgaataaccagcaaatcaatgctgctcagcaggaagtcaacaccttgagttcgatcacccaagcgaataaggacaaagatggttattctgacaagcagctcaataatgccgtggcgggtgcgaaacagcaaatggccagtcaaagtaacaacggtcagcagactttgtcccaaaatcagatcggtaacatcgtagacagtcagcttaaacagaataatttaacaacgattattaacaacaatcaacggcaattgatcatcaacttactagtgaacgttcaaaaagccggctcactaaagaacaatgactttaaagcacaggcagggaagctggccgattccattcagaattctgctaaaggcttgtttgataaactcaataagagcctgaacactgaagaaaatcggaatttcctgcaaaaaatctgggatggcatcgtgagtttctttaatggtatcgctcaatggattcagagcctgatcaaataatttttagcggtttaagcaaggggtgacagtttgtgatgattccggcgattttaacaacgacagagggtagtggcaatggtcataccttaactggcgcaattttgattggtgcagtggtggcggtgatcatcattttgtttttggtgattaagttactgggtgcgatcctccgtcatccctttatcagtctgatactgtttgcacttggcggctttgccatttttaagtttgcgttagtcggtattattggtgtcggcgttttagctgcagccggcgctggtgccttatggctgaatacaggcgatggtagctgacagtttaagaagctggtgtcaaaatgaaaaaacccctgctgaccagagtcagcaggggtttttcatttttatcggttaaacgcgcgaaggcagatcaatttctgcttgtgctaatatgtggcccttcatcgcgtgccgagcttcatttagccaaaagccagcttgcagtggcaatttcgtatccaatgcaaagacgattaaggtataatcgtgatctttatctggtggttgcgggccgacataaccagcctgtgtgaatgggtcagtgttgccgacgaggtggccagcggtggcattcttgccttcgaccattggcaccttattggtatgactggcgcctgctgggaatgttgtgctgtcggcgggaatattggctgcattccaatgaatccatggtaggccgccaaccggtacagcatcgtagtcaaggaaccaaagtgcaaaactgacagtttcggcaggggcatcctcaatcgtaaaaggaaaactcgtaatgggatagccatttttaacgtcactgccgcttgcatgcttgccatagcgatcggcaagttgaccattgataagtggtacggatagtttcatttgaatttcctcccttttatcgctaccttaatgatagaggataaaaataattaaagccaatttatcacagagcgtgagctggcccggttagaaaccggagtgtaagtggccttgggtgtgatggctgggctttggccattgcacccaaggtccttatgtgcaggtttctgcggctgcgagcgcgttttaaaagcagagcgtgagcaaagcgctgtttctaggccagcgatcgcgtttaaggagtgcaatacgatgcaggaagacgttgaaacattactaaatgaagtcaaggaacactatgatcatcccctagaagtcgacattagcggggaggcgagcggcgtcttaacgcacgatcaaagccatcagcaattgaaaaaagatggtacgctagtggtagcagtgacggacacgaccaatgtcgattacaccttaagtcatgagttactacatctgttgttccagatgaaaggttatccgcaacttcaattccatttattgagcggtgatccgcaggtagacgatcaactttatgccacgagcacctcgctatacaatgctgcggtgcatatgctcgttgtggcctggcaacgcgatcacaaccttttgacagacgcagcggtggcgcaagtgctcgccggcttcaaacaaaatgtgccagcagaagccgatgaccagttggttatttatcgagtgctatcgttgcttgatttgttggggtttttaaatggtgagttgccagcagaattagcaaatgcctatccacaagctttaccgcttgcacgcgaactatacgacttgctggatgcgcagaagcttgattccccatttggattacgacgcgccgttgttcacctgctggcgcgatttgataccgtgattgaacggctaggctatcaaccgaccaacgatgctgaatttgcaacgttgacgcctgttctgtcgcatcggcaattacgccttaccttggatcaggttttcatgatcaaacacagtggctaccgtgatcgcgagaccaaggaacccgcatatgttgccatgggacgcagcgatgagcaaaatgcgtttgtactgcccttgccagaaaaagaaacaacgccagaagcctttcagcagttgtatcaacaatcgctgaatgacattctgacgcagtatcggctcgactacacgattcgttaatgccggccaaagttgatgaagaaactattggaaacggaatgaacaccgagcatgatgacctgataaaggacgaaggcaaagaaaacaaggacgatgaccatgatcagataactaataacgtgtgaccaccgaaatgacttcatgatcaagactcctttctgaaagtatttctactgttatgttacaccttttttggtttaaattaatagcgcatgtgaaccatttaaacgcaacttgaaatattaaagatgcgtcatgctaaggattggcggtttgattgcgtattgtcatcgttgaaaaatatctgctaaaagatgagcgcgtgaacgaacgcgtttagaaaccggggcataagcggccttttaggcttgaggtctttatgtgcaggtttctgagccggtgatcgcgtttaaggagggaccatatatgtttgatctgcaaactgcaattcagcaggcgaagcatgtgacattcatgactggggcaggggtatcaacagcatcagggattccggattatcgttccaagggcgggctatacgccgatcaagtcgatccggaatatgcactgtctattgataatttacaagcacatcatgaagattttcataagtttgttgtcaataatatgtactttccagcggctaaaccgaacgttattcacgagaaaatggcaaccatcaccaatcaaaaaggtacgattgttacgcagaatgttgacggcctcaatcgtaaggccggtgcagagcatgttgttgaatttcatggcaatctttatcgcatttattgccaaacttgtcacaagcattttgactacgagacctatctgaaaagtgatgttcatgcagctgacggtggtattttgcgaccagatattgtgttgtatggtgagccaatcaatcccgataccgtcagcgcggcgatcgaagccatttcaactgcagatttgctgatcgtggtgggaacaagcttcgtggtttatccatttgcggggttgattggctatgcgcaaccagaggcgaccattgtcgctgtgaaccgtgaaaagatcgcattgccggaaggcgcgcatatggtgcagggggatgcggtggacgtatttgcgaagctggtagtctgaagcaatcacaacttagcttttgctcatcatctaggaaattctgtaagtgaaggcgaagcttccaaaaataactttgtgaggggatattgccatgaataaagggcggcttgaggcgtttacagatgcggttatcgccattatcctgacgattctggtgttagaattgcaaccgccgcacagtggatcattggcttcgttatggcaactacgcggagtttttgccatttatctagtgtcgtttttgacactcattgtttactggaataatcatcatcacttgtttcaactggtcgaacgaatcgattggcgggtgatgtgggcgaactctttcttcatgctggttgtgtcaatgtttccattcgccactagctgggtaggcgaaggacacgtagggacatttggccctgaattggcctatgggtttgtgatcttgatggccaatatcagctatgtgctattagtacaaaccctgattcgcgtcaatggaccaacatcggcattagcagacttatatcggcagcggcacaactggaaagcagcgacctcagtcgcgattgcacttgttgcgatgttattggctttgctttggccgccgttgacgatcatactagacttattgatgttgctgctatgggcgattccggatcagcgcattgaacgtcacttgatggctgattcaaaaaagaaatcacgccaatgaacgcattttgaaaaggagattttttatatggcaagaacaattggtattattggtattggacacgtaggtgtgaccacggcttttaatcttgtcagcaaaggggttgctgacaagttagtcttgattgataaaaaggctgaacttgctgaaggcgaaagctttgacttgaaggatgcgcttggcggcttgcccacttatactgacattgttgtcaacgattatgatgctttgaaagatgctgatgtggttatttccgcggtcggcaatattggcgccatttcaaatggtgatcgaattggagaaaccaagacttcaaaagtagcactagatgacgtcgctccaaaactgaaggcgtctggcttccatggcgttttgctagatatcaccaatccatgtgatgctgtcacgagttactggcaatatctcctagatttaccgaagtctcaaattattgggactgggacttcgctggatacttatcggatgcgacgggcggttgccgataccttgcatgtgaatgttgctgacgtgcgtggttacaatatgggcgaacatggcgaatcgcaatttaccgcttggtcaacagtacgggtcaataatgaaccgattgctgaatatgcgaaggttgattacgaccagcttgccgatgatgcgcgggcaggcggttggaagatttatcaggctaagcattatacgagctacggtatcgccaccatcgcgactgaaatgacacaggcgatcatcagcgatgcacatcgcatcttcccatgcgctaattacgatccagaattcggtattgctatcggtcatccagccatgatcggtaaacaaggtgttatcaagacgccaacgttgaagttgacagatgaagagcgtgctaagtatgttcactctgccggtatcattaaggatacctttgaaaaaatgaagtaggtccttttacgagcgctctttcacggtcagctaatctgggcggtttgacgcatcctcgcaaaaaagcctgtcatcaaagattcaaaagagacgccatttcggcgcctttttgctagtgatgatcccaaagcaaaggagcaaacatggtcaaaaaatataccttagtcactgtcgaaaccccaagcggctggttgctaattaatcggacgaatccaccatatcgtggcatgtggaatacattgggtgggaaattcctgcctaatgaaaccccagctacttgcgcctcacgtgaattgcaggaagaaagtcacattattattcccccgcatgatctgatcaatggcgggcgtgtgttctggcatgttgatggtgagttgcgggccgaactttttgccttctttggccatacggaagacgagctggtgatgccgcgagccacccgggagggcattttagcgactttttcaaaagattggttgttagcggataatcccggcttggtaccagatttacagccactgttgcactatgcgctgaatggcgaacgccatgattatgcatcttattttaccggcgatcggttagaagatttttgcatcgcggatggtgaaattgatgattaatgttggtttgacgagtgtagccgatcatccagaattagcgacgcgtggcaatcggagtacgttttcggattacgctcagcattttcctgtactggagttggacacgacgttttatggattgaagcctgtggaacaggttcgccactggcaggcccaagtgccatctgggtttcagttcataattaaagcgacgcgaaccatgacgaaacacgaagaaagtgcagacacagtcgctgacttttccaaatttaatgatatggtggcaccgctggttgcaagccatcagttgcaggcggtgctgtgccaatttccgccatattttggcgtgaccgcagaaaatgtacgctacttgcagcaactaaatcgtttgctgccggatttacctgttgccattgaatttcgccatcctagctggtatttgccggcttatcgtgccaacacgatggcgctgttgcaagcagccagcgacattcacgtgatcgttgatgaagcgcagacgaccagcggctcagtgccgcttgtgccaattgcaacgaatgccgatttaaccatgatgcgcttgcatggccgaaatccggcatggggtcgaaccggcgccaaaacgactgaaagaaccaattatcgttacagccaagaagaactgcagcagtttggtatcatcgctcagcatttgaaaagtaaaaatgttactgtcatcttcaacaataatggtggtcacgatgctgcagccaatgcgcaaagtttgatcgatttgttgggtctggactttccgggtcttgccccacgacaattagatctgttttgatgctgattaagttgggatcaaagaggccggctcggataacagcacagcgctaagttagcattgagagcaaacatatcatcttcgaagcgcgaccaccgatccagaaactgggttggcgatcgcgcttcgattctttctgacaccatgatcaatgcgtagtacaatcgcggtaaggatcatcatttttaagaaggagactggtgcatctatgaaaatccaagaaggctacatgccgtttcatgaatataaaacttattaccgaatcgttggcgaacctagtgctgataaggcgccgctgttactgattcacggtggaccggggtcgtcgcataattattttgaactcatggacgactatgccgaaaccggccggcaactgattatgtacgaccaagtcggctgcgggaagtcgtcactaccagaagatccggcggtttatgttaaagaaacttgggcagaagagttgatcgccttacgaaagtacctgcacctcgatgagcttcacatgcttggtcaatcatggggcggtatgctggaaatgtattatttaaccagcttcgatcctcaaggtatcaagagtgtgatgattgacggctcgccgtcatctattaagttgtggattcaggaacaacatcgcctgatcaaatacctgagttatgaagatcgcgaagccatcgcagaagcagaacgaaccggcgactttacgaatgtgaaatatctggcggccaatgatcgctacatggaaaagtactgctgggatgatccagacgaaaactcacctgaaccgctacgccggccaactaacggcaaacgagccagtttaattgctgaaggccccaatgaatttactgaaaatgggacgattagcgacttcgatgtaaccgatcagctcaaaaacattcacgttccggttttggtgaccaatgggactgatgacctctgcacgccgcttattgcgaaaacagttgtcgatcatattcctaacgccaaatggcatctcttcgccaacagtcggcatttggcgctgcttgaccaacatgatgaatttatcagtgttttggatcactggttagcagcaaatgattagctgtgggcaactatacagccccgctgtttcctatgctatactagactcattctgaactaatgtacgggaggcccttgcatggcaagcaaaccaactttttacgtaacaacaccaatttattacccatctggcaaactacatatcggcaatgcctacaccaccattgcagcagacgtgctcgcacggtataagcggctcatgggctacgacgttttcttcctaactgggaccgacgaacatggcctgaaaatcgagcaaaaggctgataagttaggggtgacgccacaagcttatgttgatggcatggcgacccaaatcaagcagctttggaaaatgcttgaaatcactaatgacaagtttatccggaccactgacaaggaacatgtcgaagccgttcaaacgattgtggaacgtctcatcaaacaaggggacgtctatttaggcgaatacactggctggtactccgttgaagacgaggaatacttcacggaatctcaactgtcagaagtttatcgcgataaagacggcaacgtgaccggcgggaaagcgccgtctggtcatgaagtgcagctggttcacgaaccaagttacttctttaagatgagcaagtacaccgatcgcttgttgaagtattatgacgagcatccggattttgttcaaccggcttcacgcaaaactgaaatgatcaataactttatcaaaccgggtctggaagatctggcgatgagccggacgagcttcaattggggtgtccagattccatccgatccgaagcacgttgtttacgtgtgggttgatgcgctgctgaactatatcaccgccctaggctatggcagtaatgatcatgctttgtttgacaaatactggccagccaacgtccaattgattggtaaggagattgttcgtttccacattatctattggccaattattttaatggcactcggcttgccgttgccaaagaaaatttatgcccatggctggctagtcatgaaagatggcaaaatgagtaagtcgaaaggcaatgccatttatccggacatgattgttgaacggtatggcttggatgctttgcggtattacttgatgcgcgccattccgattggtaatgatggtattttcacaccagaagactttattgaccgaatcaattacgacttggccaatgacctcggcaatctgttgaatcggactattgccatgattaacaagtatgaagacggtattttgccagcctttaaaccggatgtaacgccgtttgatcaagatcttggcgatgtggcgcaggcggctttggcgcaatatcacaaattgatggacgagttgcgtttctccgatgctttggatcaagtctggaaaattgtttcccgggcgaacaagtatatcgacgaaacggaaccgtggaatctggccaaagatcctgccaaaaaagatcagcttgatgctgtgatggctcacttggccgaaagcttgcgtctgattgctttactgattcaaccagtgatgacccatgcaccgttgcaaatcttcggtcagcttggcttggatcatgaaaatgacgaccacaagcttgtccaatggggcgctttgccagctggtgctaaagtggttgaacaaggcacaccaatcttcccacgtcttgatacggaagaagaagtcgcttatatcaagagcaagatgacccctggcaccacgaaagccactgtcgacgaaaaaactcggaagtcagaaatcgagttcaaacaattcgataagagcgaaattcgggtcgcagaaattttgaatgtcgaaccggttaaaggcgctgataagttattgaagttcacgctcgatgcaggcgatgaaggcacacggcaaattctttccggtattcgtgaattttacccagaatatgagaagctgaaaggcaaaaaggttatggccgtggtcaacttgaagccgcgcaagctaaaaggcgaaatgtctgaaggcatgttgttgtcggctgaaagtttagacggcaagaaaatcactttgctggaagtctctgagaacttagagaatggcagcttggttggttaattgaaaggcaatgaaaaacactcgactagttgtggtcgagtgttttttgatggtcagagataatgtcgcaacagttggtaaagttttttcgtcccgtattgtcaatctaagtgcaacagtttctagtccaatcctataagtggtactattgcttggataatctggcatgacaaactcctcagtcggttttccacaattctatcagattcagcagatactagacaggttctaagatgaccaattctgccgatacgccagctgtgtgcaacttgttaatagcctgttcaccgcgtgcttgattgcgcgcaccgacaagcaaatgctgaccgcgtttaccaagcgccattgcggtttcaaagcctatccctttatcggcaccggtgatcaaagttaacgtctgtcgtttaaccatgatcctcacttctttcaattattgaccctatttttctggctgatgaggggcgtattgacgatcagggaaccagattggaatttcacgtcgggcacttgtctcactatcggaactgtgaatgacgttgcgaatagttttgtcggcccattcacggccaaaatctccacgaatcgtgccgggcgctgcttcggcgggattcgtggcgcctgtcattttacgcaccgcttcgatcacattgaagccgctcacgatcattgccaccatcggaccgcccgtcatgaagcgttcgattcttggaaagaaaggctcgccaacaagtgctgcgtaatgctgatgtaactgatctgccgttgcatgtgtgactttcagtgcatcaattgtgaagccgcggtgttcaatccgcgtgatcacatccccaatatgtccgtttgcaacaccatccggtttgaccaagactaaagtttgttcttctgccatgtgtgtgtgcctcgtttccttaactattttcagaaaattcctgcaatctcagtatacacgagtcaccgtcgaacaaaaaaggtcgttgggcattttcatcgttttcatcgccaattgatttttgacaaaacacggcgaccaagaaattcttgaattaacaagtaaaacggaacagttgagatcatgagtggcaaataaattaatgcgagttgccactgccagagattgacaagtgaaaaaattgagctgaagacgaagaagacaagaaacagggcaatggtgagaccacccagtaggccaaccttgaatcggttgaaaggtcgggcaacgacgagcagaacattcaatgaaatagtgccaatcaacatggctaccattgatgaagtggactcaaaactcaagtggaagaaagactccatccatgtcagcagtaatgtgtagatgacgacactaatggcagcaggtgcggcaatggtcatgaccttctgcataaattgaccagtcacgcgttcgaagtttggttccaaagtcaggaagaaggaaggaatggcaaccccgatagcagaaaccggtgtgaggttaatcggtacaatcggataatcaagtggcaagaagacaaaaatagtggctaggatgactgaatacatcgttttgaccaaatacatggatgccacgcgttcaatgttgttgatgactcggcggccttcgtttagaacgccggtcatggcatcgaagtttgaatctaacaaaacgaaatccgcaatagagctggcaacatcggcaccagatgccattgcgatactgcagtcgctttgacgcaatgccaagacgtcattcacaccgtcaccggtcatggcgacggtgtgccccaaagcttgataggccataattaaagatttcttctgttcaggtgtgacccggccaaaaacgttatagcgtttcacaagtgtttgataatctttggcggttgcgttgtctgcaatggtgctcatgtccacactttgatcagctccttcaaggcgagcttgcttggcaatgttggcgaccgtgatcggatcatcacctgagatgacttttaaagccaccccttgcgttttgaagaagtcgaacgtattaatggcagttggccgcaattcatcggtgatcaaaatcagaccgagcagttggggattaactaacggatgcactaatttggttgctgtgccaatggctaaaacccggtagcccttagcagctgcatccttaatttgatttgcaatcggtgttggtaattgatcgccgaatgtgaactgcggggcgcccataaacaatacttgaccatcaacaacggcacccgaccacttacgcgcagaggagaagggcattgtctgcgtgacttgctgattggtatcgttttggaaggcggctttgatggccattgctgtttcgttgtcgtcatttagagcataaacaatagcggcggcggctttggtgactgtcgcttcagtttgcccagtcattggcaatgtttcggcaactttaagtttgccactcgtgatagtaccggttttgtcaagacagatagtatcaactcgtgcgagtgcttcaatggccggcaaggcgcgaacgagaactcgtttaacggcaagattgcgggcggatacggctaatgccacatttgttagcaaaaccagaccttcaggaatcatgccgatcatggcggcactggttgttaaaatagcccgattatagttgccccggcggatcatcgagacggtgaaaagaattgcgccaatcgggataagcacataagttaacacgcgaatgatgcgattgatcgttgccaacagttgacttttgctacctttttcggctttggctgccaaagcaagctttgccgcaaaagttgcggcgccaaccgcggtgacttgcatggttgcctgaccggaaacgataaatgcgccagaaagcagcttgtcgcccacttttttagtgatgggtcgagactcaccagttaaaggactctcgtcactttcgagaccattcgttgcgacaaccacaccatcgacaggaatctgatcaccgcgtttcaggtgcaccatgtcatccataaccaattgttcaagctcgattttttgtgttttgccatcacgaatgacggtggctcgagcagctgccaaaattgacattttatcaatctggtgcttcgcctgaatttcttgaatggtcccgatcgccgtgttgatgaccgcgacaccgagaaagagtaagttcttataactgcccgtagtcacaatcaaagcacctaaaaccacgttcaccaagttaaataaggtgaacgtatttactttgataatttggctaattgatcgcgttaatggttttaacggcaagttatgttgacccgcggcaaaccgttcttcaacttgctttgttgataatccctgatccggcaaaatgttctgctcagccatcgcatgccctccaatgcttttcattcattttaccaatcaatcccggtagatgacgaataagcgacctgtttttattaaactttgaagagtcttataagattgcgaagtggcttaatgttgttcatcaaccacgaaactcgcataatggaagacaaacgacaagaaagaagcggttgtatgccaaaacttaatccagacgggacgcaattcatcacgttatcgagtgggtaccatttgtggacacagacgcaaggaaaaggtgatatccatctcatgaccttgcatggtggcccaggcggcaccaatgaagtctttgaaaattttgctgagcagctagcgccttatggtgtgcgcgtgactcgttatgatcagttggggtcattttactccgaccagccagatttctccgatccggcaaatcgtcagcagtttctgaacattgattactatctgagcgaagtggagcaggttcgacagcagcttgggattgaccacttttatctgcttggtcaatcgtggggcggggtgctggcaattgaatatgcattgaaatacccagagcatcttaacggagtcattctgagttcgatgattgacaatcttgacgaatatattgtgaacatcaatcggattcgggaaactatgttttcaaaagaagatgtcgcttacatgcagcaaattgaacagcagcatgcgttcgatgatgcaaaatatcaggcgcttgtaagtgagctaggcgaacactacttgcatcatgcaaaagatccgcagccgcgtcacttaatcagtacgctggccacgccagtttacaattattttcaaggcgacaatgaatttgtgatggtgggtgcgcttaaagattgggatcggcgtgcagatatccaccgtatcgccgtacccacctacctgacattcggcggtcatgaaacgatgccgctggtagccgcggaacgcatggcgaagacaatcccagacgctaccttacatgtcacgccgaatgctggtcatggacaaatgctggataaccccactgactatttcagtcatttaggtgattggctggtcaaaaccgacacgaagacggcttttcattctaaataacgttataataagaatggtaaggtaagtttttcaaaatatggaggtgcttgcatgtctgaatatgatgaattaaaaacaagcttgttcgaacctgtacgagcgtttgatcgggcattggaacaacagccggatttaatcattccattggcagttgttcacttgattccaattgctctgacacttggtggcgggattgctatcattcggggtcaccagaaactgcgtgccgaaaaagagcgcacgaagcagttgagcttgaagctggagatgcataaacatcatcatggtcggcgtaattggcggctggcgccagaacatcgcggcgagcaggatgtttttgctccagaatatttggagaaaccggctggtaaaaatcgtcacgcccatcgtcggcattaggttgatttgatacatgaatagatcaaaagcctgagcaattatctattgctcaggcttttttgcttaagtatgcgcagctttacgtgttgatttttcacctgtgaacatgtttatcgccgtgtccagagccgtatgtaaaaaaatttcttgcccatttttttacatattattaaccacaaaaactgccgcgcacttttatgcgccgtcattgaaacgggcgacaaaatgcgggacaatgggtgcacgataatttaggagatgatgttgatgccagttatgttgatgcgtactgctacccgagaagatattcccgcgatgatgaagattattgcttctgctcggcaatttttgggcgaacaaggtatttcacaatggcaaggaacctatcccgatcaggctgcggttgaacaagatgtagcgacaggcatcgggcgagttttggtcgttgatgggcaggttgccggcatagccgctttggtggaaggtcctgatccgcattatctcaaaattgatggtgctggttggttggccgatgtgccctatttggcagttcatcgatttgcgcttgatggcagcattcgtggtcatcaattaagtaaagttttctttagtaatattatgactgaagcctatcgacgcggtgtctatgacctgcgcgtggatacgcatccccaaaatgtgatcatgcagcatgccatcaccggaatgggcttcgagtatcgaggctttgtttacatggatgaaccggttcctgaacgcaatgcttatgaggttcgtttggcacactaacagaaagacacgaaatggaggagatcgacatgcaggacattggcaacttggcactgatcttagtcacaacgctggttttagcgcatttaagccgattgttgaatatgcccgctgtcattggggaattattggctggtattttgattggaccggcgttattgggctggttggcaccaagtcacacggtttcattatttgcggagattggtgtcattattttgatgtttcttgctggcttggaaagtgaccttgatttattaaaaaaatacttcaaaccaggcatgttggtcgccatgatcggcgtcattgtaccggtggctgttgtgttcgtttttggacgcagttggggcttcaacatgacaagcagtctattcttaggcattacctttgccgctacttctgtttcgatctctgttgaggttttaaaagagctacatgccctagaaggccgaaatggtgcgaccattctcggtgcggcggtggttgatgatattctcactgtcctcattttaagtttcacggtagcagtccttggtgagaaaaagaccgcgagtttacctttctgggtgcaaatcattgaacagttgctctactttgccggcatttatttggttgtcaggtgggctgcgccatacttaatgggtttggcagaaaaaatgtttccgtcgtcggctgtgaccattatgtctctgctcatttgcctcggtatggcctatctggctgatcttgtgggtatgtccgccgttatcggcgctttcttcgctggcgtggcagtaggccagacacgtcatcgccatgaagtggatggtagtttgagtgcgattgggtatgccgtgtttattccggtgttctttgtcagcgtcggcttgaatatgcggtttgatacctttggccgcgatctagggtttattgcgattttgaccttattagccttagtcacaaaatgggtcggctgtggggttggtgatcgtttggccggtgcgagttggctacagagtaatgtcgtgggtgccggcatggtttcccgtggcgagatggcattgattgtcgcccaaattgggttcgaggccaaactcatggacgctgaatattactcggcggttattgttgtgattgtcctgacgacattgattgccccaattatcttgaaagatgcgctacggcgtgaacaggaacctgtataataaagatgcgcgtctatttaacgcgacataaagccgagcgtgcgtgcgagttcttaaaaatgtgttgactgggcaatcattgcgggactggcggccgcgtttatgagggggattcaaatggctaatttgttttttgactttgatggcaccgttgctgattcggaagtcggtatcgttgcaggattaaaatatatggttcaggatcgcggattgcggccgctggacaattcggcctacacgcaatttatcggaccagcgctgattgatatgcttcccaaggtttggccagaacttgatgacattgaagttaagcgggccattgatgctttccatcattattacgaagaggaaggcctttatcaggttgaattgtatcctaattttctggacacgatggcaaagctcaagcaacaagacaaccaactttacattgcctcggctaagccagaaacaatgctgcatcgccttgtaaagcacttttcgttggaccaatattttgctggtgcgtacggtgcaagtgacgatgaggaaacccgggtcacgaaaaccgatattttgacctatgcgctaaaagacagtcaagttgcgctcgatcaaagtgtcatgattggtgatcgggccaatgacatgattggtggtaaggccaatcatgttcaattgctgggtgtgacgtacggctttggttctgctaaagaactaaaagaagccggtgccaaagtcttagttgatcaaccggcagaaattcctgcaggactggcgaagctagcaaagatcaacgcaaaatagtgccctaatcaagcttgattaaggaaccagacaaaaaagacgtgcctgtaaatggcacgtcttttttgtctggcacgagataccgaattattgatcgttctcagaagtttgttggggatgaatcagtttctcaccaatttcattgagcaagtcaacaaactgtttggctttgtcctcgccaagtgcagtaacccactgatcgaagcgatcagtagcagttttagtgatctccgcctcaacttgttttccaagcggcgttaatcgtaaagtgttacgccgacggtcagctgcaaacttggtctgggtcacgtaattgagattgcgcagtacgcgcagttggcgggccacggccggtttcgtgacgcctcgtttggcgacaatggcagtcaggctaatatcgggatcatgggcaatatcagatagaatccgaaattgttcaaaactaagatggtattttgccatcggtgccgagattagctcattaatacttttgaatgttgaaaaataggcatccacatatgcctgtagcaaagattcatcagtcatctttcttcctccaaagtttatcttaacaaatcataccgcaactgtaacttgaaattattaaaagttgcggtacactttttagttatgtaaagggctttaactacttatggaggctattagtgtgcgaaaacataaaaaagcttggctgattgggctgttatcaatcttcggtgttctgcttatgggattagttggcgccagtctgtatttctaccaatatgcatttgtgccatcaaaaaaatcttttttgagtggtggcgaaagtcgaattgtcaaggacggtaaggcgtggcttaaaaccgttcataaggaaacgtggaccgaaaaggcggctggtgccgatttgaacctggttgccgactatgtgccagcggcgaaaccaacgaacaagacggtggtggtcgctcacggatacatgaacaccaaagaattcatggcgccgcaaatcaaaatgtttcatgatgcagggtttaatgttttggccccagatgatcgcggccatggacaatcgcaaggaaactacatcgggtatggctggccagatcggctggattatttgaagtggatcaatcaaatcatcaagaaacagggccagcaaagtcaaatcgcgttgtatggcgtctctatgggcggcgcaacagtgatgtatctgagtggcgaaaaattgccatcccaagtcaaaagtattgtcgaagattgtggctataccagtattattgatgaactgacttatcaagccaaagcaatgttcaatctgcctaaatggccgctgattccgtcagtggcactcacagccacgatcaaagccggttataacgtatttgatgccagtgccatcaccgcgttgcacaaaaatacccgccccattttgtttattcacggcagcaaggataagtttgtaccaaccagcatggtgtatcaaaactaccgagcagccacaaaatccaagaaggccttgtgggtcgttaagggggcagggcacgcgaagagttttcctgatcatcaacaagcctacagcaagcgagttgtcggctggtttaacgcaaactggtgaagcgcagcgttactgggcggcattggtggcagcaacccgctttaaaatcgcgtagattttctcagcatcacttggggtcccgcgtaattcgtaatcggccaagaagggcgcatcgaattctttggcatagcgtttagccgtgagacagtattgttcgttaaagttccgattgccagaaccaatgatgccaatgcattgatcagcgttttcgccttctgccagatagtcacccatggcagtggtcatcaactccttgacgccgttatcaataccattaccgccgtcaagataagttggcaccatgacaaaaaatggtttggtttcaccgtcactttgtgtggcatcagaaatttctttcagcacaattgttggattagcagcattctgatcatgttgcgtttgtgcatagactgccaagcgatgggcaaaagcccgagtattgccagaaatagaaataaataaaacgtggataggttcagtcattgtgatggcctcttttcatgattgtgagcatggcacaagcctttgcagtcgcttgctttttgccgatatgccaaacgaagaacagctaaaaagagtcgcggtacagcagccaagtgcttgcaccacggctcttttttgcggcgttagaattcttgataaactgccggatcttgatccttgagccgaccatccggttttgtcagactgtcaatggcggccatttcttcgttcgttagtgtaaagtcaaacacatcgagattggtgcgttgacgggcaaggtgtgcggactttggaatcggtaagatctgatgttgcagatcccagcgtaagataacctgaccaacatttttaccgtgtgccgcagcaatctttttgatgcttggttcctgtaaaaccgcgccgcgacccaatggactccaagcaactgtttggatattgtgcgccgcgtcatactcacgttgcgcttgttggttgaagtaaggatgcaactcaatttgattaacagctggcgtcacgtcggtttctttaattagccgatcaatatgctcaggcaaaaagtttgaaacgccgattgagcgaaccaatccaaaccgttgtgcctgaatcaaggcttgccaagcttccacgtaaagatcctctttaggatttggccagtgaattaaatagagatcgtaataatccaaaccagcacgataaagactttcttcgatggtatcgatggcttcttgataacgatgatgacgacctggcagttttgaagcaatcgttaattgactgcgcggaatgccgctttggcgaacggcctcaccaacggcaccttcattttcgtagttaaaagcggcatccaacatgcgatagccgacattgacggctcccaccattgctcgaacgccattagcaccattaagtttgtaggtgccaaaaccgattgctggtaggacgttgccgtcgtttaaggtgtaattcattcttgtgaacctcctttaagatgtgctcatagtcaaacaggacacagatgactagctgatgggattgaataagtgctcggaccaatcagttaagaaaccaaattcatcagtgcaacagttcctatacgtcgctgcgtccgcttttttaagctgcacaatactatatatagtgtagtccaaacgtagtcatgcatacaagcatcgacaaaccttcgtgtataataaagccaaaagatagcgcgcaaaccagtctagtttctgtgctggtaggagttttacgcgtttacaaagaggggattatcacgaaaacacaacaatggcgagccgtttcacgaagctggtttgcactattcacgatgattttttgggtattattatttgtcgaagcttttagtacagggatgatgctcacaattggctcaccagtgcggaccgaggcggttatcgtcaagagtaaaggcctagatcaattgacgcaaacgttgaatcagcagttgttaacaactgcagcgaaaagtggggcatcactggataaaagaacagtgctcgtcactacagatgatacccagagactggctaagaatatggtggcggccagttcactacatcagccacatgtttcgttgacgaccattgaagagagtgtcacaagtcgcttacaaacggcagcgactgtgcagcatcaaaattttgatcaaaaaaaagtactcgccagcttgaaaacaacgcttgagcgcgaaattaatttacacgtgatggcacaaggctggggattagtttatccattgctggttttgatgacgcaaacagctgtgattgtcgcggcgatcctgatggcctttgttttgctcattatgatcaaaaccgctcattcatggcggcgtttcttagcagtaactggtcgttcgacctatgtcatgggatatattggcggattcatggccatgtttgtcaccgcgaatcctttcttaggtgctgttgtatcacgcattgcgattaatcaacaactgacacgtgatctgattctggcttactcgccaatatggcagtgcgtcgcaggatggacgattatcatcggtttgcttgttgcgggtgtaagccactttttcccgcgcgctcaggctgaggacgatgacttattaacggctgaaaggagtgctttatgaaactaaaacgctgggttgttatcgtatttgcggcggttgtggttatcgctggagcgggttggtactggtatcaggaacaacccaccgatacaccgacgacagagaaaacgacgattggtcaaaccgcaacgctatacttgcatggctattcagggggtgctggctcgactaataccttgattcgacatgctgagcagtctggcgcaactaaggtgctcacggccactgtcgctaaaaatggtaaagttagctggcaagggaatgcacggcatgtcagcaagccgatagttcaggtgatttttcaggataatgtcaatccggattacgccaagctagcgggttggttgacgaccattaatcgcgaactttatcaacgttacggcgttcgccaggtcaaccttgtggcccattcgatgggcaatatggcagtgatgttctatgcaactcaaaactcagatcaccctaaattgccaaaaatgcgggcttacgtggcgattgctggccattttgacggtattatcggcatgggcgatgagcctcatcgtattaaacttgctccaaacggttatccgacgccgccggatgagaattatgccacgttagacagaatgcgcgatcgttttccaaaaaatgtgaaggttttgaacatttatggcgatgtggatgatggttcagactcagacggtcgtgtcgcaaacaattcatcgcgctcattgcagtacctagttgaagggcgcgccgccagttatcaagaaaaagaatttgttggcaaaaaagcgcagcatagtgcgcttcatgaaaatccacaggtggctaaggcggttgataattttatttggtgagggtatgcgctagtttttgttagggtcatacggcgtgacaacgactttgccactaagatagttggccatgtaaacgtcgccagtttcatagccttgctcctgtagctgtgctttcagccagtcttcatcatgatcaatggcatcaagtgcggcgggatcaatctggccatctagaatcaacgggtatttgatggtttcatcgcctttgaggatgacattaagctgaccattttgttctagataggcttgccgaacatcgcgaagatcgtttacgccagtagttcgtaatttgtaagccaaatcatttgccgaaagaccgacttgagtcgccgtctctacacgaattttgccatgctgcacgaccaataaaggcttgccgtcaatcagacgcttgatccagcggttatggttagttaagtatttcgaactgaaaacaatgagtgtccaaatcagcagtaggtttacaaattggagcaagccgatatcagtattgtaaatcaccccgccgataataccgccaaggacgtaattctgcatttgatcaacaatcgttgctggggcaaggttacctttgccggtgagcttgatttgggcgacgaacacaatgaagcctagtaagagtttcattgccgtgatgaaatatggatctctaaaaagttgcatgacagcctcctacttagtcacaaagtttgcttgaggtacaatcaaggtggttttatctagctggtagctattgttgtccgcattgatcgtcaccgtaaacatggttttcgttgacttaccgatggtgacgagcatgccagtgtgaaccgtgctgctgttagcatagacttgttgcacacccacctgtttttgcttggcgacactgcgcaacagtgtcgcgactgcctgtgaatcagcggttgcggtgcggctcgcttgcagatcacgaatttgaatgccgatggttaatagttcaatcaacgcaactaaaattaatagatcgcgatatttgtttgtgtgtttgtggcgcaaaaaatagatgagataggcgacaatcacaacagctcctgccatgatgatgatgtaacggaaggtactttgccaagtagtttggcgagttaagacgctgtaagcataaaaagttgttcccatgagacacctccaaaaaagtaactaccaaaagcataacagaaacagaacatgacagaagttattcttgacagtttgattggcggtgttatgataatgccaacttagacagacagattgctttgcggagaagagtacctgaagcgcagatcacaagcgagcctgaacagtgaaagcaggcgatcagttaatcagggaagatgagctccaaacagcttttcagcggttcacgccactgaaacgggcgcacccgttaccatgccgggtatcaaaattggtaccgttgaggcattggcatcaaaaccagtgcgaataagggtggtaacgcgcaaagtcgccccttgatcagaaatggtcaaggggcgacttttttgtgagcgcgagccagcccaaacccacttcccaagccatcgtaagcaccgccccctcccaacattctttccgcaaaagccatcactgcgtctgtcgacgaaaaataaggaggaccaccatcatgacagaaaaagttcaaataaaagctcctttccgcgccgatttagtcggcagcttgcttcggcctgaacgcttaaaagcggcgcatcaacaacttgcgatcggtgaaattaaacaagatcaggaacttaacattcaacacgcagccattgagcgtattgtcaaacgacaaattgaacttggcttcaaagctgtgacagatggtgagttctcccgccgttattggcatctagactttttatggggcttgaacggttttgaaaaagatgatagttggcagtatgaacacgacttcaaaggcggcattaacgcagctgctaatgtgcatcttgctgggaaagtcaacttcaatcctgatcacccattttttgccgcctttaagtatttgcagagcattgtgccagaaggggttctccccaaacagaccatcccgagtcctgcattgctctttcgtgaccatcgcagcgataactgggcaaaatattatgacagatttgatgattatttggctgacgttgtccaagcctatgtggatacgattcaacatttttatgatttaggtgcccgctatcttcaaattgacgatactaactgggcctacttgattcagaatctaaaagatactgaaaatgatcccaaggcgcatcagcggtttattgacctcgctaaattggcacaccgcgtgatcaaggcggttttggtgaaactgccagaagacttgaccgtgacgtcgcatatctgtcgcggcaatttccagtcgacattcctgttttccggcgggtatcaatatgtggcagattacatcggtgatttgccgtatgacggcttattcttagagtatgataatcagcgttcagggtcttttgaaccgctagcaaagttgtggcacggcgatactaataagcgtattgtcctaggcctgatcacttcgaagtttcctgaattggaagatgaggatgccgttatcaagcgaattaacgctgcgactgagtacgtaccgctgacgaatctggcgttgtccactcaatgcggttttgcttcaaccgaagaagataacaaggttactgaagatgaccagtgggggaactggctctggttcaaaaaattgccaagcgagtttgggcggatgcttagattgttttttcacttatgtttcggcttctgagcgctactgctcgcgctcagatttttttaacagataccactgttgtgttatatgataaatgtgtcatcaaaactaaaagggagatttctatattatggcaaaagttgaaagtttcaccttggatcacacagctgttaaagcaccttatgttcggttgattacgacagagcatggtgcaaagggtgatgtgatttcaaactatgatttgcggttggtacaaccaaacacagcagccattgatacagctggcttgcacacgattgaacacttgctggcatcgttattgcgtgatcggatggacggcgttattgattgttcaccattcggctgccgcaccggtttccacttgattacttggggtgagcacagcacaaccgaagtggccaaggctttgaagtcaagcttagaggccattgctaatgacattacttgggatgacgtccctggtgttgacatcaagagttgtggcaattacaaggatcacagcctgttttcagcaaaggaatgggcgaagttaattttgagccgcggcatttcaaatgacccgtacacgtgtcaggttgtctgaggcttggtttcaaaagtatcccaccaactcaaaattgccgcataaaaatggcactgctacaactcgctaaatgagtttgacagtgccattttcatgttcgaaggattattgaaataagtggattagccattgcccgccataaatcaaactcatactgtaggcgaggatcgtgataggtttgcctaaaataatgatccaaaaaaactttttaaaggtcattttagttaacccggcaagcagacacaaaacgtcgtcaggagcaaccggcaaaatgatagcaagcgtgaaaaagcgatcgaagcgttgctgatttttggtatagccgatgtatttgttataggttttttcagagatcagataagtaagcagcggcttaccaaatcgccgagcaagatggaaattgataaacgagccaattgcaataccgatgtagttgtaaaaaaagcctgtccatgggccaaacaaaatcacgccagccgccgtactgacaccgccaggaatgatcgggatgacaacctgaatgacttgaatgagcataaaaaataaagcgccggctattccgaggcgagcaatgtaagcctgcagagcattgatgtttgaaagaatacctaagtcataccagtaaatggctactgctgctaataagataacaacaacgatggtggcaaaattaatcagacgacgcacattttttggattcatatatttttggcctcagaacagttcatcatcaggaaaacatctatgctacaatgaatcaagcataccaaacatacgtactgaatggagagcttatgtacgagtattttgaaggcattattcaggcggtgaccccggcttacatcgtcatcgatgtgcatggcatcgggttccgtctgctggtagccaacccttatcattttgaagctggcgagcaaaaacgtgtttatgtgcagctgatcattcgcgacaacgaccagacactttatggattcgaaggtgctgcggataagcgtacctttaaccagctattgacggtcacaggcattggcccgaagtcagcgttggccattttggcgaacgtgtctagcggcggcttggcgactgcgattgctcaagatgatgtgaagtttctgactaagtttcctgggatcggtaagaaaacagctgcccagattatccttgatctcaaaggtaaaatcacaacagatggacaaccagcggcagcagcgattgcgccagttgccagtgacgttgattcggaactcgcagatgcgttagcggcactcgtggcgttgggctacccgcaacgcaccgttgatggtctcactgacacactgaaggcattcagtgccaagacaactgatgcctatttacgcgaaggcttgcggctattaagcggcaaggcttaggcttgattatactgaagctgaccgttgacgacaacggaagcggcttttgaatcacgataaaatttttcccgtgcttttaatagcatgttaactagagaggaagtgggcttttggcagacgcagacaaggatcgcttggtttctggcgacgttgacgattcgaatgaagcacagatcgaaaaaagtttacgtccccggatgctcgtgcagtatattggtcaggatcgcgtcaaacatcagttggaagtctatatcacggctgccaaacagcgcgaagagtcattggatcatgttctgctctatggaccgcctggtttgggaaaaacgacgttggctttggtgattgccaatgaactgggcgtcaatattcgcacgacatcggggcctgctatcgaaaaaccgggtgatttagtggcactgctgaatgaattgcatcccggtgatgtcttgttcattgatgaaattcaccgtctaccaaaaattgtcgaagaaatgctttattcagcgatggaagatttttatattgatattgtggttggtcaagggccaaccgcccaccctgtgcatttcccgcttcctcccttcaccttaattggggcgacaacgcgcgctggcatgctttccgctccgttacgtgatcgatttggcatcagtgaacatatggcgtattattctgctgatgacctcagtgagatcgtcaaacgatcagcaacaattttcgatatggcgattgatgctgaaggtgctcatgaaattgcccgacggtcgcggggaacaccgcgggttgctaatcggctgctcaaacgtatccgtgattttgccgaagttgcggggcagagtccagttgatatacaaatggttgaccatgcgcttgaccagctgcaagtcgatcagcaaggcttagaccaaattgatcgcaaactgttgatgttcatgattcgtgattacgaaggcggccccgttggactctcaacgattgccgctaacatcggcgaggaaatggcaacgattgaggaaatgtatgagccttatctgttacagatcgggtatttgaaacgaacgccgcgtggccgcatggtgacgccagccggatttgcacatatggggctgtcggctgagcaacattaggcaacatgctaaacgcgctcgcagtcgcagaagcttgcacataaggaccttgaagcctaaatggctaaagttctgccatttatgcttcaagcccacttatgctccggcttctaagcgctcctgctcgcgctcactgattaaaatgaatggaagcgaatatggtgcaagagaacaaacgttatcacaaagtagaagacaaacattatcagctatcggatttcgattatgacctgccgcatgaattgattgcgcagacacctttgaaggaacgtgatgccagtcggctgttggtattaaattctgaaactggtgagatgcaagataagcatttttacgacattcttgattatttcaagccaggtgatgcgttggtcatgaatgatacgcgggtgatgccagcgcgattgtatggggttaagccagagactggtgcccatatggaagtgttattgcttaacaacacgtctggtgatgattgggaaaccttgatgaagcctgcgcgcaaggctccggttggcacggtgattgattttggcgatggcttactaaaggccacagttacgaaggaactcgaacatggcggtcgaatgattcactttgactatgacggcatctttatggaaatcctcgataagttaggcgagacgccattgccgccttacatcaaggaaaagcttgaagatccagaaatgtatcaaactgtttattctaaagagctaggctctgcagcggcaccaacagccggtcttcactggaccaaagacttgctgaaaaaagtgcaagaaaagggcgtcaagttggtttacttgacgttgcatgttggcttgggtactttccggccagtagttgaggaaaacatcgaagcacataaaatgcacagtgaattttatcggttgactccggaagcagcagcgacactgaatgatgttcgcgacaatggcggtcgaattattgctaccggtacaacatccattcgcaccctcgaggccatcggtaccaaatttgatggtgccatcaaggcagattcgggttggactgacatttttatcaagccagggtatcagtggaaggttgttgatgcatttatcaccaacttccatttgccaaagtcaacgttagttatgctcgtggcagcgttcaccgggcgcgatacaattttaaatgcgtataagcatgcgatcgacgaaaaatatcgcttcttcagctttggcgatgcgatgttcatttactaatcacgaagctagtttctgctcactttagtgtgtttactagcccggcaacttgtctgtaaagagcttagccgcttactttccgggtgttaaccgctggcttgcgcgcaactatcacgcgttcgcagtcccagcaacttattcgcgctcactaaaaaatcggcttgcttaaatgcaagccgattttttaacggacgggatcacatcaacacataccaacagacatgtctcgatttttcttttaacgcatcgctgcgtggaacaacgtattcataggcgatcacaatggccgggtcaaaacccgggaagtgcgaaaactacggtaacggtgatcccgtccttaacttcattctaacagggaagatggtatgagaaaagcggaaagctcggactttcttgaaggttaagtcaatcatgatatgcatgcacttacttttaaataacaagtaactctgttaaactgacgtcacgagaaaatcaagcggcggtgctgcgagggcattgccatgaatgaggagaatgtatggaaccagcagttaagtatcgtctgattcatcaggataagcatagcggtgcgcggttgggtgaattgatcacgccgcacggcacatttcccaccccaatgtttatgcctgttggcacacaggcgagcgtgaaaacaatggcgcctgaagaattggatacgatgggggccacggttattttggcgaacacgtatcatctgtggttacggccggggccagaactgattgaagaagcgggcggcttgcacaagtttatgaactggcacaaaggtatcctgactgactcaggtggctttcaagtcttttcgctagccgacactagacatattactgaagaaggtgtcactttcaaaaatcatttgaatggtgccaagatgttcctgtccccagaaaaggcgatcgcaattgaaaacgcgttgggacctgacatcatgatgagtttggatgaatgtccgccgttttttgaaagctatgattatgttaaaaagagtgttgctcgaaccagtcgttgggctgaacgtggcttgcaggctcacaagaatcctgattggcaggcgctttttggtattgtgcaaggtgccggattcaaagacttgcgcgagcaaagtgctaaggatcttgttagcatggattttcctggttattcgattggtggcttgtctgttggtgaatcaaaagatgagatgaaccatgtccttgatttcactaccccgctgctgccggaaaacaaaccgcgctatttgatgggtgtcggctctgcggatgcgctgattgatggcgccttgcgtggcattgatatgtttgactgcgtcttaccaactcggattgcccgaaatggtacttgcatgaccagccgtggccggctcgtcattaaaaatgcgaaatatgcgcatgactttggaccgctggatcctaattgcgattgctacacgtgtcgtaactatagccgcgcctatattcgccatctgatccatgttggtgaagctttcggtattcggttgacgacctaccataatctctacttcttactgcacttgatgcagcaagtgcgtgaagcgattgccaatgatgatttgctggctttccgtgaagatttctttgaagcttacggatacaacaaggaaaaagcaaagaatttttagattatttggagtagaccgcctaattctgttacactgtttgttgacaaaataaaaataagaggtgcctaaattgaatggtaatatgacaatgatcattatgctgctgattttcgtgggcttcatgtattttggcatggttcgtccgcaaaagaaacaacagcaaaagcgtcaagaaatgttgaatcagcttaaaaaaggcgaccccatcatcacgatcggtgggttgcacggtgtcattgattcaatcgaccagcaagctggtacggttgtcattgattctgacggcatctatttaacctttaacttgagtgctgttcgcggcacagcaactcgtcctgcagcgcctgcaccagccgctaccgtgacaaaggctgaagaagcgcataatactgatgaacaacgcgaagctaaaccagttgaagaggctgcaccaaaggctgatgatcaaaccgatgccaaaagtgatagcaaggcagaagacgacaaatagattcgtcatctgatagagaattcaatataggtgacgtaagggaaggtgtttagccttctctttttttgcgttttaagagcggatcggcgcaaatcacagggagatgtcaaaacaacgatgcttttttaacaaatggctttaaaagacctacaagcaagaaaaaaacggcagatccacctttatagttcaaaaaaatacaaagtgaaatacgcaataaaagccaatgaacacaacaatatcagtgatcaagtcactttttcgtgaaaaaattcaccaaaattgtttacaaaatcacaaagaccggttatgatgttcttgtgaaatggttaacaaaaaaattccgcaaaacacttggaggtaagctcatgttaaagaatactgcgaagactgctaccgaagttgatgtaaagagcatggttgacgaactggttgcgaatgcgcatgccgctttgaagatcatgaaaacttttgatcaagaaaagatcgatcacatcgttcatcggatggcaatcgctggtttggatcatcatatggaattggcaaaactcgctgttgacgagacgggccgtggcgtgtgggaagataaagcgatcaagaacatgttcgccaccgaagaaatttggcactcaatcaagaacaacaagaccgttggtgtgatcaacgaagacaaacaacgcggcttggtatcgattgctgaaccaattggtgtcattgctggtgtgacgccagtgacgaacccaacttcaacgaccatgttcaaatccgaaattgccattaaaacccgtaatccaatcattttcgccttccatccgggtgcccaaaagtcttcagcgcgtgcgttggaggtcatccgtgatgaagccgaaaaagcaggcttaccaaagggtgctttgcaatatatccctgtaccaagtatggatgcgactaaagctttgatggatcaccctagtatcgccacgattctggcaacgggcggtcctggcatggttaagtccgcctattcatcaggcaagccagcactgggtgttggggccgggaatgcgccagcttacattgaaaccagcgctaacatcaaacaagctgtcaatgacttagtactttcaaagagttttgataatggcatgatctgtgcttccgaacaaggcgtgattattgattccagcatttacgatgatgtgaagaaggaatttgaagcccaaggtgcttacttcgttaaacagaaggacatgaagaagttcgaaagtaccgtcattaatcttgaaaagcaaagtgtcaatccgcgaattgttggtcaaagtcctaagcagattgctgaatgggcggggatcacgattcctgataacaccacgattctgattgctgaattgaaaggtgttggcgaaaagtatccactgtctcgtgaaaaactaagtccagtactggccatggtcaaagcagatggtcatgaagatgccttcaagaaatgtgaaaccatgcttgatatcggcggtttgggtcatacggcagtcattcacacggctgatgatgagttagctttgaagtatgccgatgctatgcaagcttgccggattttgatcaacacaccatcttctgtcggcgggattggcgatctttacaacgaaatgattccaagtttgactctgggctgcggctcatacggtggtaactcaatttcgcataacgtggggacggtcgacttgcttaacatcaagacaatggcaaaacgccgcaataacatgcagtggatgaaattgccaccaaagatctattttgaaaagaattctgttcgttacctcgaacacatggaaggcatcaaacgggccttcatcgttgctgatcgaagcatggaaaagttaggcttcgtcaagatcgttgaagatgttctggctcggcgtgaaaatcctgttcaagttcagacttttgtcgatgttgaacctgatccatcaactgatacggttttcaaggggaccgatatcatgcgctcatttggaccggataccgtcattgctatcggcggcgggtctgttatggatgctgccaaagggatgtgcttgttcaacgatgccggggatgctgatttcttcggcgctaagcagaaattcttggatattcggaagcggacttacaccttcccgaatctgaataagacaaagcttgtctgcattccaacaacttctgggactggttcagaagtaacaccttttgcggttatcaccgattccaaggctggcatcaagtatccgttagctgactatgcattgacgccagacatcgcgattgtggacagtcagttcatcgaatctgtaccgccagtggttgtcgctgattctgggttggatgtgctctgccacgcaaccgaaagttatgtttcgaccatggccactcattacacgaagggcctgagtttggaagcaatcaagttggtcttcgaaaatctggaaaagagttatcatggcgacgtcgaagcaaagtcaaagatgcatgacgcttcaaccattgccgggatggcctttgccaacgcactgttgggtattaaccacagcatcgcccataagatcgggcaagcgttccatctgcctcacggtcgttgcatcgcgatcacgatgccgcatgttattcgcttcaatgcgagtcaaccgaagaagcgcgctatctgggcgaagtacagctacttccgcgctaacgaagactacgcagaaatcgctcgctacctcggccttcctggcaagacaactgatgaattagttgaaagctatgtccaggccttcgtcaagctggctcacagtgttggcgtcaagctcagtttgaaggaacaaggcgttaaaaaggctgatcttgacaagcaagttgatcgtcttgccgaactggcttatgaagacaactgcaccgttaccaacccgcaagaaccgttaatcggcgacttgaagcatatcatccttgatgaatatgaaggcaccgaatccactttctaagatgtttgccgctaatcatttcacaatgatcggcgcagaaaattcaatggcgacattatttgagccgatcacgaaaaacacgtcagtaaattggcgtgtttttttgtgtgactcatggcataatggagtacagtgactgcaaattaaaagtaaggatgtaaaatgacaccgaataaagaggattatcttaaattgatttttgagattggcggcgatacacagctggtctctaataaacaaatcgttgccggtatgcatgtttctgctgcttcggtcagtgagatgatcaacaaactgggcgaagagaaactggttgcgcacacgccttatcaaggtatccagctgacatcagctggccggaaaaaggcggccattttggtgcgtaatcatcggctctgggaagtatttctggttcagtgccttaaatatccagctgatgcggtccatcaagaagcagaaaaactggaacatgccttaacgccggaaatggccaaacggttgtcagccatgttgggcgaacctcgctattgtccgcacggcggtgttattccggatgccaatagccactatctccaacaaagtcgggtgacattaggcacgttagatgttgggcaaagtgggcatattgaacgcgtgattgatgaagtttcgttgattgattacacggttaaaattgacctgcggctggatgatgaattcacggtgactgcgaaaaccttagatgccgtgatcatcaagttagcccgtaccggaaaagaattggcggtcgatgcagatcgtgctgatcacatttttgtcgaattgtaattaagtctagagaaagcagggtcgtatacatgccagaagagtcacgtgctgtgattattatttttggaggttcaggagatctagcctcacgcaagttgtatcccgcactgtttaatctttaccgtcgtggtgtcctcgctgagcattttgcggtgatcggcacagcgcggcgtccgtggactgatgatcattatcacgaggttgttgaaaacgccgtcgctggcgatgatgtggatcgtgaccaagcaaaagcctttgcccagcatttcttttatcagagtcatgatgtaaccgatgcagatcattacattaccttgaaaaatcttgctgcaaaattggacgatcagtatgtgactggtggcaatcgcatcttttacatggccatggcaccagatttcttcgaaacaattgcgagccatctgaaatcggaacatttgctgacggagcgcggtttcaaccgattaattatcgaaaaaccgtttggtcatgattatgccagtgctaaagaactaaacgattcgttaactgcaacctttgatgatgatcagattttccgaattgaccattatcttggcaaagaaatgattcagaatctgttggtttttcggtttgataatgccatttttgaaggagtctggaacaaggattacatcgacaatattcaaatcacactttccgaggcggttggggttgaggaacgcgctggttattatgaaaaggccggcgcgttgcgtgatatggtgcaaaaccatgtgatgcaggtgctgtcttatctgacaatgccaaaaccaaagacttttacggctaacgacattttgacggccaaggatcaagtgtttgccgctttgaagccttatgatcttgcaactgctaaagaaaattttgtgcgtgcgcaatatgcaagcgccgaagtagatggcgaccaagtgctgggttatcggcaagaagaaggcgtggcagcagattcacaaacagccacttttgtcgcaggcaaaattatgttagatatgccgcaatgggaaggtgtgccggtttatattcgcactggtaaacggttaactcggaagtcaacccagctgacactgacatttaaaccggtcgcaagtccgttattcaaccgagaaaccggtagtcaaccagacagcttgaccatttatatcgagccaagtgaaggctattcgttgcaattgaatggtaaggcccttggcacaggctttaatattgaacccgatgagttgcggtatcgtcatgatccggaagccgccgctgctgctccagaagcatatgaacgattaatcaataatgtgcttgaaggcgatcagacaaactttactcattggtcagagttatcggcatcttggcggttcatcgatgcgattcaagcagcttggtcacaggagacagaaatgccgacatatccggctgccacgatgggtccgcaagcagcgtttgatttgttagctcgtgatggccgccaatggttctggcaaccacgcagaattaaactggcggactaggctttcacagataaacaaaagggactgtgacccgaaaaggcggtcagggtccttttttagtgaacgcgagtcagcccgggtttctgggctgacgagcgcgttataggtggtccgagtagaatcggtcttgatcgttaaagctgaacgtgaactagcgcgacagaaagaataacagaacagttgatatgaggaaggggaagctcatggcgttatttgaattaccattacaaaacgatacttcccggaaaatcattcatctggatatggacgccttttatgcttcaattgagatgcgcgataatccgcaattgcgtagtaaagccttggtaattgcccgggatccgcgtacaactggcggcaaaggcgttgtgacaacggccaactatgtcgccagacgttatggcgttcattcgacaatgccggccaatgaagccttgcaacttgtgcctcgttcaaaactggtgtttaagacgccggattttccaaaatataaagcagtgtccgcgcaaattcacgccttgtttcatcaagtgaccgatctaattgaaccagtggcgttcgatgaagcttatcttgatgtcacggccaacaagatgttcccgagtacgatcgccttggcattgtggctgcaagatcaaattagtcaggcaacgcagctcacaagttccattggcatttcctacaataaatttatcgccaagcaagcctctgattacaataaaccggttggtcgtacactggttttgccagaacaagccttattatttttggattggctgacgatcaaacagtttcgcggggttggtaagaaaacgttgccgaagttaaccgacataggtgtcactgatggcaagtctttacgggccttatcgcaagatgatttgctccggatgtttggcaaaatgggatttgtgctttatcaacatgctcgtggcgttgacaatcgtcctgttgctgttcggacggcgaagtcaattggtaaagaacgaacctatggcacgcctctaactgacgccgaggcggttcagacacagttacacaatctggcagggatggtcgtgacatcgttgaatcaaaaaggtatgcacggcaaaaccgtggtgctcaaggtgcgcgatgttgacttcatcacgcaaacaaagcggctaacccaagatcactactttgaaggcgaacaagccattttcgatgcagcgtggcagctctggggcagtgttgccatgtcgaacttggccatccggttacttgggattaccgtgaccgggttggatccgaagcagtatgagaatttggacttaccgttgtgaagacagacagcgaaggggtgcttgctgtaggggctttggtaacggcatgcgctacttgtgctaattaatgcggttttgcgcacgtttttcccataacgcgctcgccaacccagaaacctgcgcgtaaggacactgaacgcaatgaccaaaacccggtcatcacgttcagtgccgcttacgctccggtttctaactgggttcgctcgcgcttcgtctgtcatagtacagccgtgacctatggtatactaacgatagattgcagtggggtgatggtatggcgacaaagcatgagcagattttggattatattgcaaacttggcggttggcaagaagatttccgttcggtcgatcgcgaagcatttgaaagtcagcgaaggaaccgcttatcgagctattaaggaagccgagaataccggctttgtctcgacgattgcgcgtgtcggcactattcggattgaacaaaaaccgttaaatccaattgaatctgtgacattcaaaacactggttgatttgattgacgccaaagttttaggcgggcaggccggtatggacaagaaattggacaaattcgtgatcggggcgatgacaccagctgccatgcggccttacatcacgcgtaactcgttgatgattgtcggaaaccgtgaagatgcacaacggctggcactagaagatggtgctgcggtgttgatcaccgggggattcgaaactagcgcggcgattatcgccttggcggatgatcagcagttgcctgtgttgcaaactgcttatgatacctttacagttgcaaccatgatcaatcgagctttgtcagatcaggcgatcaaacaggatattttgacagtagctgccatttatacgccgttggcccaaattcaaaccattggtgttgaggcgacggtcggtgattatttgctgttgcccgatccgcgatatccattgccggtcgtgacgcgcaatgggcgattggttggcgtcatgcggccatcgctggttggcggtaagaagccgacggtgccgattgaacggttgatgcagaaggatccgcaaactgtcaaaccttaccttagtgtgactgctgtggggcataccatgcaggataacggtttaacggccatgccggtggtggatgatagctggaatctgttgggaattgtgacccgcaacgcggttttttcaagtctcacaggcattgcccacagtcgcgaactatccaataccattgccgatcaggtcagcgctcaactgaccgccatcacaccgcaaccgccttacgttggcggttacgagttgaaaaccgtgccggccatgaccaattcgcttggcactatgagttttggggtgctggctgaagccattaacggttgcactacccgttatttgcatgacacggggcggcgaaacgtgttggtcgaaggactgaatttaacaacatttcgacccatccagttagaaagtgtggtcaccgtcttgttacgtgaacttgagatgactaggcatgatgcgacgctggatgttgatgtcttaagcgacggggttcaggttgctaaagcgattgtgacctgccagctattagaaaggaattgatttttgatgattcaaaccgatattattaacgccatcaaggcaaacgatccaatcattatccatcgtcatgtgaacccagatccagatgcgttgggttcccaagttggcttagcagaaaccattcgcgctagttttccggataagaaagtgtatcaggttggtagtgacactggcaatttgagctggttggcacaggaacaaaccattactgatgacgtttacaaggatgctctcgtgattgtgaccgatactgctgatacgccgcgagtttctgatgagcgcttcaacaaggggaaaatgctgatcaaaatcgatcatcatccgaacgatgatgcgtatggcgatcttgtttgggtcgataacaacgctagctctgcctctgaactgatttacgatttaatcgccgccagcaacggtgttttgaaactcagcgataaggctgctcgcctaatgtacgctgggattgttggcgacaccggccgatttttatttaacaatacgaccccgcatacgttgcaggtggcggctgagttgattaaaaaggattttgatccaacagccattaataatcggatgaacacggtgacgttggcacaagcacagttgcaaggctatgttgtcgatcatctgaaaattaccccagcaggtgccgccagtgtgacggtaccacggaccgcgatcaacgagctgaaactggctgatgatcaggtaagcgctgttgtcggcacacctggccgactggataccgtcattgcttgggcagaatttattgaacaggcagaaggtggttaccgtgttcatctgcgttcaaaaggtcccatcatcaacacacttgccaaagcacacaatggcggtggtcatccattagcaagcggcgctaaggcagctaattttgacgaactgattcaaatcgagacgcaactcgatcaactggtcaaagaatattcgacctcaggaaagtaggcattatggagaatcaattcaaacaatttcaactaaaaccttttgttatcgatggtctcaatgcaatggccatcaccgccccgacacccattcaacaaaaagttattcccgcacttttgcgtggtgaaaacattgttgggcaaagccagaccggtagcgggaaaactcacgcctttttggtacccttactcagtatggtagatcctaccgaagatgcgactcaggtcgtgatcactgccccttcacgtgagttagccaatcaaatttatgcggttgcccagcaactcatacaaactgagccggcgattcagattaaccgtttagtcgggggaatggacaagcaaaagcagatcgacaagttgcaaaatcatcaaccacatgtggctatcggaacgccaggtcgaatcttagacatgatcaaaagctatgatttagtgccatcgtctgtccgtcattttgtggtcgacgaagctgacatgacgctggatatgggcttcctcgaaacggttgatgcaattgcctcgagttttccagatcatctgcaaatggctgttttttcggcgactattccgcaaaaactggaaccattcttgcgcaagtacatggataatccaacgacgattgaattgaaaccgcagtcggtgattgctgacacggttgaaaatattttgattgcggcaaaagggcgcgataaaaatgagttaatctatcagcttgtcacgatggggcatccctttttagtgctgatttttgctaacaccaagaccagcgtggatgctatccatgacttcttgaagcatcaaggtttgaaggtggccaagattcatggtggcattcagccgcgagaacgtcggcgcgtgatgaaggatgttgccgacctcaaatatcagtatgtggtcgccactgatcttgctgctcggggtatcgatatcaaaggggtctcaatggtcatcaatgccgagattccccgcgacaacgagttctttattcaccgagtgggccgaaccggtcggaatggcatggctggtacagcggtgacactgtacgaaccgggacaggaagatcaaattgccgaattagagcatatgggcattaagtttgcgccgaaaatgatcaaaaacggtgagcttgtcgacacttatgaccgcaatcgtcgagttcaccgcaaaccgaagcaagaagacaccagtcttgccattcgcggtttggtgaaaaaggcaaagcaaaagcacatgccgaattatcgtaaaaagattcgaactgcggtgttattagaacgcaaacgaaataccaaaattgctcggcgccaagcgctgttagcagaaaaacgcaagaaccgcaaacgagggtgagcatatggcagtcaacgacctgaccctgccgacctggaacacgctggatgaagcgcggcagaagtttatttttcagcaactcacacgatactttctaagtccgttattgtccgttgacgatattcggccgttgacggtgactttttttggccaaactttgcatacgtttgaggcaatgattggcggggaatggttacgcttggtcccggggatgcctaatgttagcttaggttttgcggctgatcaacaagggcagttagctgattatttggggcaaagcggactaaccatgcaagacctgagccatcagctttcgcctgaacgacaagttgatataccagcgatgctcgtggcaacgagagcaacgccagcgagcgaagagattttaggccgagtcagtttaacgacacgtatttttaagggcaatcatatggcctacgcggctgttcgtgctcaagtgctggccttgctggaccgccatggcagtcttgatccgttttctcaatccggctggccagcaactttgactagcggatcggtgatcctgcgacttgccagtgcacaccattatcaggtcagcatcagcaaaaactggcaaaaatctgagctgcaaaaagcacttagttacttcggcttccgcctgccaacccaagatcaatatgaatacttgcaaggcgggggtgtcaccagcctattttcattcggcaataccctgccagccgacatgccacgctaccttcccaatcgcttcggcctaactgttccggtcacgcgatccggcagtgagctaatccaagaagcgatgcaaaaaagcacaccactttccgcgcaaccaaccgcaaaagaagctttggcactgtcgccgttttatcagttggcaggcgaagggaacatgggcacggctttatatcggcgcgtggcgacaattacgatggattgaggatctgtactcgttggcgtttgaatgcgtgctaaacactcaggatgagacaataatcaacaacaagttgaccctttttttcagaaaagctataatgagttttcgttaggacatgcgttgaaccctgcacgagacagaaacgaccgcacagctgagaacggtcgcgtcaggctaagatgtgctccctgatattagttaaacgacaattaatgaagtggtaatgactcgcatcattgcaaccaaggtggtaccgcgtgcaagcgcccttggcagcaatggtgctttttattttgtgagcgcgagcaggagcgtttagaagccggagctcagtcggttttccacaattctaccagattcagcagatactagacaggttcttagaatacttctccgcacatgatgttgcattagtcaagggacacttcatgatttccacttcgagggaagccaaaagatttacacatttacacatgtgtaactttattattgctaacatagcaggcaatttagattatgtgtaaatttacacatttacacatgtatcaacgacttctacgctcgtcagttgctttaattctttcaatggcttgctgataaagacgtaattcgtcgggcctatcggtagaaatttctttaacagctctatctactagctcagcaattagttcatatacatacttatttggcgacagttcgagaagtgccagcagttcatagtattgttgtcttggaattcgaatggttctgcgcgcatctttgactttatgcgtgactggggttgtctttttttcagcactaggatcaaaagcttttagaccagatcctttgtatgtctctttgaccggaatatcttctttataagccatatctggagagtgcttcttttctttattgaagaatccgatagtgtttttctttgtgtcagccattggttacttcacctacaatctttagtctttgaagaaagtcgtctgttagtggatctacgatgtcatcaaacaatttctggttccagtatccctgccgagagaggcccattctcggagcggcttgaatacgacgtgcaaagggaatgatgtgatcgaatagattttgttggccaaaacgggcaatagcgtctttaatgactacttgatcgattgccccacttttagaaacttgattaggaaggattccaagaacgtcagttctagccccaaaggtttctacaagttcggtcaagtcatcgcttatgaattgaatagcgccatcaaggctatcagactgagtttgaaaagcaataatgacataatcactagcaaatgtcgcatttcgaacatattgtccggcagttggtggtgtgtcaatgaagacaaagtcataatcagctttgataggttcgataagccccttaaggagagaaacttttttggattcaacggaaagatattcgggatcacctttttctgcaacaccgtatttcttactaaggaaggtttcaaaacctctaaagtcaatttgagatggtaattcgtaaagattaggtacgatttcaagaacagcgcctttaaagcttccgtcacgcacagcagccatcattgacttatcaattgtaaagatgttgtctggatcatgttgttgtttggtgatccccatggattttgtcaaattagcttgggggtcagcatcgatcacgagaaccttgtaaccacgttctgccaaatcataaggaagatagcgcgtgatggtcgtctttccaactcctcccttagcgttggcaacggttattgttagcgggcgtttgagatttagcttggattgcattaaaattcctccaactttatgtgtaaatgtacaaatgtgtaaatgtgtaaacgtgtaatacaaagccacagtcgtagtctatcacattttcacgtatttgagtacacatttacacatttacacataaagatcgttttaattattgtaagaacgggatatatttctgaaatgtgtaaatgtgtaaatgtgtaaaaggtctgcggatattttacacatttacatatatgtaaatgtacaaatgtgtaaatgtgtaaatgtgcaaattcgaatcaaaaaaccaaaaaatgctgttgcaccaggcttgctagtactgtactgtctagataaagaaaaaagcttcaaaccaactgcaattggtttgaagctcgctgaatataacctcttgataaaactaaatgggcttttagtttttgacactctgcgtcgctgacaaccgtatgcgcctgcgacagccaaatgtgtctatattatatatactatccggttttcgtctatttttcaagaggtgcatacggctatttgagtgcaccttcttgagaaatgggcggcgcctgtctttagccagattatttttgttgcgacaaagggcaatttgggttaaagtgcaaagcgaaaaatacaaacgcgataagtttaggaaaagcccatttccacatcagaaggtggagtgggccttttttgtgcccaaatctggtgaaaggagttggcaagcatggatgtactgggcgcagcaaatctttctgaagcagccattgtggcaatcttgcatcacggtttggcccgcagcaaatacaaacatagccaactccggccagaggatcggcaaggggcgcggccgactggtgcgatcttcttgacccggaccaaggatgatttacgtgaggcgatcgggtttgtcgcgacaagccaggaggcagtcttggacaacgagacatgcagtcattggacgcccaatattttccgctttggcacctatgcggatcgtcgctgccatgtgctcaaaggtcattcggaagacaacctgaagcagatcaataccttcgtggttgatgccgactttggttcgggaaagcccagttacgacacggcgctactgaacaaattcattgtgaaccaaaacgatcaacaggagctttggccaacattggtcctcgaaaccccccacggttaccaggcttattatgtgctggatcggcccgtctttgtacgccggacaggtgatcagttgccggcagttacagcggcgaagcgcgtaagcgaagccttgcgcgctgccgtggctaaagacttgccacaagttgatgttggggcaaatcactttggatttttccgcaagcctagtgaagagaacgtctgtttttttgagccggccctcacccacgattttggcgatcttcaggattggaccaagttacaacatttgacgtttcatcatgacaacaaggcgcactaccccgtcaagcaaacggaccagccgtggtttattgccctcactcacgctcaggtgccgcgcggcgatggcatgttgggccgtaataatactttgctgacgctgtgcttggctggctacagttccggctggtcagctgaggacgcctatgactttgcggatcaatggaatacggatcaacgggaaccacttagtgatcaggaagtccgccggatcattcggagtgcgttctcaggcaagtaccaaggagccagtgcggcgtatattgctgaactgaccgcaacttacacgcctgatgctccgaaaacaacgggtcctcaagtttggcacaaacatgcgaagccgcgcacggaacgaaagtacagtcacttgcaagagtgggcgggcgatttggtggcctacgtggttgaacgggctggtcaggctgtcgaccagatcaaagtcactacccgagagttgcgagatcaactaggcatcagcagtcaggtgctcaccaaagtgctggcttacgtggcggactatggcttgctgaaggttgttaagcagtacgggcgtcatggtgggctgtacctgaccacgcgtcagatgcttggtcggcatcttcaactggatcggcgcgcgcaggcgatcttctggcacgattttgtgacggggcaattgcgcggacgggctcaaaaagaagtggtgaacggccaggtgtcgttgttgccagaaaccttgacacgaagcggtccataaatgctctactttgccgttacattttctagtttagctgttgtttgctttcttcactgacgagcaagtagaattcgtataagaacctgtctagtatctgcggaatctggtagaattgtggaaaaccgactgaggagtttgtcatgccagattatcctcagtcggttttccacaattctaccagattcagcagatactagacaggttcttagcgatggaatcgatgatgacctttcgtgctaaaagaaagcacttactacaatcacattctatcattataagccatttacgattcgttttacttaatccgaaaactctgaatcgcctggctattaatgcaccccagaaacttcataaatctgcgacttgctattgccccaaagttcttctggcatgtaccgatcagtttcaaagattgtcaagctaccatcagcggcaatgactggattggcaccaaaccaagcccatgttgggtcaactatcaatagtctacgtcttttcttgccttttggtaatgaccaagcagagatatattgatcaataaaatgtgatcgcatataccgtgtttgcccattatcaaattcaattgccaataaattcgctgctacccatactttcacagctttcggtaaggttcttgccatgacgcccgctcctctcaacaaaccaaaaaatgctatgatctagtcaactgtttacgagttgaatataccatagccggcgaagatagttaatagtttctataagaaattaagaaatatggaataaataagtatcgttattacatctaaaggcgacatattacgataattaaattaattcagtgtttgtttcggagagttacccagtcaaaaatatgttgatatcaaataattatgccactgatatcaaccatcattccgagtcatcaggcaggcgatcctgccattgatgcatctgatccaaaaaacgtttggctttcggggtcacaccgaccatatcagtgtagataacatccaaaattcgtcgtaattgtgctttggtgtcaggtttgacgttgatgcgctccactttactgagatcaagcgtgctaaagcgtcgcaggtaaaaaatcgcccgcggactagcatgaagtcgatgcggatccttatcccaatgattttggcacagcaaaccgccataactttcggaaaaatcaagcggcaaatcggcgcgaccgtcaatcacacaaccgcgccagttaggctcaacgccatattctttgagcatctggacttcaatcacgttggcgataatttgtggatcgaggccagaatcaatgaggtgcaaagcttgtttgatttggttaaaccagaatccgactggccgtccatctggaaaagcaagatcgattaatccaaaaatataggctgcataagcatttaaggtaatgtcatcagaaatttgccgatattgagtcgcatttttgatggcagacaaataagatagaccggattcacgaacttcaccaatataatcagcgtgagtgaacggtaaaataccagcacctaaagtaaaaccgggcttacgggcccggttcaaaagaaacatttttttgccgaatcgatcggtcaaaattttgacaagcatatcagattcgcgatagttctggcgggacataaccagtccctcaaatgtttcagtctgcctaaccattatcgaagatccttcgtgttgtaccctaacgacttcagataagcattattatcacgccaatttttctggacgcgaacccataacttcaggttcaccttgtcgcccaacaggttttcgatgtcacgtcgggcgcgaatgccgatctgcttaagcatctgcccaccgcggccaataatgattcctttttgactatcgcgttcaacgataatatacgcctcgatctgcaatttaccgccttcacgatctttcatgcgctcaacttgaacggcaacagcgtgcggcacttcatcgcgagttaattcgagaattttttcgcggataagttcaccgacaacaaaatactcaggatgatcggtgagctgatcttcggggtagtattgcggaccgactggcaatgcatcggttaatgccgtcaatagctcgtcgacattgtttcccatcgttgcactaatcggaaaaacttgggcaaacgcatagtcatgctggtagctttcaatcaacggcaataaatcgtcaggttttactagatcaattttattaatgatcaaataaaccggctttttcacttccgccagttggcgcatgatatagccatcaccagggcctttttcctcgtccgcttcgaccatgaacaagatggcatcaacttgattcaaagttgacaatgccgctttatccatataggtatccagctcatttttcggcttatgaatacctggtgtgtcgacaaatacgatctgcgcgtccggagtcgtgtagataccgttaattttgttacgggtcgtctgagcctttggcgacataatggcgattttttcacctaaaatacggttcataaacgttgacttgccgacattgggccgaccgataatcgcaacaaaaccagaatgatgttcactcaagcgttaaaatctcctttcgaaaacgcacctggcagtaaagcctgtggcgtcgtttgaactgactgtccggcaacgttggcaagcgtgatgacagcattagggccaaagaattcgctaatgacttggcggcaagcgccacaaggggccactggtcccttggtatctgcaatcaccaacaattcatccagcttcgaatagcccgcgctgactgccgcaaaaatagcactgcgttcagcacagttactaagaccgtaactagcattttcgacatttgcccctgaaaaaatgcgatcaccgacacggacggccgcgccgacagcaaaatgagaatacggaacataggcattttctcgagccgctaaagcagctgtacgcaaaactgacaacttaccaactcctaaaaagggccaaaagtggtggcccaaagacataaataccggcgacgacggcaatcagcgacacgatgagcaccgcgccggcactcatgtccttaatcttcttcgcgcgcgcgtcatattgatcgccaacaataaaatcaacaacattttcaacgatcgtgttcaacaactcgccaagaaacaccaacaagattgccagaactaacacgaaccatgaaaaagcggaaacttgtaagacaacgccggcaacaatgaccagagttgcactcagaaattcgcgcttaaaattattttcgtcgacaaaaaacaccttcagcccatcgagcgcgtgacgggcactttggatgaaatgtttattcttgccaacttgcttatctggtaaggccataagctgcgaggattttcttttgaagcgggatcatgacagcttcatcttctggcttaatgtggtcgtagccattaagatgcaagaagccatggacgacggtgtaacccagctcgcgctcaaagctgtgcccataatcctcggcatggcggcgaacggtcagtggatcaatgaaaagatcaccgatgttctttgccatgccaggtagcagcggcaaatcgtcttcgccctcttcaatcgcaaaactgataacatccgtgacccggtcggtttcacgatactcgcgattgatgcgctcaatctcatcatccccaaccaaggtgatcgacatttctgtgttttcaggcaacttaagctgtttgccgcaaaaagcgactagttttttgatgagatcatggtgcttgtcatccagcagttgatcgtcatcgaataattctaagtccatcccttactccttcgtcttcttctgcaactgcaggtcgtgtcgaccataagcctcaataatctttgcaacaaccggatgccgcacaacgtcctgtgccgaaaattgggtaaaggcaatgtgactgatacctttgagtaattgctcggcctgaagcagtccgcttttggcgttgttcggcaaatcaatttgagtgatgtccccattgacgatcatctttgagccaaaacctaagcgggtcaggaacattttcatttgtgcttgggtggtattttgcgcctcatcaaggatggcaaacgcattatccaacgttcgcccacgcatataagctaacggggcgatttcaatcacaccacgatccatcagccgatctgtgtgttctttccccaaaacagcgtaaagggcgtcatataccggacgcaaatagggatcaactttttccttgaggtcgcctggcaagaaacccagactctcaccggcttcaactgccggtctagtcaaaatgatccgctcaacttggcctgccttcatcgcggcgacagccatgacaacggccaagaatgtcttcccagtgcctgctggcccaatgccaaacgtgatatcgttatgcttaatggcatcaacgtactggcgctgcccaaagtttttgacccgaattggctgacctttggcatcgcgcaacaaggtttcactgtacatatcagcaaaatactcaagcgtcccacgcttggccatcgcaacggcgctagcgatgtcctgcggtgacaatttaatgccttgagctaataacttactagccgcctcaagtaactgtaatgtcaagctgaccgcttcagtatcaccatgaatccgcaactcatccccaaaaggcgagatctgcacattcaatccttcttcaatcaatgtcaaattagcgtcattgatcccgacaaggttaatcgccatgtcaggattactaaaacggaaaattttctccgaggtttcttgtgccaaatattggccccctaacaaatttattaagcaatgatgctctcagtttagcatattttaagagcgcgagcaggcgcggttagaaaccggagcataagtggccttgagactaaatgaccggtctttggtcatttagtctcaaggtccttatgtgcaggtttctgcgcctgctcgcgcgtttccaagcaaagcgtgaagcaatcgcctgaccaaagttagacgatattcagcgcagacccattcgtcagcaaaatcagcacccttatctgatcaccacgcacgacattcacccacaaaacccatataaaaaagccggctattgcaccggctttgtcgttaactaagtttttctttgaccacgctgctgacaagactgccatctgcttggcctttgacttttggcatcaacgtcttcatcactttgccgaagtcttgcttacccttggcgccaacttccttgatagttgcatcaacgatgtcaccgacttgggctttgtttaactgggctggtaaaaaacgttcgacgaccttgatttcaccttcggtttgttgaacgagatcatcacgaccgccttttgtaaattcagaaacgctttccttgcgctgtttaagttcagtcgcaagaacgctcttttcttcctcttcagaaaggtcgtggccgagtttaatcttttcattgaccaaagccgtcttcaacatccggacgacgctcaacgtcactttgtccttggctaacatgctttgtttcatctgagcgttaagctcatccattaaagccactattcaccaagtcctttaattaaaacttcttacgcttacgtgcagcttctgacttcagcttgcggcgtacgctaggcttctcgtagaactcacgcttgcggtattcagcgagtgtacccgacttggatacagtacgcttaaagcgccgaagagcgtcatcgagagattcgtttttcttaacaactgtcttagccatgtgatatccctccctccgacacttgtgtaaccactgacggatatcatagccaatagttcgtttattagtatacaaaactagcaaccacgcgtcaataagcgatttcacatttttgaataaacttgccctgttctgttaagttttttagttgtttttggcgtaaaatccctaacatcagcaaatggttgaccttaaatacctgactggtctagacacgcttgtcaccattggtcgtcggctaaccgctcctgtttagttggtaaatatgctatgatagcgttatctaagtaatgaggtggcagtatgacgcaagaattaaatttatatattatgtcggactcggttggcgaaactggcttgcggttggcgcaagctgtcgcggcacagtttcccaactttgaggcacattatgtccggttcccatttattcatacggaagaaaagatttacagcgcgcttgatgaggccaagaaggaaaatgccttggcaattatgaccttcgtgacatcaggctttgctcaacttgcaacgcattatgccaaagatcaaggcgtgattgccattgatgtgatgtcgccaattttaagcgggattaagtcaattacgcatgaggaaccaaatcacgttcccggcgctgttcatgatcttaatgaacgctattttgaccgcatctcagctatggaattcgcggtgctgtatgatgacggcaaagacccgaaaggctttctcgaggcagatatcgttttgcttggcgtttcgcgaacgagtaaaacaccattgtcgttgtttctcgctaatcgcaaccttaaagtggccaacttgccgctggtacctaacgcccatattcctgaagagatctggtcagttgacccgaagaagattgttggtttaaccacagatacctctgttttaatggaattccggcgccagcgaatgattgcctatggcttgaatcccgacaccgcttattcagcacgcgatcaagtcaatcaagaactcaagtttgcggaagatctgtacaaaaaaatcggctgcatggtgatcaacaccgcccaccgatcgattgaagaaacagcaacgcttattttggaacacatgggtctcgatgaatttgataatactgaaacccattaaaccatcaagtggcgtaactcatcgggctgaaagtcccctgtttttagccatttgatctctgccccgtatggcggtacctgatgttttttgtcaggaccaacatacggggtttcgagtatcttgggtaattcggccaaggctgggtgatgagcgatcttgtttaaggcgtcaaacccgatcgtgccaaagccaatgttagcatgccgatctttatgactgccttggggatttttcgagtcattcacatgaatcacactgagtcgatcaaggccaatgatgtgatcaaactcgttgagaacaccgtcaaagtcatttttgatatcatagccagcatcattggtatgacaggtatcaaaggttacccgaagcttttcgttatgtgtcacaccatcaataatggcagctaattcatcaaaagagcgcccgatctccgtgcctttgccagccattgtttccaaggcaatggtcactttttgattaggatcaatgagatcattgagtcctttgataatttgtttaatcgctgcttccggaccagcgccgacatgcgcaccgggatgaaaaggcatggtataggcatgaagagcatctgctcgagcgacctcttctcgcatgaactgcaccgcaaatgtaaagttttccggtttcttggtattgccgagattgacgatatacggggcatgaatcacggtatgactaatgccgtctttcgtcatcgctgctagcccttcaggaatcatcatttcgctagttggtttacgccgcgtgttttgcggtgcccccgtatagaattgaagcgtgttagccgtataactggcggcttcttcaacagcaccaagcaacatttttgaccctttcatactgacgttagctcctattaacatgtttccctcctaattaattgatcgtttttgattttgacaaggtgacctgccgatgtcggatacgttgaacgattccgacaggcacggcttgccaatgaaaaagcccggaatcgctccgggctaaatctgatggtcttaatccgttttcggctcataaaaatgacccagaattttgaccgaatccgtgatcgagacgaatgcataaggatcactgtggcgcatggcttgttctaaatcatacatttctgcccgcgaaatgatggtgaacagaatcgtcttttcctcgtgatgaaaggcaccttctgcatcgtgaacaattgtgatgccacgccgcattgaattctgaatctcattcacgacctgtcgcggccgggccgtgacaatcataacttgaagtcgttgctgccgcgtataaagcgaatccatgacccggccattgataaagatcgccaaagcagaatacagcgcatgcggccagtcattgacaaatccggcgaagaagataatcaaaatattgaacataatattgattgtcccaaccgttcggcctgtgcgttttcgcaaaacaatgccgaggatatcaatcccaccggttgaaatattattccgcaaggcgaaccccgttccgagaccgttaacgaccgctccgaagatcccgcagacaatcgggtctttagtaagcggtgtaagcacgccgagcacccgaatcataatggtcgaaaaaatgaccgccaagaacgtgaaaaaagtgaaccgatggccaatggctttccatgctaacacaaacaacgggacgttcaggaagaaaagcagcgtcccggttgaaaaaagatctgttgttgataacgatacgaaaggcaatgcaatcgagaaattaaaccactttcgcacgatcgttgccaataactgcgctagtccagtgaccccgctggcaaaaaccccgcctggttcccagaacatattcagcgccactgccacacaaatactatagaaaaaagccgctgatagccgtgaccaattttggtgtcgtctgatcagcttatcaatctcttccatacaaaaaccgctccctgtcacccgtaataagtcgcgcatcaagtataacaagggcggtcctgtattgctaccatggtctttttaaaacattttaatgaacagacttaaagagatgtcgataatccccgtaaccttctttttctaagtcggccactggaataaaccgcaacgcagctgagttgatgcaatagcgcaacccgcctttagcagctggaccgtctgtgaagacgtggcctaaatgcgactcggcagatgggctgcgcgcttcaacacgttccatgccaaaactttggtcgcggtgctcagccagtttgctgattggcttggtgaatgacggccagccgcagccggcatcgtacttgtcctgcgatgagaataacggttcaccactaacaatgtcgacatagatgccatcttgataaaagtcgtcgtactcgccagtaaacggccgctctgtcgctgcttcctgtgtcaccgcataagcctctggtgacaagcgctttttcaagtcctttttgctttccttttcaaattgatctgacaattaaaacacctcccgctgtcttcattatagcgggaggtgttttaattgtcagcaacttaattgcggctggcttttttaaaaagtaacgtttactcagttaggttttcgtcgccttcatgttccttttcaggatcaacatcggcccgaacttcgataccgagatcttttaattgtgcatcagcaacgggatatggcgcactggtcatcggttcactagccttgctgttcttcgggaaagcaatcacatcgcgaatgttatcgcggcctgttagcagcatgacaaaccgatcgagtccaatagctagaccaccatgcggcgggaacccgtagtctaaggcatttagcaagaagccaaaactcttttgggctcgttctggggtgaacccgagcgccttgagcattttttcctgaatctcgcggttatgaatacgaatggaaccgccacctaattcgtaaccgttgagcacgatgtcgtaactttgagcatgtgcggcatgcggatcagtgtcaagcaaatgaacgtcttcttcatttggcattgtgaacggatgatgcgctggtacccaacgctggatgccttcatcgtattcaaacagcggccagtcaacgacccagcaaaagcgaaatgcttgttcatcaatcaaaccaagatcgtggccaaaatgggtccgtagataacctaatgcatctgcgaccaccttggccttgtcagcaacaaacaacaccagatcaccggcgttagcgccaacagctttcacgaggtcagcaccatcgccaaagaatttagcaatcggaccgctgataccgtctgacgtgactttgagccaggccaaacctttggcaccaaaacgcttgatgtagtcttgctgggcatcgatcattttccgagaatacttgtcagcgccgcctggtaaaacaatagcccgcacttggccgccattttgaacagcgccggcaaagactttgaaatcagaatctttgacgagttcagacacatcctgaatctgcatgtcaaagcgcagatccggcttatcagaaccgtatttatccatcgcatcttgccaagtaattcggtcaaatggcaacttgacatcaatgcctttcacatcatgcatcactttgtcaatcaagccttctgtgatgtcctgaatctcttcagcagttagaaagctggtttcaaggtcaatctgggtaaattctggttgacgatcaccacgcaagtcttcatcacggaagcaacgcgcaatttgataataccgatcgaacccagcacccatcagcagctgtttgaacaattgcggtgactggggtagtgcgtagaagctgccaggataaacacgtgacggcaccaaatagtcccgggcaccttctggcgtgctggcggtcaatgtcggtgtttcaacgtcaatgaacccgttgtcgtccaaaaaatgatgcacgctgcgcatgatacgtgcgcgcgtaaaaatattcttctgcatttccggccggcgcaaatcaaggtatcggtattttaacttggtttcctcagtgacggccaccccgtcctcaatataaaatggtggcgttttagctttgttcaaaattgtgatggtatgaacttcaacttccacgtccccggttttcatatctttattgacagcttgcggcttacgcttttttaccacgccttgcacttcgatgacgtactcagagcgtaccgaattcgccacagctaaagcatccttgtcaaattcttcagagaagactaattgcacaatgccttcaaggtcacgcaagtcaatgaaaatcaaactacccagactgcgacgtttttgtacccagccttttagtgtcacttcttgatcaacatactcggcggtcacatcaccggcataacaggttcgtttactcattttattttgcctccattacttgcgtatagattttgccaaagtcggccagcacatcagcttgagggaatgcttgctgatcgcctgtggccatatttttgatttgaacagtgcctgcagcgcgttcgctttcaccaatcgtcaaaacaagcttggcatttgctttgttggcagccttaaactgtcctttaggtttgcgtcccatgtaatccatctcgccggtgaagccttgttgacgaatggcggtcagcatttgcagggcctcttgatcggcaccttggtcaatggtcacaatgtacgcatctggctgcgccgttggcaattcgccttgcattagtaacatcaggcgctcaacacccatggcaaatccgatcccaggtgtctccggaccgcccagttcttcgactaagccattgtatcgaccaccagctaaaatcgttgtatagccgccgccaaacaccttatcatcggacatgacttcaaaaatggtgtgattataatagtccaagccgcgcaccatcgtggcatccacttcaaacggaatccccaatccctgcaataaggttttcacccgatcaaaatgttgctgtgcttccggtgtcaaataatccaaaatagatggggcattggccacaatttcctgatcatgcttgtctttgctatcaaggatccgcaacgggtttttaaccaaacgaaccttggagtcttcagaaagctgatctttgaaaggtgttaaatagtcaaccagcgctgcgtggaaggctttgcgggttgctggatctcccaacgagttgatcacaaatttaagatgcttggcgcctaaagcctccagcaactgttttgccaaagccaacgtctcggcatccaacaccggtgaatcactgccaaatgcctcaaccccgatttgatgaaattggcgttgccgaccactctgaggccgttcatatcgaaacatcggacccaaatagtaaaccttataaggcttagcatgttcaggaccatacagtttattttctacataggcacgaacgacgccagcagtcccttcagggcgtaaagccatcatccggtcacctttgtctttaaaggtatacatttccttagtaacaatatcactagtgtcccccgcgctacgcgagaatacatccacattttcaaaaatgggtgtgcggatttcatgatactgatattgggcaaaaattttgcgagctacggcttcaacttgctgccagcgttcgctttggcctggtaatatgtcggctgtgccttttgggcgttgataattcatggattgcctcctgtggtttaagcactgtgatttagttggtgaagtgtgctggttccgaaacgcgcaaaaggacgcagaaacctgcgtgtaaggaccttgagcagcagtgaccaaagtgcaggtcactactgctcaaggccacttacactccggtttctaagcgcgtccttttgcgttctaaaaaaatacacccctcgattgctcgaagggtgcggacacggtaccaccttgtttttttctttgccataacggtggcgttccggaacttgttcacctcagaagtgtcttttcgatcggtcccgactttcaccatctccgggtcgcttaaagtgatctatcctacttcgtcacaggtcttagttattgcttaaagcatacggtttgctgaaagttttgtcaacgcgtttggcaagattttcacggttcattttcaacaaatctgttgcttgtggatattgtataatactgaggaaaaaagatgttagtcatgttcaagcataggcaaggagcgttatagcaatggcaagtaaatcagtttttgttaaagttgatcgcccgatcggtttttcagacaagtcgcatgcgccttatccgattaattacggctatgtgccaacggttaccggtggcgacggcgaaaagcaagatgtctacattgtctccgacctgattaatgaacccttgcaatcgtttgaaggcaagttgattgctgttgttcaccgagcggatgataacgaagaaaagtgggtcgccaccactgaaaacgaaactttctcggcagctgaaattgccgcgcgcattcattttatggagcaatattttgactcaacggtggcgttagtttaacttgacaatattttttgaattttcaataaagtaaacgctgttagtgtgagaaacccctccgtttcattgttcaatatacgaattaaggatcaaattttctctaaagcctttctgcaatgttgatgccgttaccttgcgcgtacttctatgacaatccagcagcccacagcaatcaaactataaacggcacctgtcaccataccaacaatgcttgtcgccagcggtagtggtccagtcaggccgcaaacgactaggaacaaaatgacagtccccagcagttggcttcactggccggatttggtcaactgacccaacatgagactcatcaccggtaacatgatggcccagccaagtaacggccacgcaacgattccctgccgcagcaaggttggcagcaaaagtagtaacgaaaatgcaacacttaaccataaagtgctgttgatggcgcggcgagtcgcatggttcacggtaccttcccatgccgataaaccgttcacatcatcaggccaaccaatttggctgaagaaactcaaggtccataaatactgaattggcaatagcatcccgcgcaggctgccaactggtacaacccaagcaagtagccataaaccgatcgtcactagccaccaccacttgctctgagaatggaaaagtcgatgtgcctgttggccaagcaattgttgccagcgaaagttgttcgtccttgccgaatgaaaccgatcatcttttggccttggcaaatcaaccgttaattttgatttgcctaagttcgttttttggtgtagtggccggtgctccagacaaaaggcagccagtaacaccaacacgatgctcatcaacaccgtcccgccgattgccaaccattctgtttgtgttaacgccagcggcttaaaaattagctgatgtgtgcccgtccgactcaaatgatcattgccgcccagcatcaacaccgtgttaagcggatgtccggcagaaatggcggactggcggatcatggccatcaagaacgcaatacccgaaaagttaaaaagttggctgtaccaagtcatggtagtcatcatggcatataacgtcagaagtgctatcactaacacggtggtaccgagttgtcctcgcagtcccggcaatgtctcactcaaaacccctaaaccgctaatcaagaagatcccaggcaccagactaaaaaagggtgacaaaaattgactcaagctcaacccttgaccaggatattggatcaaaagcattagcccgctgccaagcatcaccaagactaaaatggtgaacaataggcagcagctaaccagaaattgactcgccaaataacggaaacgtcgtaattttgtcgtcaacaaatatgtaaggacaccattttcccgatcagcatgaataccttggcgcgcgatcacaaggctcacaagtggaaagaacaatgacaacacgcaagcaataccgattggtaaccaagtgggattattggcttgcgcaaaatactgtggatccaatactaatacccgaaaattgccctttagccgcggtgcaagaatgacagcagcaaaaagtgctatcaccgccaaaatgcgaaatgagaattgttgggtgcgttcccgataatcaaccgcaatgagtcgcatcatcctttcctcaccgcctgactttcaaagaaatcgagagtcgcatcttctaagttaggcgctaccatgaccgcatttgccaccggcgcctcgtctgcaatcatgcgaatatgaataccatcgcttctttcttgcatgccactaattcgctcacttgtcggcaaagacgcattgcgcggcagtgtgtattcccaaacgtgccccgaagctttgtcgagaaattgtgctggtgtgccttgaaaatgcaattgtccatcggtaagcaataataactgactggcaatggcctcaacatcttcaataatatgggtcgaaatgatgacaattcgggtttgcgcgagactgctcaataaattgcggacagcaattcgttcaactgggtctaggccaacagtaggttcatcaacaatcaccacttgcggatcacctaaaagactagcagtcagcccaacacgctgacgcatcccacctgagtaatcaccgagcaaggttgaattgctgggattcaaatgcagcagtcctaacgtttggacaatttgccggtccgcctcgcgaggagcaatgcccttaagcgccgcaatatagcgtaaataagccaatgcggtcacatgtgcatcataaggcacctgctgtggcagatagcctaaaacttgacgcattttttgcggttgcctgacaatgtcaacatcatccaataaaatcgtgccactggatggttttgccaaggttgctaagagtttcagtaaagtcgacttgccagcaccatttggtccaatcaaaccaatgaccccattgacttcaagtgtcgcggttatcccagtcaacgcttgtttatccccaaagcgttgaccaacgtttttcaaaaataatgacatgagacatgcacctcctgaaactagtttaaaattaataacttttggcaacatcaatcataagttgcacttggcgtcagtctttagaccgaaaaagaataagacataattccttattggacttgtgattcattagattctgaataatctgggaaacgtatagattagaattctttgccagttcggctcagcagcagtacgctattactaatttcgcgcccactctactaaaacaaggaagtgtctttatgtggcaagataatcgtatccaagcagccattgacggtaccaatccaatggtcatggctgagctacccggcggatttgcggtatttggtgatgttcaatttttacccggttactgtgtgctccttccaaaacagaatattaccgatctcaatcatctcgaagagccagcaagaactttattcttacaaagcatggctcagttaggcgatgcggttttggccgcttgtcatccggtccgagtgaactataatattttagggaatacagataattttttacatgcccatgtgtttccacgatacaaaacggaatccgcggagcgacttgctaaacctgtttggttatacaccccggatcattggcacgatccacaatatcaatacaacccggccaagcatgatgcgattcggcaaaaaatcactcagtttcttttggcataagcgcccgatccgactggtaagggttattccgaattgtcttgttgtctagtccttaacgcaacttaaacgtgattacgccactttttctaatgcgatttgctataataggattaactatcttcagaaaatggtgggctcatgaagaaaattggacaattaaaaaaatggccgctggccgttctggtagcgctacttttcggcgttggtgttgccacaaccagtgtaatggccaacacacaatacatgactgtcaaggcagataccgtcaacgtgcggttaggtcctggtttggcatattcaattatgggacaagtgaaatccggtaatgaactgtcgattatcggtgcgaaaaactcctggtatcaagtccgactagctggtaataaaatcggctgggttgcctcttggttggtggatcaaagtgaggcagcaacttcacaggccaaagtggcaacggttaatcaaccggttaacgtccttgaatatgccagtcaaaatgcaaaacaactaggttcgctaaatgccggcgacagcgtcaaggtcgtctatcaagaaggcgcttggactcagattgcgtacaacaccacggctgcatggatcaccagcagcagcgttcagttaaccggccaaaccaccaatttagcccagcctgcgcaaacggcgttggcaaccgagaaaagtgcgccggcgctgaaggtaacaaccaatacgatgaccaaccttcgcaatgccgccggtatcaatgcgccttcggttgaaaagctagacaaaggcaccgaactgacggtctctaagcaacaagatgattggtatgcggtcacggcaccagatggcaaaactggctacgttgcgagctggaccgtcagcgcaccaaatgacgggcaaacgcaaaaagccgctacaaaactgtcagaggctacgattgtccttgacccaggtcacggcggctccgacactggtgcgattgccaatgatggcaccgactatgaaaaaacatacacgcttaagacggccaatttagttgctaacgctttacgcgcggctggtgccaatgtcattatgacccgtacaacggatactttcgttgatttagcacctcgaccaaatactgccaacaatgctcacgcggatgctttcatctctttccattttgactccagtccatccaagaattcagcatctgggatcaccacctattactacgacagcaaaaaagaccttgccttggccaagtccgtcaacagtgctttcagcggccttccgctggaaaaccgcggtgtcgcctttggcaatttcgaagtcctgcgtgataataaacaacctgctattctgaacgagatgggttacatcaacaacgataaagatttccgtcaaatcaaagatccgagctatcaatccaagattgctaccgatattgtaaatggcctaaacgcctactttaaggcaggcaatcatcagtgatgacctaaaaaaggtcctgacattgagtttacaacttcaatgcaggaccttttttagagtcgataataacttttaaacgcggaataatggcgggatctcttccagatgatccacctgaaaatcagcttgcggtgcggcgttcaagccgtcaacgttaaagtagatcgttttgacgccagcgttaatgccagcgtcaacatccaatgagcgatcaccaatcatcgctgtgacagccggatttagctgaaatcgtttgagcagatactgaattgaatctggtgccggcttgcgtggcaaatctaaatcggcatccacgccacccaaaaacaaatcagcagcatgatccttggccaatattttccaagcactgtggtcgcggtgcgtcaacaaaagattattcccgccttgcgacttgatcgctcgcaaaacagctaaggcagtcgggtaaggtttgatatcctgcaaatatgccgcagcccgatggtggtaatcagcctccaaatcggtcacactgcggccgatctgtgccccaaatgtcgtcaaaaattgtttgattgaagtctctttggttgttcgatacaaagcggctaaatcaaagtgaccaccgttatctgtcaccaaagcacctaacgctttcatcatccccgggtaggaatcatacaaggtcccgtcaaaatcccagatggcattgaccagcatcatttcgcctccgtatcaaataaaatcgtaactggcccgtcatttgtcaggctcacctgcatatcgccaccgaactcaccagttgcaacaggcacacctaaagctttgagtttggcattgaaggcttgatacaaacgatcacctaatgccggatcagcagctccagtaaaactcggccgattgccgcggtgagtgtcagcatacaacgtgaactgcgaaatcgatagcacttggccacctacatcagctaaagccaagttcattttgccgactggatcactgaacacccgtagcttgctaattttttcggccaaataatcactgtcggcttccgtatcagttggtccgacaccgagtaaaaccacaaacccgtggtcaattgtgccaactgtattgccttcaattgtcacttttgcttcaagacttcgttgtaccactgcgcgcatgaattcaatcccctttatttgcttagcatgatcaaaaaaagctgcttactcaatacggtagcagatttctgaccacctgtcttgagcaaacagcatttttatcgtcaaccagccctaaaatcagccattggcccgctttacttcataaatatccggcacatttttgactgcatccatcaatttatccaaatgagcaagattgcgtacccccactgtcacgtgaatgtcagccattttgtcatggtcaacccggccgttaatgttgtttaacgccttggtctgggcatttagaacctgcaacacatcactcagtaaaccgctgcgattataaccgtagatttccaagtcagtatcaaaaagctgcttttgggcttcttcattctcccagcggacatcaatcaaccggccggccatttcaccggaactttgcacattcgggcaatcggcgcgatgcacggtgaccccgcgaccctttgtgacatagccaacgatcgcgtcaccagggacaggcatgcaacacttcgcaagatgcaccagcaggttatccacgccttcgatgacaacgccatcttcagaatgggtttgtggctgctgatgtttgtcgcttgaaaccgttgtaaccttttgatttttggacagaatttcggcttctttagccttccggtctttttcagccttgtcatgccggaatttctccgtcaaacgattggcaatgactttcggggtatattcgccgtaaccaattgaactcatcaattcatcaaccgtttgaaaattgaggcgctgcatcaagcctgtcatattttccttggtcaagaaatcttttggcacgtaaccttcgtccaaaagttcacgttccagcatatcacggcctttttcagcattctcgcttttatcagcctgtttaaaatagcgcttgattttattgcgagcccgtgaagtgaagaccagcttgatccagtcgcggcttggcgcactgccgctagccgttaacatctcaacaatatcgccgtttttcaaaacataattcagcggtacgattttgccattgaccttagcgccgaccgtgtgattaccaacctctgtgtgcacaaggtagccaaaatctaacggattactccccttaggcagctcatagacgtcacctttaggcgtgaaaacgtaaacccgatccgtgaagatatcgcctttgacactttccataaaatcggcagcatcgctggtttcatcttgaagctccagaatttcacggaaaatgtcgagtttcttaccggtcttatcgtactcaaccttgctggtctggccttctttataagcccaatgtgccgcaacaccatattcagccacatggtgcatttcttcggtgcgaatctgaacttcaagcggcttacccatcggtccaatcaccgtggtatgaatactttgatacaagtttgccttgggcatcgcaatataatccttgaatcgcccaggcatcggcttccacttagtatgaatggcgccaagaaccgcataacagtctttgatcgtctcggtaatcacccgaatggccaacaaatcatagagttcatcgaactgcttatgcttgtcgcgcatttttttgtaaattgaatagatgtgctttggccgaccgtaaatctcatatttgatgtgtaaatcagccaaggccttttcgatttcatcgatggcttcctgaatataagcttcacgttcagtccgcttactattcatcaagtgggcaatgcgatagtactgttggggattgagatatcgcaacgatagatcttcgagttcccatttgatggtactgatccctaaacgatcagccaagggtgcgtaaatctccaatgtttcgttggcaattcgtcgttgcttatcaggccgcaaatgttgcagcgtccgcatattgtgcagccgatcagccagcttcaccataatgacccgtagatccttggccattgccagcaacatttttcgatggttttctgccagctcatctttatgggcaacataggtcactttgcttaacttggtgacgccatccacaatgacggcaacatcatgaccaaacacttcttcaatatcgcccaaagtaatattggtatcttcgacgacatcatgcaaatagccagatgcgactgttgctggatccatttttaattcagcgagaatccctgccacctgaatgggatggataatgtacggctcgccagatttgcgaacctgatccttatgaacatatgcggcaaacttgtaggccttttcgacgaatgccaagtgttcagggttcatgcaagctttacacaacttcatgacatccggttgggtgagttcaacttcttcggccattctattccctcctgaattccacgccttcacaggcacgcgcacactgatattatgagaagggcgataagcacctgccaaaagaatcttaggcaacacgcttatcgccgcttcgctacgcttgctgtttcgcgtcagtgcgcgcttttatctcaacacaccgttttcaaaaagcagtgtgcgtgacggttcacttttcttagattacccttaaattataacgattctatgtaaaaatgctagtcctttgccattgcgagcagactgagcaaaatatagaccggcacaaagaaatagccataccattgataacgcaaaaaaaccatggtggcaaataaaactggcagaacgaataaccaccaccaagccaaatgataccgatgaatcatcttaccaatccaccaagcactgaacatatcgatgagaataaacaaaacaccgacacgaatcgctgtgctgatatgaaataacggaaatagccacggtaaaatcaaggtgatcagaatgctccaactaataacactgttgcggggcactttgacccaattgagaatacgactcatatgaaaatgttctcctttaatgacacttatatagatgttgcttgtaattctgttaaaaccgacacggcactaagcaagtaaagcggtgcagtttctgcacgtaaaatgcgcggccctaatcccgcagcaataaacccttgccccgttaaaactgataactcctctggtgcaaggccgccttctggaccaaagaccacacacaacgaagcaggccgagccgatagcgccgagattaaggcaccatgctcaccttgtttggcactttcctcataagcgaccaatttcgcctcggcagtctgccctacctgatttagcttagcatacatcgtcacatctggaacctggtttcgatgactttgttcggcagcatttttagcaatttcctgtaaacgggcgatttttttaacaacccgttccgccggccaccgtgccgttccccactgggcattgaaaaaaccgattttgtcggcacccagctcagtagctttttgaacgatccattctgatttgtcccctttgctgacaccacagacaacttccacagccagtggcagttcaacttttttagttatgtcttcatcaatcgcgacctgtagcggcgacgactgctgaatgattgccaaatatgcgtggtgcgtggggtcaacgagttcgaaccgatcaccaatatcctgacgcagcactttgatcgcatgtttggcaatggtcgcatctaactgaacaacgtcaccggttttaagtttttgatcggtaaaataccgctgcatctgatgtcctcctcataaacgaatcgcaagcactagcgcaaaaagttgcacattagaaccttggtcagaatcgtcaaagcacggccattccggccaagaacgctcattgctttgattgctaaccgtgccacctcacgctgtttctttaatcactgcgtctaatgcgacccaaccaccggcctcgcgccgctgagcaattgaaaagccattatcttctaaagtccgaataattaacgtcgccttgtcggcaataatgccagcaagcaagaagtgtccatgagctttaaacgtggtcgcacttgcggaatcagcggcaccagcacttcggccaaaatgttggctacaatcaaatcggctgacaaggtaatgcccttcaacaagtcattcgcggtgacagtaatgtggctaaccggatttagcttgatattagcctccgcatttctaacggcaatctcgtccacatcggtcgccaaaatgtcaccgacaccaagccgttcagccgcaatcgctaaaatgcctgagccagtgccgacatcaatcatggtttcaccaccgcggatcacggactccaataacgaaagcatcagctgggtcgtcgggtgtgtgccggtgccaaaggccataccgggatcaagtgtcaactgcaattcgcctgcttgttgcggcgtataatgctcccacttgggtacgatggtcaaaaatcgcgaaacgcgtaagggatggtaatactgtttccagacatttgcccaatccgcctgcctgacatctgccaaggtgacggttgcagcaccgggatccaggccgaattgagcaagcccgcggacccgcgttgcaatatgatcgcgttgttcaacaagtgatgttgctggatcaaaatacccaatcacttgtgctccagaggccaaatgcggcaccgctttcgggtcaaaccaggtaccgtgagcatccacggtttcttttttgaaatcagcggcgtctttgatttgaatcccaaccgcccctgcctccattaaaatattgctgaccgcctcaatggcttcagtggtggttgtgaccgttaacgctgtccaatcattcatggttgcctcctttaaacgtgttctttgatgcaaaaactgctactgtccagataccggcttgaaaagtcagccgaccggtctttgcagccaatattctttcttctttggcaggctgactagtacttgggatagggtaaaaagatgcggttatcctcctccggctgttccgccagaatccgttcaaatgccgcatcgtcaaaattcaagacgaaagtatcatcgtcagacgtgccatcgacaaaatccatgaggtcactttcgctatcgtctaagaaatcctgcagatagataaacaaagcatccactgtggctttatcaatgcccttctttccattaaacccgaaaacagctaaataatcatctgcatagtcttcaccgtgcagccgggtttcatcataaaataaaatggcatcttgatattcaactggcccattgtcaacggtctcaccagattgatcttcaacctcgataccagactcgctttgtactgtcatcgtgatttcaagttcaatcacatgggcatctttatcccagtttagacttaaatcaccatcgaaatccagcgcatccattttgtcaccaattgcatctaacatattgatttggctcatgattgccatcctctcgtttttaaatcctgatctcgccgagctgtgcctgatacaaacggattcccctgcacggaaaaacgcaagggcgcgcttgtccaaggttctttgtttggaatgccaatgcgcggtcctatcgtgatgtgacgcggctgaaatgttgtcgccgtcagctgcaagccgccagcgtttaatcgactgccgtcaagcgcacggtcaattgccaatacctgacaaagcttgcccgggccattggtcaacccaacgccttcttggtgccgacgttgctgcattttcgccataccagcttgcggctccagcgcccaaatcaagatacactccggcacctccgcagttcgcgtcacaatattcaataagcagtactggcgcatttgacaaacataaacgttgcccgccggtaaatacagactgtgattacgcggtgtttttcgaccgccaaacgcatgcgcggctttatcctctacacctaaatacgcctcagtctcaacaatcaaaccactgcagccagccagactcagttgcatacctagcaattgctgcgcagattgaattgttggctgggttactaaccatggtatcatcatgcttaacatcttagcctagctgcgcgcgaaatcaaagaggcagcacagctttgcctaaaaatctttgccgggtataatggtatcaagttagaaaggaagctgaatatggcagaaaacttggcattgcgcgcattaatcagccaacagacagatgcactcgtctctgaactctataccgacgacaaggtcaatgcacgactgcagacgtggttagcaaaagtacctgatcctggtgtagccgatacctacagttacctactgtcggaatctcgcgatttctctgaggaacttctctatcgcattctgacaaagcttgtcgaggatggttcgctcaaactcaaggagcaagcttagtaaaaaataaaaagaacgaagcagtcagctcataatgagcctgcttcgttcttttttgccagttcccgtttactcaagcttagaaagcactgaggcagggatcgcatttttattcacgacttctgggcctttgataacccgtttctcggaaacagttgctttcacataagagccaggctgtagttcagttggatttgcagattcgccagactcatatccaacttcgcgtttttgaccatcccttgtcacccaagtgaactcataatcataatagtaatactgtttaccattaactttataaggggagccatcattatttttggacgcatgcttggttccttgtgtcacctttgcataggattcaacgccattataggtgctgttccaatactgatagccgaaaaagcccaagacaatgacgaccaataagaacacaacgccgaatgcttttttcatatttgtttcactccttctcgataaaaatagtatgccaaaatcgtgacctggactcaacactttcaacggcttttacggctttcttaacgcgtgacaaaagtgtaagaaatgtaagcttgatgcgggttaaagccattctgcaatgctaatgctttatccatcagcattgcatatcatgagatttttaaaaacaaaatggaactaactgaataattaattttattactaatattatttaatgcgtatatcactggtatgtaagaagacaacttatccacgagggacatcgttcacttctcttattgataccttgcgaaaatgtgatggttgcttaaatacaatttctatatcatctcatcgaatcccttgacggcttattgaccaaaaaaagtgttggcagtctttaacaaatcaaggctgaaccaacacttttgtaataggtattaccaccccaaaccagatttaatgtcgcttaggtcgccgcgaatcatcttttcgcggcttgcgcttcaggcggctgaaaactgactgtacggccttaaaccgttgcggatcacggcgagcatcctgcacgaattgactaaaatcatgatcgccgatgccaatctcaggcggttcttcttttttatgctttaaccaggccatcacgacacctccgaattattatggacacgacgagatcgtttggcgcctgacaaaattaagaacatggcaacagccaaaccaatgactgcaaagacactgtagttcggaatcagaatgaaggcaataaatgcacacaagcctatcagattgcctattaaaagcagccgttgattctgactcgcaaaatacgacagcaaatgtaagacgatcccaggcaacgtcagccaccacaaatgattggcccactgcatcagtgttgatccaacacccgtcaatgagaagccgtttggcaatgtcgccatgatggcagcaactagcattaccaaggcaaaggcaccatataagaggtcatacagtgccggtactttcttaatggaaattttcaagtgtcgaccttcccttgtttagcgataatcgtattatacaaggttaaacgtggcaatgcacggaagatgaaaacgacttaattaaaataatagtgtttcgcaaacggttggctattaaaaatattgcttttagcggggactgaaatttttgtccaaacacttcaaatccagaaaaatattcacttactaatggttttatagaaataaatgatggtcatcgcgggttttatggccgttatcttggtggtgtcctgaacataacccatttttctgtatagatgaaccaactttttctcttcagcaattgtatccagatgccatgtcgtgatactcggataaaagatttcaatgtcacgtagcatttgctgcgcgtaacctcgaccctgaaattgcggtaaaattaacaagggagataaacgtgcgatctgcctatcctgactgacaatgattcgaagcatacccacgcgaacatttccgtgtctaaaaaaatatacgtgattggtaggacgagaccacttttcttctagggagactaatgattcaaaaaaggggtcagtttggtcattctggtctttcagatagataggtttgaaagcgacctgatacatctgccgaataagcggtaaatccgctttggtaacggtcgtaaaattaaaggattcattcatagcgatctctccctaattgataaaatcaccacggcttattcatagctcacagcttaactggcaattgaacaacgattaaccttctcgattcaaccgtaattatcacacattttaagacaatagcttcccaaaggtggtctgttttgttatactagttcttgtgttttggagagttggcagagtggtaatgcaacggactcgaaatccgtcgaaccggctaataccggcgcgcaggttcaaatcctgtactctccttattatttcaataagatccgtctgatataacgccagtaaaaggtgtggtatcaggcggttcttttttcttccccaaaatacgtctctattgctcaccaccaaagtgatggttatgcgaccattttctttgcacagaatttaattcaaatctaatcatccagcgggctatgcgaagaagctatttaagttcatttagaaaacatgttggcagcatcacttaggcaagtatcaaggcttggcttctctttaatcgtcgtttgcagtttgtttttatttccagcaaaagcagtgatcaaattatttatatctaattgttctattaagaagatacagacatctaacgtcccccctttatcagagtgttttatttccaagcttcatatttgctctcctcttggttaaaaaggtggaaattgatcatttcgtctggggagtaacttgttcaaaaatcgatggattatattctttgaccaaaaccttcaacccaaacacacgaacaagtaatcgccaagctaatgtcggcgacaaacattaagaatatcaaaccgatcgttagaattatctgaccaatgtctaacatagaattgaacagataacatcatgcaaaattcaaagggaacactagccaaacaaacttgatgcactaaccacgaactgatacattttgcctgctcgtcttcgctatgcaacaagttgtttgacggcttaactaactagtgtgaaaaccggtgcctgaaaaatgtaactttctcccccgcttctactgactttagcttcggatgaaacccctatcgtcttaaaaggaataataacaaagaatatccgaacagaagaaggtaaattgggagcttaagttattttaagcagcaagtcaagttattttgatggctacccttgcttgcgttaattaaagcggccaagtatgccatagcaaacaaaatgtctgccactatttaggtcaacaggatgttgaattgttggcgtttcacggatagcgttcagtaaatttaaaatttcaacgggatttaaacacggtatttgctaaaaacgaaagctcttttcggccacttgttgtaagtatcgttgccgttttttcaaagtagattttgttatgccgccaaaattataccagtaggcgtgttgcaccccgatttgtttgagtgtgtgatgcacaaaaacaccattcagcgcattgccgcaaaataatcgaaggtaacatgttggcgaagtcgaagtcgtgagaacgtaagcatgttgtaagttagtcagtaaacctttcacgccggttttagtcacaatatgacttaatcctgggccttctttcatcactttatcaatgaatcccttcaacattgctggaacatcattccaccaaactggcgaaatgatgactaaaccatctgccttttgtaagagtcgcaaatatttctggacgagcggatcatgggttttactagcatgaaacaagcgaagttctgccacatcataactaggaacaaattggtcttgataaagatcaatgaccgtataggacacttgatggtgatcaaaattatgttcgactgcttccaaaattgcatgattaaagctttttgcatatggatgacaataaacaatcagaattttagtcatttgaaacctccaatagatccttcaatgttttacgcaccagattaagatcataactcgtaatgccactatcaattaacaaaccgtatccttgaataaatgaccacaactggataaaaagaatctgggggtcaatagtgatcccgcgtttgcggagtacgtcttttattagttggatcacttgatcgtaaaatccgaattgcccaggttcgactttcaacacatcgcgagctgctggattgaaaaataaaaagtgcatcaaatgcggatctgcttcaaaccgctctaaaatttcggcagccatcaccaaaagtttttcttctggatcggtgatttgccccagcacttgcgccatctctgcctcctctcgctgtgacagaagctgggtaacagcgcgcaatagatcgtccttggttgcaaaatgcttgtagaaagcgccagttgtcaatccgatggcccgtgccaattttcgtaaagataactgatcttcaccattttcacgaatcatattcatcgcctgttctaaaatacgtcggtccgtatcatgactgattcctaccaaatactcacccccaaaaagagataacaccgttacccaattaattaattatagggtaacagtgttatctctctttttcaatccttaattttagtgttccagcaatctttatcgtaactgtttcagaaaatcccgcaaaaatcgcaatctatcttgcgctttgcgaaataaatcagtctgatactgagtcaatacttcttctctaaatggccgctggtcaatgtattgatcgtatcgtagctcaatttgaatggcggtgatattaggttgatggccgtagtagcgcgttatgtcaccgccacgaaatggaaagttattttcaactgtgaaatcatgtgcggtaaacgctgcggatagcgtttgtcgaaaaattttactagttgttcggtcatggtcattgcctaacacgattgtttttggcttgataccagggtaatgaggatattgggcaaaactgtgcaagtcaattaagtagtggctgttgaactaggccaccatatcttcgacccttgtagtaaatttccaccactctagcttcgcggtcgccaccccgaatcgccgcggagccaactcggacaataggatcaagcttaattagagtagagccgagaaaagcttgacacatacgggcctgctcacgctctttacttttccaagtgcccagcgtacaattatcgacaccattttaaacaccgaaaggagcgccgtttctatggaaaatgcaacgaaggcagaagaacaggctcgggtcacggcggtcattgagaagctcaaggcaaggctagcggccattcatgaccagatcgaagcggcgcacaaagaaaccagccggattgaacgatcttacggtgaaaataccaaggtcaacgttaccgaagtcgatgaccaaatggaaaccaacgctgcggttcaacagcagaaagtcatggttgcccgcgccgtcgaaaatgaaaccattctcaaacacgaaggtaatcgtctcaccctgctagcggacaatccttattttggccgtatcgatattgacgaagatggcgatcccgacacgctttatatcggcactgccaccttcattgaccaagatggcgaattcttggtttatgattggcgcgcgccggtaagttctatttattacaacggtacccttggcgatgtcagctacgatacaccagcaggcgaacaacacgccactttgaaaaacaagcgtcagttccaaatcgaacacggccacatcaaaaccatgttcgacaccaatgaaaccgttggcgacgaaatccttcaatccgttttaggcgatcaatcagacgaatacatgaaaaatattgtcgcgaccattcagcgcgaacaaaacgacattattcgtgataccaccagcgacttgcttgtggttcaaggggtcgccggctccgggaaaaccagtgcggtcctacaacgcattgcttacttgctatatcacagccgtagcgatctggatgctgaccaaatggtacttttctcacctaaccgcttgtttgccaattacatctcgcaagttttgccgagcttaggcgaaaagaatatgcggcaggcaaccttgtttgaattcttggcaaaccgtttcaccggcttacatgttgaaacattatttgaacgttatgaacatgatgcagctggattgccgccagctgctgagcatatccgtcgctttaaagaagcgccgcgctatcttgaagctatctacgactatgctaagcaaccaaagcggacaccgcattttattgacgttgagttcaacggtgagactttcttctccgccgcaaccatcgcgaaaatttatcaagcccagccagcattgatgcagccagttgataagtttaccgccactaagaatgctttgatcaaacgtctgaatacccgaattcatatggaagccaaacgagactgggcgcagttgcgcgtttccgatctgtcacaaactgaattggaaaccttgaccgccgaccacgaattcgaaaccggtgaagatgaacagcgatttgtctcggaagctattgtctcaaaagcattttcgccaatctacgacgcactgtacaacgatcatttttacgatgtgttccaagactatcagcaattcatggcacaggtgaaaccacccgttgctccggctatctggcacacgatggtcaacgccttttcagacggaatcgaagcgcatcaattacgcttagaagatgccgccccgctgctttatcttcgtgatctcagcaccggcagcggtcaaaatagcctgattcagtatgttttcgttgatgagatgcaagacttcagtatggcgcagttgttgtacttgaaacacgcctttcctaaagccaagttgaccttgttgggcgatgccaagcaagacgtgtttaccagtaattatcagcctagtgatttcattcatgaaatcgaggacgttttttccggctataaaattcgactcattacgttgaacaaaagctaccgatccacgcaaccgattactaactttgccaaagctttattaccagaacacgaccatattcaggcgtttaaccgtgctggtgataaaccagaagtcttgacggtagcgcacacggaagcacctgatgctttgtcaaaactggtgacgcaactgctggcaaccgataccaccgtggcgattctagccaaagatgcccaaacggctgatcaactttacgccactctcaaacttgatgcaccagtaaccttgctatcggctaatgaccatagccttaaaaacggttgtgtcattttgccagtctatctcgcgaaaggtttagagtttgacgcagtcatcggttgggatatttctgcaaccacgtatcaaaatgaagccgaccgtgatattctctacacactttgctcccgagccttgcaccatctcacactcgttgctttggacgccccaagtccattgatcatggcactgccagctgatctctacacacatgcaggggatgcctctgaggcgcgtgtctaatgccacccatgcatcatcaacaaacgcccgtgtcttcgctgacacgggcgtttgtttggcttctagaatcatgataaattatcaatgggacgatttaatcaattctatttattaaaaatttggagggtttatttttgtttaatctactccgtaccttcatggccgtttacgaaacacgcagcttctccttggcagccacgcacttattcaccagccagccaactgtgtcacaccatattcatcagctggaacatcaactaaaaacaaccttatttgaacgaaacaaacgcagtgcgacgattcccacagcagctgctgatattttgtatacctttagtggcaacctgctggctgagtgggaaaaaacgcaggaagcgattcaaaatagtcaaaaggatgtcattgttgacctgcatattggcgtatcgcaaagtatcgccgctgttctattttcccgaatcgccgcggctttaaaaaaagcttttccctacttgcaatatgatgtcgccgtgctcaattccttgcaagttgtcaaacagctggaaggccaacatttagatttaggctttattgaacaacctttaaccttaaagggcgctgtccgaacaaccctttgtacggatcaactgatcgctgcaggttggtctaccggcacttggattacccgcgaagaaggctctgggatgcgctattacaccaccgcttacctgcaagccgctggtatttcgccgcaacacatgatgacagtcaataacaatgccatgctgctggcattggtacaacaaggtgtcgggcaggcacttttgtcggatcaagtcgcactcggcaatgctccggcacaagcagttggcccgcaatttcaacggcatttttacttgctgcaaaacccaaccgccaattggccccacaaacaggccatgctagataaaattgttgaagcagctcgcgcttcggaagtaacccgctgatggccaagctgctttggatgactattaatcagacagttcttgagtagcagttgctgtttgcttgactgttttagctgtaagccgcaaaaagtttagataatggccggtcacaaatatcagcatcaaactcgctacaagccactcaccccactgcaacacgctcaacaagttatgcaccaaccccttgctggcaaagatagcaataaagcgggtcaaagcagttgcggaaatgacgagtggaaaggtgaaggcggcaaaactcggataaaacgacagccgcgtatactgtcgaatgctgaaaagggtcagaaaatacaggcactgtgcaaaaatcaacatgccggttgcaaataccaaattaggatgcgtgaagctggccagataaccggtcaggcaaagcgaagccggtgcggcgatgatcgtcagtaagggctgtgttgcctcaggcagcggtattgtcctgacacgatgcagcacaaacggaaaaactgccacgtagatcacaaatgcaagccagaaaaggggctgcccaagtgctggcacgaattttccactggtcacgggaatgacgccgataccgacaaaggtgacaaaccagctcggataaatcatttgccattctttttgttgcgggagcaaatgccgtgaaacgaaaaaaatcattaagccaaaatggataatcactgctaatacccagatgacagtagcgatccccaccggcattccccaagcagttaaataagtgcacaagatcatcaaggtcatcgaaaatgtcggcgacaccgatgcgatgatcggatcctgtaaacttttagctgcgtgtaagggagtcaggcaaattttcagtacaatcagtccaaacagcaaagcagctaagcctcctgttaggttccctactaattgccaacctgccagtttgtatagattacccaacgatgccaatcccagtgtcagtcccgccatcggtaacggcactcgtttcaaaaatgatctcataactgcctccttatattcttgctattaagtgtagcaagaatcatcgtcatcggctaaattgatcttttgcatgattaacattcacttattgaattaatcatggtgacgatcatgcgaccaatctaggctaaaagtttcttgccatgccaaactccgcaatctccggacagatgaggatggaacgcgtgacggcgcttcgagcccaaaaagcggtctcgaagtcgcctaacaacatcagcgccaccactctagcttcgcggtcgccaccccgaatcgccgcggagccaactcggactaagggtgttcaaacagccgccgtaagaaaagaaaacctacctcaatatcgcaagcagttcgacagccgttcgcttataatagattgaaaccagtcatcataacgcgctcgcagtcgcaaaaacctgctcgcgctttccatcatgggggtaaactttatggcaaatattgaatatgatccggaacgtcaattgtttcacttgcacaacgacacctttagctatgtcattcaggttattcgcggttatcttgttaaacgttactgcggaccggcgctggatcatttttccggtaccgccaaacttgaagacttcagtcatgcttttaacattcaaaatgatgccgcaccttactcactgacgaccttgccgctggaatatagcacattgatgggcggcgattaccggacgccagcttacgccgtgcataacggtcacggtcagttgattggtaatctcaagtttgaccactatcaaattcttgctggcaatgaaagctttaacggtaccttgccgacagcgcggacaccgcacgggcaaacgctgatcataacgatgcacgatgaaatccagacgcttgctatccggctcaaatacacgattgtcggcgatttgcctgtcttgctcaaacaagttgagtatcgtaatctgacagacacgacactgacgattactcatgctgccagcctccaactggattttgacgaccacgcttatgacctcattacgctgaccggcgctcatctcaatgaggccaaagtgacccgccagccgctgacccccggcaaaaagtcaatcggcagtaattatggcgccagtgggccgcaaggtgtcccggcgacgattcttgcagcgccagcaaccaatgaatttgctggggaagctttaggcgtcacgcttttgtggagcggcaattttaactatacggcgcaagttgatcagttcgacaacagccggctcgtgatgggactgaatccggagctctttgcttggcaactcaagcccggcaagccatttgtcacgccggaagcagccgtcgcttacaccaacgatggcctaaatgatctcagccggatcttccaccgcttttttgccgatcatgtcatgccattgccgcgcaaaaacctaattgaatacaacacgtgggaaaccacttattttgacgttagcgaagccaaaattcttgccgagattcccaaagcggaagagttgggagttgagttactggtcattgatgatggctggttcaaaaatcggcctaacgatgctggccaacttggcgactgggtacctgatcccgttaaatttccacatggcctgcgcccggtggctgacgcaattcacgctcgcggccttgcttttggactttgggtcgaacccgaaatgatcagcgaaaatagtgagctctatgccacccatcctgactgggccatgcaatatgtcggccaaaagcctttgcgttctcgcaatcagcttattctcgatctcagtcagcggattgtgcaggatcacttgatcacagttctaactaacctcgtgcgcgataatcacattgactacctcaagtgggactataaccgccacttcagtcaacctggcagtccggtgctaccacctgatcaacaaggtgaagtcggctatcgctatacccgcggcttatatcgggttttgaaaacgttacgcgacacttttccaaagcttctcatcgaaaactgttcgtccggcggtggtcgtttagatggcgggatgatcgcctacaccgaccaaacatggaccagcgattttactgacccggtttaccgcatgaaaattatgaacggcttctcgctgtttttcccgctcaaaatttttgtctcgcatttcaccgcctccccgaatctacaagatgcgcggttaacgcccttgcatacccgcgcactgttaagtctggttggcatcactggcatcgaatgcccgccgagtcagctcagtcccgctgaagccgcggcggtcaaggccagttttgccttttacaaagcgaatcgcaaagaattgcagaatggtttgctttttcggttacaacctagccatgttaatcaagacgaggtttgttggctgatcaccaacgccgccagaaccaaggcactggtcttgacttcagtcggtgtcacttcgccgattccccattatcaacatgtactgctgcattacttggacccaagattgtcttatcaaatcgacaacaccaaaaatgccaccgggttagaactgaaccacgccggtgttaccttgccagtagcccatggtgatttttcggcaacgctcatggagctaacggcagtaaccaaccttccgcaacccaccgcagcaccgacgcttgatcaaataaccacgcaaagttagaccatcttgttgttcaagcatgaccgtttaatctcagccgttagaaagtgagtttcgctcgcatgaaatttatcatcgctcccgcaaagaaaatgatccgcgctcaagacgatttcccggtccaaagccagcccaaattccgtgccgaagctggtgagctgctgctgctgatgcaacaattgaccttttctgaagcgcaagcgctgtggcataccagtgacaaactcacgcaaaccgcttacaaccaactgcagcaaagtgacctgactcgccaacagtcaccggccatcttcagctattctggcattcaataccaatacatagccccggacttgctagacgacgccggactggtgtacattcagcaacatcttcggattttgtcaggactgtatggcattttgcgcccattcgatggcgttgtgccttatcgcttagaaatgcaaaatcacttacgtctgcctcatcatcgcaatctatatgacttttggggcaaccgcctttatcaggccttagccagaatgcccggccccatcatcaacctcgcctctgacgaatatgccaaagccattcgcccctacttgcaagcaaaagatcaattcatagatgtccgtttcgcccatcgcgttaacggtcaactaaaaacccgtgccacttatgccaaaatggcccgtggtgaaatgattcgttttgccgccagccatcggttaaccaaggcggcggatttgaaatattttgattcgcccacgtaccgcttcgatgcgcatctttcaacagcaacgcaactggtgttcatcgcgaagtaagtctttataaaaagctggcccaaattgcctttgatgagtatcaccatgaccgacccagtctcttttggccggtaatgatgtgaagaatcagccatcattgacagtttgagtcagtttttttgcgtgcgctgcctcgcgctcatgccccaccattaaactcatcgcatgtgtcaaaaaacgtttctgtgcaggtaaaaagtcatcagcaagctcaaaacttgcagtttcgcaaaatcaaagttaacatataaacaaatattagaaaggtttatttatatggaaacttcaaacaatttcgtttgcgaaaattcagagctaacgcacggttatcggctcaaaaatcatcattaccagtgccgctactgtccggtcacatttgctgcggatgaagtctatccgcaagatggccattttttcacagctgaagccatgattcgtcaacatatcgcccaagtccatcatggcgcgcttgcagcgttaatggcacaacccgctggtcaacttggggtgtcatccagccaacagacagttttacagttgttctcccagggactcagtgatactgtcatcgcacaacgactcaaagtctcgccttccaccatccgcaactaccgctttaagttccgcgaaaaggcgcaacaggcacaacaatttctcgccgccatgacgctgctagcgatgccagacgcgctaatcatccctcacgacggtgcaaaaatggtcgatgatcgatatgcgatcacacctgaggaacgaaccaagacactcaaaagtttcatggacgctgatggtcgcgtgacgaattggccatcaaaagagaaacgcaagctcattattttgtcggaaattttcaaaggcttcgatcctcaaaagaactactcggaaaccgcggtcaatgaaatccttaagcagcacgttgaggattatgtcacggtccggcgtattttgattgaatacggctttctcgatcgaaccgcagatggccgcacgtattgggtcaaggctagtggtccgcgaatttaaaatggcacgataaatgtgctcgcgggatattcaaaaaagaatttagaataaagattctgcgacgtgccaaactccgaaatctccagcgagacggggaggcgacgcgtagctagatcggagacggcgcttcgagcgcaaaaaccggtctcgaagtcgtctaacaacatcagcgacaaggcccggtcgctgtgttgtttgcacgggtgagcccgatctggcgtacgattgctccgccttggcactgagttttttaaaaagttgtcgtgataagacgaaaggcgaaggattttccgaactctcagaaaatccctcgcctttatttgtcttccatgaatgatatgactatcaaacatcccgagcaggttttctagctggcaattgagcaacctcatcgacaatctgatccaagatgtccagttgttccgcataacgaacggcaaatggctgctcgcttggtttgacttcctctgcttccagtgcaggtcgcgtggataagcgttcagcgtgccgcttatccagccaagccaagacctgaccaaagggatagcggctgaacgtatcgactgtcagttggccggatagaaaactgccgagcaaatcatggcgggcgtcgatgggatagattttggtgcgggctaagagcacccgaaagtcaccaaaaaagatgaattgctgctgggtgcgcgtcaacgccgtataaaagctttgggcattgagcatcatgtcagcgccggtgacaatggcaataacggtatctgcctgcccaccttgggccttatgcaccgtaatcgcataagccagcgtcaaatcgcgcggcacgctgccaaaactgtagtaacaatattgctggccgatttggaccacaacaaaatggcgtttggtatcaatatgggctaccacccctgtgtcgccgtttgccacaattgtctcacgccaacgtttagtgccaaaatcatcggtctgttgcaagccattttcacccagcaccgcacgccgttcccatgttttcggatcaacaagcgggacatgtttgtcgtttttcaaaatcatgacccgatcattgaggcgcaagtgatgtttttgattagtgatcgggtccacgtaactgctgatatactccggttcgcgatttttagccgggttgaccaacgcttgcaactcagcattaaatcgcaagcggccagttgcgccgatgtttttattcacgatcaacaattgcgcatcaatctgctgaccacttttgaccagcgcatcctgatacgccttcaccccagcatcaaacacccggccagcattgcgttggttatacagcgccacgttgccgctgacatagcgatcatcgtctggtccaaaaggcagcgctaaccgctcacgaatgcgattagctagtgctaacacgccggactggctatcttgccgataaacgcgcgtcagtgttgtcgccgccacctgttcatcgtctagacaatcttttaaaaagttgccgggaccgatgggcggcagttggaaaacatcaccgacaaacagcacatgcgcctttttgaaattaacgttcttcaaaaccgtgtaggctagcggcgttgtcagcattgagctttcatccaccacaatgagtcgcgcatcgccaaaggtttcccagtcggcatccgcgtcaaactggccggtttcttcacctggcagcaaatgcagataagcatgaatcgtggcagccggctcgtgcgtatactttgccaaaactttggcggcgcggccagttggtgcaagcaagacacttttcccttttgcttgggcgttaaaaaaccgaaccagcaaatcggtcaaccaagttttaccggtgccagcactgccattcaaaacgctcaagccatgacggttcacattttgaaaagcggcgcgctgttgatcattaatggttaaatgaaaccgatcgagaaactgatcgagagcatcatctagctcatccggagccatcaacggctcggctgttttttgagcgactttaataatccgcgccaccgatccttctgtggcaaacatatcgcaactcgtcaccagtccatactgctcgttaagtaaaaagccgtattgcaaggcttcgtgcggatcagcaaacattttcaaatcggcttcgcttacagccaataaagtggcggcttgctgccggaaccacgtaatggtgacataggtcaatccttgcgtgagtacagcggtgcgaaaaatatattgcagccctgccgtaagccgatgcggatcatttgctgcaatgccacgcgtcttagcaaaggtgtcgactttcttgaaatcaagctgggcaactgacatcaacaggtacggattggcatcaatactttgcatggccaaattggcatctttataagccaaccaaattttttcataagtcattgagcttagtgccttgccccagtgattggccaatacggcaatttccagtttgccgcggatggcggtagcgattttcttaattgtggcgggaccaatgcccgggacactatccggttttacctgatcggttgaaaaaatggtcaagatcggggtatcatccgcaaaatgttcatgcaatcggcgccgaactgtcggctgatgcaccagcaacgtgtcaatcagctgccactgccggcgcggttctttgggcaagccaaaatgcaaccgcgccaatttgtaagacggcttgttataacgcaatgagccagcatcatcgtaaaccaaatcagcggtgatgatcgctcggcgattgtagtagcccatatcaccggtaatggttgcctcttgggtgagcgtcattttaagcgccggattcggattcagaatccgcacggcgtaaactttataatcaccgttatcgctattaaacagcaacttgatcacttgcagatcaacattttcataaacttgttcctgattagccatgtgcgcccctcctctcaaaaaacaatcaccgacaaaaactttatagttgcattcttagtttcgttgtctcgtgtgtcgcagccttgtcgagcttcggtgcaatccgaaagcgaaaatcctccggtacggcttgcaactcatgctgagcccactgttggataaaggtcggttgctgccgggcctgataaaactgcaactctgggcgatgcgtactgtaaaccacgacatcttctcgcccgtgcttcactgaccactgaatggccgccagcagtgcgaccaagccggcagatggtagataaaattttcgcgccgggttgaaatcgtccggtgtcagctcagcatttgctggcgcatccgcgtatgccaactctttgactgcatcgtccaaaaactgggtgtggcgcaacaatgttttatctgccgcatccgtgattttcaagccaaatcgattgccattcaggtcattcagccacgctaaataaacctttgtctgcggcgcaaaatctgcactatcaacctcgtgctgcagattggccatgccgcgatgcagcatgatcccctccgctgtgccgccattaggaagtttaatgatgtgttgtgcctcgcttgatgttgcgtgtgtatctgccatgatcggcctcttttcttcaaataagcttaaccggtgtggtggttggctgcaaatattgattagctaaccctcaaaaaggtggctgacttgctgctaacattgacttttgagtgatctcgagcgtcccattagcatcgacttttactactatcattcttttgatatttttggggttgaagcttagactggcaatttaagtctcacaaatcggcatttatttaccttaaaacgagacaaaaagttatttttagctttgtgatctcgtgaatttgaaagcgggtttccatgtaaagcctattaataagcgattaaacaaattttgcttgctcactcaattcgtttttgttggctctcgcaaccattcgcgtacaattaaagttgttcctacgaatggaacgatttgacatcaattggggggaacttttatgtcaaagaaattgtggttgagcggtgtcgcgtttgccggtctcgttgtggggagtattgcaaccggttcatcgcttgtagctgcggacaataccgttggcacgacaaatacgacagtcgcagtgacgggtggcacaatcgaccttgcagtgcctgacacactgacttttccaagtgagcctgtcgaagggattgttagaggcaatgtcaacgagacggttaattccgctgacaactcattattaacgatcaatgacttccgcggtacggacgccgggtatacggtgtcggccaaagcgtctgcgatcacagccgctaatggcgatgttctgccaggcgcggccatcgaactaacgccggatgccccagcagtgacgaatgctgatgccccgacttggagtaaagcggtaacgttgacggattcagatcaaccattattcgccacgaccaaatcgctaaacggtgccggcattagcagttatgatctgaacaaaacaacgttggcaattcctgaggacaacgctgttaaggctgaaagctattccggtgtcatcacctttacattgacaccgggtcaaccagccgcaccagctactgcacagtaacggtggcgcgaggttgagggttttcgacttttctggttgtacttgccggaagggagttggttcatgtcaggacatcaccagaagactgttcggtcacaattaaaaatcagcgcgggtacccacgtcgcttggatcggcaatcattcacgcaccatatcgtattgaatccacaagtctttcatctctcttatgaattttcatctctacacatgcggcatcaccattgtcttgggggagacggtgatgccgcatgaaaaagaaccaaagttaatgtcttgctcaaggttgacttgcaactgtcagctttgataaccaagtcgcgacacggcaaccagcaacatcagagcgcaaacagaagcgctaaaaaatcggaacatgttcaaatcccaatttgatgttaccggcattgctgatcgttcacgcgcacggtcagcgatccaaaacccacagtaccgatcttttcaaagttcccgaaatgggttgccgacttggtctatcaaaaagcatcaaagaaaccgtcgattttatgatcgacggttttttcgtgagcgcgaaccagcccgggtagaaaccggagcatatgcggccttgggcgtgatggttggtttttgaccattgcgaccacggtccttatgcacaggtttctgggctggcaagcgcgttatgacgaagcccgaaccagcccggatagaaaccggagcataagcggccttggcgtgatggttggtttttgaccattgcgaccacggcccttatgcgcaggtttctgggctggcaagcgcgtttatggcgaaacacagcgcaattttcacgaaatcagtggtgcgccatgcccaaatgaaccgggcaacaaaacctgcgccgaagcgaatttagccgcatgacttaatgattccgaaactttggcatccaatgttggcttgctagaagaatacaaggtcgcagcaaaggacgtaatataagcatcccctgctcccaacgaatccaccgccttcacgccaagcgcctgctgccaagacatcatgccgtcgaccagcgccgccgaaccacgcaatccgcgtgaacaaacaatccgatcgcaaccagccgccgcaacccggcgcatcaatgcctccacatcatcatcagaccgtgctttgccagaaagataggcgagatcaatctgtggcgcaatctttttaaacagtttgtcatcgtcaaggatcgaaaagtcataaaccttgcgcgctgtgatagcctgcagaaaagcatccgcatgactttcactattcagatagaccagatcgaaactattgatataggcgatgtcctctgggtcaagtcgcagctcttgtggcggctcgccgaccactttacgccgtgccccgtctttgtctgtgatcgttgtaaaagcatttcgaccggcatattgtagcgaatgctgcacatctacgccgcgttcgaccaacatgcgccgcgcaaaatcgccacgcgcatcattcccgaacgtcccgatataggctgcctgcaagccgagttcggcggcaaaaaccgccgtattcgctgcatgaccgccaagatacatctgcttatcagccggataaagatcaacgacattgtctccaatcgcaatgactttcaacgatctctccttctttccatcaaacgcagcaactgcagtcttcgatcaaactgccgtcatgcacacccctgcttcctgttaacaaggtcaagtttaccacagcaggaattaggtgtgacatcaagcttgtcatgttttccagaatgcatgatcatcactaggccccatcagcctgaggaaatgaacaaaacggcgtccaaaactggccgtcgttttttcgttttatatgttattccaagctaatgtctgaaaacttattccggtcaccaataacagtctccatatttcgatgatgggtattatcaccatcaggtttgctttttcatctcgccaaattcccaaccaccttaatcttcacccgattcgcattctcaggatgataagccagcggcacctcatcgacttcaacgacttcaatcgtcgtttcatccgcgccagattcaattgctgcggcagtagctttctcctttgcatcagccatcgccttgtcgcgcggaatctggttgtatggataaattcggccgtattcacccgaaacctgactgatggacgcaccaatcgcgtttgccacaccgcccaatgggtcacgaactagtttgccgaccccttccaaccgatgcggtgcaatgatggcaccgccaccgacaaggatcactgttgttggctcagcactcgtcttcattttatcaatcgccacggcgatcatgtcgctgatcgtttgcaaagccgcctgagcgaacttcagtggaatctgcttggtcagttgtggatcgccgacatccgacaaacccaaacgaaccgcaatgtcagtggcggtgataatgttaccaccaaacgtcaatgcctcatccgtaatcttgtagccaacggaatcaggaccaaccgtaacactgccatcttgctgctggcgaacgatcgaaccgccgcctaacccaattgacatgatgtccggcatccggaagttagtcgccacgccgccacaatcacagtttatatgcgtttttcagcccaatatttgccgaatcgccagtaacaccaaacccaatcccatcattgccatcgtaacgttaagtaccttcgtcacgattcgccgctcttggtcatccatctcctctatcatgctcaaactatagtcattgtaaggaccagcatcccagtacccgacataataactcagcaacttcttctcacgaccagtcaacggcttactgtcagcgcgaagcaacagttgatcatcaaacaaagcatacatatcatcgctcaacatagcggtcttacgatgccgcctcgcctgctcactgacccgatcgaacaaccgctgaaaccgttcccgcgcctgcgcatcttcatcatcctccgctgaccacgccgttaattttcgctgaaagatcgccatcacatcgttaaaatgttgccgttgaaaatgattagtaaacgtcagataacgattctgttcattcagatatttagtttgccaagtctgataaagaaagtagccaaacaaccacaacacgatcaaagcattgatcaagttccccaagttccaagccgtcatcagtttctcaagactaccaatcacccaaaaagtcaggatcatgagactaacaaacaacgacaacagctgtttctgccgcatctgcggattccgctgcatctcgtcatagatcgtctggcgatgttttaggtaaaggacaaagtagtccaaaaagttcaatgagcggacttgtcggtaggttttaacaatgtaaaagagcaggatgaccagtgaaaccatgttgatgacgcggttgatggtgtcgattggggacatggaggactcctttttaacttattgatgtatcacacaccaatcaatttttatgaatggctaacttgacgtgttttaacattgacctctgacaaatcatgatcactgccagctaacaatcgtttaatgtgttgcactcgacccaaagcgctgtctccacctgcgtaaacggcaacgtcagaatcacctagttgccgataccgttgatctgcctcgacttcattaacatgtttaacaaggctttcatcactattggccatagcgaaaaagttagaggggtcagcatcccacaggaggtcaatcagctgattgtacaaatcagtccaacttttaatttgaaccacctgatcatcaacaaaactgaaagcaactggcttagtaccggttgggttggcttctagaatcatgtccaacgtatcccatgaatttggatcgtctgtcgcaagctgagttgacacattgggacgtggccaaactgttaacgctcttgttaccaaatcagcctgccgttcctgtaaagttgcttcatcccacttatcgaattgcgctacccattggttgagtttaatacctgacttacgataaccgtctgccatatcccgcttctcaatataagggcgattgctcatctgaccattaaacccagttaaagtcaggttagctagtcggttcaaccaaacattgtggaccagtcgccaatcggtccccaaagccttctgccaactactattcacaactcgcggcataatatgttcaatcgagtacttaccagattgcgccgcatcgaataagtcctgctcctcaccactcgaattattcagttcatctagaatgaaccacagtgacatagaactcatgtggtagtaatctttctcaaccaacgcgtcttttaaagattgatctgttggaaaacgtttattttctttaacgacctgcgtcaacactaacttcaaaccttcaacataatcaaccttagcttggttaacataatgctccacttggcgatccagcgcggcaaacagcaaattcagtccagtagtggggactccgataaaaagccgccgagccagataggccagcaaaacccgcaacacttcaactaattgatcagcggatagcacgccatcacgcgtctttgcaaaaacctgcaataagtacggcaccaaaatatcgttatttaaatgaccgagtctaatcaaaagtgatttgactcgttgatctttgatggcaacagtcgctggcgccgtgatttccgcaaagagtttggctgccgcctgctcctttttcaactgagcaatttgatcaaagtttttagtcaaacccacataacggcgataatcgctgtaaatttcattttctttaaccggctttgagctccgagccaacgaggttaagtactgccgatagaaccgcgagagctcctcactaccaaccaagcgctcgttctgttgccatagttgaaaagccgctgcttgttgatcgcctttcaagcccatcagcaaaaagttccggatcttgtctgattccgttaaattcataccggttgaatttaaactttcaaagatcaattgagcatcatcgtattgatcaacaacgatgttcataacttgcaaccgttgttccaacaaggaaagccactcatggactgttaagtctccctgctgcaaaacgttccaaaaataagcgtaggtgcttttgaaaatcgtatccgcagctgacaaaccattaattaggacatcgacatattgctcctcatcaccaggcaccggatgcaacctattcttcgcgattgaatcccgatcaaacctgtctattaaaaacatttcgttaactcgttgataatccacatcacttgatcctaaaaaatcacggatagcaatcaagaataacgaaacagtggtcagtcgttgctgcccatcaatgacatctaccgtactagtgtcaccagtggcgttcaaaattaaacttccaaagaaatatcgttcgcgttgattcacataagccgtcttcaaatccgcgacaaaccgttccaactgttcccgtcgccaactatagcgccgttgataaactggaatattgatggtcctattattcgcaatcacctgactgacgataagctctgcattacccttcacaattgtcaccccaaagtagtattttgctggcaagttcaacttgattagcactaattgatcgctagcattctctgggtattagcataccagagatgtggggttgtggcggagtttggttgtctatactctgaagttttgcttactcggaacgcttgggaaaagcgtaagtttaaagatcttgttgtgcgtgtcaacaaaacatcagatgactcgacgataccaagtgttgaatttgaagatatcatttcaaaacaaggacgcttgaataaagatgttcgattaaaaatcaattcaaagcaaggcatatactttgagccgcaggatgttctatttggaaagttacgtccatacttacaaaattggttgttcccaagtttttatggtagagccgttggtgatttctgggtactgagagccaactcaagtgtactttcagagtacttatttgtccttatttaatcacctcgatttcaaatcgttgcaaatatttcttcagggacaaaaatgccaagatcggactggaatactgtttcaaacacttcatttccgataccggttcaaagtgaacagcggaaaatctggcagctttttaatgtattggataaccttatcgctgcaactcagcataagattgatgctttggaacaaatcaaagagaaattatcgcaaaacctttttgatcaatcgtggcgattcaaagaatactcgactccttggaaggaaaacaaattgaaagatattgtttcagcatattctgggggcacaccatcggcaaatattcgtacgtattatggtggacacattccttttattcgttctgcagaaatccattcgtcaactactgctttaacacttactcaagaaggccttcagaattcttcagcaaagttggttaaaaccggcgacattctgtatgcgttgtacggagcaaacagcggtgatgttgatcgatcaaagattaacggagcaatcaatcaagctattctcgcgatgaggccatcaaaagagaatgaccctaactttatattgtttcagctaatgaggatgaaagacaaaatcgtttcaacatacttacaagggggtcaaggtaatctttctggaagacttatccttgctttgaatctcgatatgccagaatcaacacttgagcagcggactattggaagattacttcaactactgtgtgaacttatcggtgtaaatcagtccaagtattctcaacttgagttactcaaaaaatcgttacttcaaaacctttttgtctgaaacagtaaaatgactttttctagttcatatggtaaacagtttaattgtctaacaaagacaactaaaccaaggaggtgcgcaatgaatttacgcacacagaaattccatatgtacttcaaacagtggattgaactctacaaggaaggcgctgttcgaccagtcacttatcagaagtatcaaatgtcgcataagcatttggtaacgctagctcctgatctgcatatggacgaactcaagcgacggacgtatcaagagttaatcaatgaattcgccgcaaatcacgaaaaacagacgactctcgactttcatcaccatctcaaggcagcgatactggatgcattggacgaatgcattttagaacaagaccctacgcgcaaagtcgtcatcaaaggaaccgtattgcgtgtacataaggttaagtttctaaatcagcatgagctcacaaagttgttggccctgctggatctcgatcacgggttggactgggactacttcctgctactaatcgccaaaactggtctgcgattcggtgaagcgcttggcgtcacacccatggactttgatatggcaaaattgacgctgacgatcaataagacatgggactacaaaagtgccactggaagctttgcagagacaaagaatactgcctctgttcgcaaggtgccgcttgattggcaggttgctatgcaatttgcaactcaaatcaaaagtctcccacaggacaagccaatttttgttacagatggacagcgagtatacaacgagacagcaaatgacattcttgagcgcaaatgtaagcgagcaagcatccccgtcattagcattcacggactgcgccacactcacgcgtctttgttactttacgcaggcgtctcggttggatctgttgcaagacgacttggacacgccaatatgagcaccacgcagaagacataccttcatatcatccaagaattagaaaaccaagacaacgataagataatgcgctatcttacctcattgatgtaacacaaaaggatcgcctaacgcagcttcaccgcgtaagacgatccttttcaaatgaaaagggcctgtaataaggccttttttaataattcaaggctagaaagtctggattgagttgcagcgataagactgtcaatgcagttcaatgtttttgcaattctatcttgttcatttttctttggaagaaaaataattgcgtctttgatgtcagctgaattaattgaatcaaaagtggatcccgtactataccgaagccaaaagccattaatcttcaatgtgatcaaatactggtataagaaatctgtctgaccgacacttgccacaccgcggcctaaaacaacatcaaatgctgtcttggaaacttcaccaacaggggcacggacactaagtagtacacttcccttttttgctatcttggttatttgggtagtccaaactcttggctctacccatccgttctttatatccgcatttccttgaaccaagatgtggtcctggggatttaatgtgtaattcttgctatcaggtgattgccccattgtgatagtagctacctctcccaacttacgcttttcccacgggtcagagtaacctttgaagcgccatgactgatcaaaaagacgttgaagtaacgcttttttagtttgttccaaagcatcaatcttatgctgagttgcagcgataagatcatcagcttttctcaagaattctccgatatttctttgttccgaaatgtcgggtagcagaatgcctttagattccatgtctttttttgtaacatgaatcattgttgatccatttgttgaattaagaagtctgactctatccgcctcgaaaaactgtaatgcaaaatctttctcaaataagttcttcagagcaactttccaaatatgatagtgatagatcacctttgggccaatccaaatatgtggtccgaaagtagctgaccaagtgtacaataggtctcccttttcagcataatatttttcaggcaattccaagtcagaataataccaattgtcatttgtataaaaattgccaacacgaagaactggatatttaccagaagctagtagctcatcttgtttataagcccgaccgttaataaattctgccagttcccccaacttacgcttttcccaagcgtcagagtaccccttaaaccgcaatgcaggaacgtttttagcatccttactcatttttaaacagctccttcaaggcagcgagttgtttagcagcttcgtcattattggctactaaatcgtcaaaatctttcgctagctccgaacttaatcttgcaatttcttcatcgtttttcttgatatcagcaaccactttgaccacatcaactggcttttctggttctgtcgtatcaacgtaacgcgggatatttaagttaaagtcattttccttgatctcatcgaaggatgcgagatgggcatacttatcaacatccttgcgattgatatatgtttcaagaattttttggatgttgtcgtctgtcagatgattttggttcttagccttctcaaactcttttgatgcgtcaataaagagcacatcgcgagtcgttctagactttttcaagaccgtgactgtggttggaatgctcgtgttaaagaagatgtttgcaggcaaaccaatcaccgtgtcgatcgcgccgttttcaagtaatgctttccgaatacgcccctctgcaccaccacggaaaagaacaccgtgcggcaaaacaatacacattaccccagtgtcctttaagtgatagtagccatggagcaagaaggcaaagtcagccttagattttggtgcaagtccatagctgacaaaccggggatcgttttctgtccccttcgacggctgccaatgcgctgagtatggtgggttcatcacaacggcatcaaagtttgttggttcttcaattggccagtcttgatccaaggtatcagcattgtgtagatgctggttattaattggcacaccatgaagaatcatgttcatacgcgctaaattgtacgttgacgtattcagttcctgaccaaagtagttgatagacagacgttcgttcgaatagcgacgcgcatttagaagcagtgagcctgatcccattgtcggatcataaatcgtgaaaccacggacatcttccttaccgtgcatcgcgatttgcgtaataagacgtgacaccgactgcggcgtataaaactcaccagcatttttgccggaatcagaggcaaattgaccgatcaaatattcgtatgcatccccgagtatgtcattcgtgttctgacccaccagatcaagcgtcgagatttgtttcatgacatccgagataacctgattttgcttttgcggggttgcacccagctttcgcgaatacaaatcaacatcctcgaataatccagaaaagaattcactagattgttcaatatcacgaaagctctgactaaggtcttcaagctgaaaggtgccgtgatcgattttgtctatgagagccgtaaaagtcagatcaggctgaatgtgataaccaaactcatcggaaacattacttatcagatcatcatgcaaatctttatcattgtatgcatccgtgtaaatttgctgggctttatccagatctgttgtcttctcctccaattgatctgaagcataaaccaccatgcgatcagaaagatacttgtaaaaaattaagcctagcaagtaattcttatattcgctggcgtccatctttgatcgtaagatatcggcagaattccaaagtgcttggtacagtgtctgtgacgtcatttgagccatcgttaagttcctccaaattagtcctgattaagtggcaagatctcttcgcgaatgagattcgagtatgcatctttaaattcgcgccagtacgagatctttttgacaggattttcactattttccttatacatttcataatccatatgacgttttaagctctcttcgccgggattaaattctttcttagggtcaaaattttcagcgtagaaaagcgcctcttcaggatcggcaccccatgtcgtcgcgacatccttgaccaaatgctcaattgtttcgtttttcatagtctgaagcaaagtttggacattttgattttgaaactctttaggattagcctgaatcttacgccatagactttccgtacaatagccttaaaagttgtcactttaagaaataaaaagtgatgacttttcatatattagcttaactgcctgaattatagaatttttaagcagccactaagtagcattactgtcactgacgcggaacagggattggttcaggttcaagcaggcgcagtctggggagatgttgccgaggctttacgtccgtttaatttaatcatctcaagtggtgattttggtgatacaggtgttggtggactcgccacaggtggtggcattggcttactcgttcgtcgtctagggttgacaatcgatcatattgtcagcgctagactagtaaccgctgatggtgagatccgtgtgactgatcatcaaaagtatcctgatcttttttggggtattcgaggtggaaattcacagttaggaatggttacagcgttcacttttaaagcaagtaagttggttgaagagaaatccgatatttcgctaccatttactgtacaaaccattgaatcccaaacgagcaatttgacaaagttcattcagcaatggcaaagttggataactcacgcatctagtaaaatgagcagcaatctcatgttgactgccgagaatagaaatactgttcacattaatgctagtaatttttgggcaggttctataaattctgatgcgaaagccttgtttaaatcagctctaagcctttctgaagtgaataaacagcaattagagacaaaaagctatgctgaattggtcaaggctcctcatatcccgcattctaaacaacaacctgttttcgtaaaaaatattttactggatgccatgaatgctaatattggcgatattatcagcaaaatacttgtttctccaggaatcattggtatcgaaatgagagcaattgacggcccgctaaataccattaatgctgatgaaactgcatggcatgatcgaaaagcgaaagtattcttagctatgtggttgcaaaaggacacagagcctcatgctaaggaggtttttggcccactacaagatttagggacgggtgtctatagttcctactcaagtgatctatcgatagaagaaagtcaacgtatttggccggaagaaacaggtcgcaaactgagaaaacttataacaaagtatgatccacaacatctgtttaaccaaggacactattggtaatacgtgtccaatctcgatgccaccgaacgttatttctgtggtgaaatcaccgcttagctgccaagttgcatagacaatacccctcaatagtattttcagtcgttacccatgactttaaagaggcctaggcaatctgtttcgaattcactaaggcggttaacagggaattcatactcactgatctttaacatcaagcggcttaattgagaaataattccagatgcttttacgtattaacttaaatcgtgttgcgcattttgggcgcgaattagtgtatttaagatgctatatccttgactcaaggatattgtacttcgaagattattcgcaataaattcgttcttgaaggggtattcagtctgactaatcaattgtattgcagcttgttgattgaaaatggttcttttatattcaattctgttatcgtccagccacaaccattgcgcgccaaattggtttgagaatggcatgcctatgctgcctgcgttgataatctttttattaggcaaggacaattcaaactgtatatgagtatgtccacaaataatatacgattcttgaactcctttaaataaagcctctaggtagtggctgcttaaaaattctataattcaggcagttaagctaatatatgcattagacgaattgtcaactcaagtgcaactttttacccatgaagacttctgatggcgtcttccagcctaagaccttgcgtggtcgattattcagttgttcaatgtaagtctcaatttcctggtcgctctgaaggtctaggtctgtgttcttgggaaagtattctctaatcagtccgttggtgttttcgttagttcctcgttgttgaggcgcgtgtgggtcaggaaagaagacctttgtattcagacgttctgccagctccctgtaccgggcaaactcccttccacggtcaggagtcactgttcttactcggttagctggtaaggcaccaagcagctcaatcatgacgtctctaacagtgtcagcttttgcgttggccgttcgcttcgaaagcagatagcgtgatttacggtcaactaatgttactaatgcagagtgtcctgttttaccgcgtactgtatcgccttcccagtgaccaaaccagctgcgattttctgccgaccggggtcggtcgtgaattgatggcacgtcattgaagcgcccccggcgttcatttatggtgcctttgattttgcgcgtcttgcctcggtgtcgaagcagccttggtagcccgcgagcaccatggctcttcaatggaacgccgagattatctaggtagatacctctgtagatagtcgaatagctgatgcgaataggactgccttctagtgacaagcgaccggcaatctgctcaggcgaccaatgtagcaccgtgatatatcgaatgacagcgtcacgagtccccggtcgatcgaggatccgaggacgcctgctagccaagcgaacccgccggtagcggtcctgagcggtggctgccgaatagctccgccagccgccgttacgtgcaatttcacggctgactgtactcttggaacgacctatctctttggcgatggtatcaagagttttgcctgtagagataccaagcagtatcgattcacggtcttttaaggtaagatgggtgtacggactcatagtcgagttctccttgtagttggtcttgtggtgattccattttacaaggactcaggctatgagtcttttctatttgactaatttgttgcacttgaattgtaaatccgtcctggatccagaaaatacattggcaattatacagacttcacacaggccgatagcaccaatccagctgtttatagttggcaactagtgcaggggccacaaggtccacaaggtgatagtggtgcagatggcctaccgggtaaggatggcgtaggcatcaaatcaacgcttatccaatacgcatcaaataccagcggtacagtagctccaacaactggctggacaacaacgattcctgcagcttcccccggctattatgtttggactaagtacacatggacgtacaccgacggcactacagaagcaggatactcagtgggcaagattggtgagacgggtcaaactggacagaagggtgatactggtccgcgaggccctcaggggcctcagggacctcagggacctcaaggccctcaaggtgttcccggaagcaaggatgtgccatacacttacattcagttgggcacacccacaagccccaaaaaaggcgatttgtggtggcatggcacaacactcaacgatgccacagcattacagtattataatggatcaacttggattgaccaaagtatccagcaggccattttgaacattgagaaacttgttgcgattgagattgacagtgcgatcattgattctcctgatatcaatgcgccattccatcacactgctcttagcgatgccaatttaggaaagttcagcagtggcaacaccagtatgcaatatggtcacgtgaatatcacagggaatgttgaaaacgatcaaggtacagcagacggacacactatgattagtgacttgggcccatcaggttttatcagtcgtgaacgaacacctgacaatgccggagatacccaatatgctaaccttcaaggcggcaagcttaatctttcaactctaattagtgctgaaaatgcggccaccaagaagtatgtgtttagtacattcaagtcaacggacaatgtcacctattattggagcagcaccactccatattcaaacgcagatactcaagcggcatacattaattatgctagaagaaataacatttgcacagtaagctttgatctttttgtgcgaggcaagcaaggatggctagatcttgttaagccaagagacggatataagccatacttagcaaagtcaacagggacaacgctgttttctgtatcttatccaggtgctacttgtgccgtttattacgtggaaggtggctactggcgattgatcccgtctgttggcagtggcgagtatcgaggctcattctcatatctaacgcaagatgattatccaacaggagatccatttttttaggaggcaagtatgaaaatcaaagtgtggacagatagcaataatcggttgcttaattgggcaaacgctgatgaaagaagaccagtagggccaaccgatgaaggattcgaggttattgaggttgacgatgctgttagcttgtatgagaaccatgcaagtattgttgatggcaaggttgttcctgatgctggctatgatccagacgctgacagacctacacctgagccgttacctgagcagcagatgattgccgcactgtatgcccgcgtgacacagctggaggatggtggaaagaatgagtgactttgagttttgcagtatgctccattcttgggggtgcccgatagagcagtacgtgggccatcaaataaccgaggatcaatacaagcaaattacaggcagtgactatgtcgccagcaaaagctagcggctatttttatggaaggaagtgatgacaatgctaaataaaatcagagatcacccgacacacacagcactcgccattggtatggttgccattggcttgtttctaatcatcaatgaccattatttcatctggcccccacattactctgactggttaaacgatgacattgtggggtttttgtttgtcattgatggactcgggattgggggttgggtgctatgggaaacacagttagcagtgacaaatcgtctgttgctcacaactaccagctttttaatgtcgttcttgacaatactgcaatttctgacctcaatctcaactggaatctactcaaattggataagcaatgcgatcataacagcctttgtgctgattctggcacgaaggagtgacagccgtgacagcagcgataactaaaattattgtcagttctgctccatacattgctggtattgcttcggctctcatcgctttcatgacctaccgcgagggtaaacggaaaaacaggcatgatgagcttgaggatatgaatgacagattacgcgcagacaatgaccgtttgagacgtgagaatgagcgtctcaggaaggaaaacaaatcatgaataattggacaaatcttgtggtatcacttgcagtagcagcaatcccgatcattggggcttggatctcaaaacaattgctggctaacaaacaggcactcaccttggtaaaggtaaatttactacaagggtcgaagatatggtggcctagttcaacagccactacttaactgtgaaatatctaaaatgataccgccatcattcaccgaagccattgaaatgccatgaccgccgctacgaaatgaaaacggaatactgtggctaacattttctctaatttttttgacgtattgaatgctagcaatgacatcacgctctgtcgttgcccttaagattagctttggacgaccggtgacaaaatagtttgaacacataagttcatagtcatcagaagtgggatcgattgcgatcttctttagtgctactggtaacttaggccacgtggagttaacatcattattcatcaaattcctcctaaaaatttttcatggttggtaaaaattgctcttacagatgctaaaaaatgatttatcatcagcgacagtcgtctatgttaaaaaatgcctttattaggctctgctgctaagcatcctcattctagtatactttttgacgagaagtgaaaggaagagacatgaagacttcaaaaacataaaaactcttaccctagcgtgaacgtggacttcacaaaaaatcttgatgtttgtttatcagcagcatttgaagactaacaccttgaaccgcgatgagaacgatgcttacagtagaaagatcaggctaagcacagacagatcgccaagtaaggatcaaagaaatttgttctggtatactaaccagagggggtagaatgccatgaaaattgtacttatcatttgtatcgtcatcgcgatagctgcggggtatgtggcgaataagaggcggcaaagacaatgataacagtttcaatttctttgcttgtcatacctcaagcttccgtgctatactccatgacggtgccaaaccacggtgagttcgtaacgatcggcgcgtaagcgttcagaaggtcgaagcggctcgccattttttgtgccctaatttagtacaaatgttgggaccgaagacgggtttgatgaacaagaacaacttttctgactgatgaggaggttggcagaagcatctttaaataaatcaaggcaaatatgagcgcattaatcgtgatgtttactatcctgggctttcattttctgcatctcccgcttttgcttacttaattttgattgccgtccgccttcccacaggctaatcaaagccaacaatccaatgatgggcatggcaatatctccaaaagagagttgaagcaaaccgtttgctaaaaagtagatgtcggccacaataaccgcgattggcagaatggcacctagcagtttattttcaatgtagccaaaaaaggtttgaagagaaatgacgatgacgatgatcagtgtttcaatcattggtagtctccttgtatttttgaatgatttcttgggccaaggctaaatcgagtttgtcgtcaatgaccatctgcatgatgctaacctaaaacttgtttttctgatccaattcggccgcttttagcttgcgaatgacgcgatccaaacgtagccggatggttgggtaagagaccgagtacttttcagaaagcttcttgagtgaaccagaagataaaacgaattgtctgacaaattcctgatcgtcttcatctagcaacaaaattggattcaatgtcacgaccaaccgccctccacctttaattttgttgatataattttaacaaaatgaaagccgcgggttccaataaacagcttgggaacggactgttactcatataccacaacaaaaaaccacagcccatcttcacaagcggctgtggcgaaataaattagcattttgatataagcggtgttggtaagtggcgtttcaggagattggctctgtgtttaagttcttcgctgacgagcgggcggttagggcttcccaatcgactaatggttgttgtacaatcgcggctaggatcagaatgagcgaccatgtgagaatcagactcatggtgacatcaccggtgaaatgggcgaggatgcgcacgcgggtgtaggccatgacggcgccgtaagcaaaggtgagccagaaaaccagtcgctggcgttttggcttgtcacgatcgacgaaccatgtcaaagttagcaaggtcgcggccgtttgggtatgaccagatgggaagctcatgtgaccattggcgccgtttggctggaaccagcttgtgaagtgggtcggattgccgttcaattcataaggacggaagcggccccagaaagttttcatggcattgacgatttggtcagatagcaggcagaccaaggtggcgacaacagccattttcaataagtaatgaagctgttcatcggttttgtgggcgagccagtactgactgccgatgaacacgacgaggtagaggatgaggaacaaaatgatactggtggcacccggcagtgttagcttgctgccgtcagagttagccatgcccattggcttgccagcgttgatatcattcagcgaggtgatcaccatggtcatggcatacttgaggtagccggcccaaagttcccaaccagcgtagatgacactaccgatcaccattaaggtgcgggtataccacgccagctgttgtgaacgaatggcataatgacaaacaatgttgcaactgagcatgataatcaacggtgcggtccacagcccaacgtcttggaacaaagtggcgaatgggtcgttcatatcaccgatggtttgcgagatttgccagtcaaaaccagcagcggcagctaacaataaaagcagtacaccagcaacgatcaagaaaatatgtttgcgaatcggagcattcaatttttgcgtttggtccatagcctttccctccttagacgcgttcgcagtcgcagaaacttccctgtaaggaccttgaagcaaaaggaccaaaaaggcggtcctttcacttcaaggccactgacacttcagtttctcagcgctcctgctctcgctctttgaaaatagcacatagtttacaaaaaaggtcgggatttacggtacctgtacgcaacatttaagtggtcgatacgaagtttacaacttatcagcaaaataaggttcgtctaccgtaacttgacgctgatcgaaaccgaccgtcgtttgcaggccgtatggcaggacggttcgcggataggcgtggccaaaattcaggttgtacaggatcggcgtcttgtatggttgagtgacatcaagcagcacctgctggtaagcgtcaaagtgagtttcattttggggcttgccaacgagaatcgccttcacttgtgcaagaacgccatgttcatcaagacgttctaaataggcgcggtaagttgcgggggttattttgtcttctgatgtttcaatgaaaaggatcttgttggtccagtcttgcgggaagagctggtactttttggccacttctggttcgtcctgatagcgaactgggtagattaagtcgtggagactatcgagacagccaccaagtaaggtgccagtgacacggccttgaccccgcagcgcgaggtagccatgctgttctttgtgtgattttcgcggtacccctaactgactttctgaaaagtccgtgcgttcgtcataccaagtcgggctggaactaatcgccgttgtggccggatttttgaaataatgctgaaaactggcggcggtgtacggcaacatgcgcgtgtctaattcagctagatcatttaaaaaattaggcccataaaagctagtcatgcctaattgataaaacatgagatggtcaatggtcgtgtcggaaaaaccagtgaacagtttgggatgatcagcgactgcttgcgtgaaagccggatcatctagcaggtaagggatgattcggtaagtatcatcgccgccgatggcacagatgatacctttgatgctcgggtcaaggaaagcggcttttaaatctgctgcgcgtgcttctggatgggctttgagataggcttggccgcgtaaggcgtttggcataaagcgcggttccagcttcatggctttcaatcgctcagtcccaagttgaagctgatgggctgcaaagctttcacctagtgttccggcgctgaggctgacaatggcaacttgatcatgtggctgtaatgcttgcggttttagcataaagatctccctgctttctcatacaatgcattaattatctattgaacatgcaggaaacgcaagcgggcaaaaagatgacaccatcgtcgttctaaccgtaaaccggttgcttgtttttccggctggcaacctgttacgatcgaatagaagacctatcaggaagtgttggttaattaaactgtgcgatttttaacaagacacagtatcagggggaaagcgatatgtataccatccaagcgactgccacgattactgggcgcggcacagtgatcacgattgcgcctccggttgaacgcattcagccgggcgatccgatccgccttaatggcacgacaacaggtaaagtctgtgcgattgagaagcggcaacatccgcaccatactgacgaagtcccgtgtctcgggttgctcgtcacggcacctgtcaaagtcggggatacaattgagtttccgcagtcgccacggtgggtgtgaactgtaggcgatacgcgctcccagttgtagaaatctgctcgtactcaaagaaaaagtcgctatctgaatcgtcaacggcatcacgttgatttcagatagcgactttttatggttactttgagcaaaatgaagacatattttggccgttgtggcttacttcgttaagagtccggcctcggtcatgccgtcagcgtagagcttgagcttgccgttgacaatatccatcaccaaatcgccgtagtcaacaccgtctgcttcggcttcttgcggcaacagtgacagtggtgtcatccccggcaggttgttggcttcaatgacccaaacacctttttcgttggcgaagaagtcaattcggccgtaattttgcaggcccagaacatccatcgtttggacggcaacatctttcatagcctgatggacatcttcatcgagatcctttggcggggtgatgaagtcggtgtagccggcttggaatttatgcttgaaatcataccaaccagaacgcaccttgatttcgatggccgagtaagcgtggccattgacaacgcctaacgagaattcgcgacctggggtgaactcttcaacaatggcgctgttgtcgaagcggaaaacatcttcaagaccactttcgagttcttcctgattatgaataatatgtgtcccaacgctggaaccgccggatgttggcttgacaacaactggaaaatcaaacgggaccgtttgttttggcccttgatcgcgcttgaattccttgaatcttgaagtctgaatgccatgatacaacatgacttccttactgaaaaccttgttcatggtgatgcctgaagccagtgggccagagccagtatacttgaccccgttgatgtcaaacacagcctgaaccttaccgttttcgccatcgccaccatgcaaagcgaggaaaacaatgtccgctgctttgcagatcgccataacattgggaccaaatagctgggtgctgccatctggccgtaacttattgatgtcttcatcagtcagaatcgcatcagaaatattcagatccttgctggtgttggcgtcatcaaaaacctgttcgaccgtcttcccttcgaggtcgtagccaagaaacaggtcaataaaggtggcctgctgccctttttgccgcaaggcgttcgtgatccggtagccgctagaaatggacacattgcgctccgtgctccggccgcctgctaaaacgacaattttcatgtgatagtacctccgcgtattatccgagtttgatagaaacctcagtttagcacaatccgggctcatcggcgataaagatgctaaaaaatggtgtaatattaagaaggcttttaagccctctgccatggttgtgaacgcgctttctctaaacagcgcagataaggagtcaaagaatgcaatacacacggttagcaatgcccaatcacgcctattttatcgtggccgatcaagggaaactggccttcgtcgggtcaccggatgcgccgcttagcgaggcggctgattatgtcagcggttcacttgaatttaatcaagaagagatgttgccgtttcaaaatgccattgatgattatcttactggcaaggcgcaaaccatcacagtaccggtgacttaccatgggacaccgctgcaagaagccgtttggcagtatctgcagacgattccttatggagagacccgaacgtacgcacaggtggcagccgcagtcggtcatccgcatgccttccaagcagtcggctctgcggtcgggaagaatcccgttatgatcgctgtgccttgtcatcgcgtcctgcgcaaagatggtggtttgggtggctttcgtggcggtttgccaatgaagcgcgacttgttggcacttgaacaagggcagcggccaattttttaaagatgctttttcacagaggcatcttgtatactggtgagtggacaaattggaaaggaagtttaacacatgaagattattgcttacggtgcacgcgttgacgagattcaatatttcaagcaatgggccaaggatacaggcaacacacttgaataccatacagaatttctcgatgaaaacaccgttgaatgggctaaagggtttgatggcatcaattcattgcaaacaacgccatatgcagccggcgtttttgaaaaaatgcacgcgtatggtatcaagttcctgacgattcggaatgtgggtacggataacattgatatgactgccatgaagcaatacggcattcgtttgagcaatgtaccggcttattcaccagcagcgattgctgaatttgctttgaccgatactttgtacttgctacgtaatatgggtaaagtacaggcgcaactacaggcgggcgattatgaaaaagcgggcaccttcatcggtaaggaactcggtcagcaaaccgttggcgtgatgggcaccggtcatattgggcaggttgctatcaaactgttcaaaggttttggcgccaaagtgattgcttacgatccttatccaatgaagggcgatcacccagattttgactatgtcagccttgaagacctctttaagcaaagtgatatcattgatcttcatgttcctgggattgaacaaaatacccacattatcaatgaagcggcatttaatttgatgaaaccgggtgcgattgtgatcaacacggctcggccaaatctgattgacacgcaagccatgctcagcaatcttaagtctggcaagttggccggtgtcgggattgacacctatgaatacgaaaccgaggacttgttgaatctcgccaagcacggtagcttcaaggatccgttgtgggatgagctgttggggatgccaaatgttgtcctcagcccgcacattgcctactacaccgagacggctgtgcataatatggtttacttctcactacaacatctcgttgatttcttgaccaaaggcgaaaccagcacggaagttactggtccagcaaagtagtcaactgaatagcaaaacgtgccctgcctattgacgaatacgttaatggcagagcacgttttttaatattgggattgattgcttaaaaaatcgaattgccacgaattgccatgatataaacgaacaaagcagcgccattgacgaacaaggagacggcaatgattgaaaaacgaatggtgtacggtctggcgcctatgtcaggatcataaaagcgtgaacggcgtttgccacggtaagagaagaaaaagcctaccagaataacgacaatgatgctctcaacaatcgtgagcaaccaaaaaaccggttgcgttgtactggcagtgaccagaaagtacccgccaagagcgataagatcgagcaggatcgaaatgagaaccatcgtaaattcctcctttaaagtgagcgtgagccaacgcgggtggaaccgaagtgtaagtggccttgggcgtgatgaccgttctttggtcattgcgacgaaggtccttacacgcaggtttcagcgctggcgagcgcgttatggcgggcgtatcgcgagtgggactaagacttgggatgtaaaggctgagccgtcagttttgtgagtacctgaatggtagtttgaacatcttgtggatcaagggtatgaagtacagaggcgagttgagcatttgtgtgatgatgcatttgctgatgtaaggcagcgacttgttgaccaagcggagttagtgcaacaatgtaggccttgcgattgtcgggcaaggataattttgtcagcaagtttaattgaacaaggcgagcaacatagcgtgagactaggccttgtgagaacggaacagcagcggttaaatcctgattgcgcagttgtttgcgactgctttgatccagcgttgtgagtaacgtcaattgggcatgattaaaccgaactgtttgcatttgccggcgagtttcagagggtaaagttgccagccaacgatcaaaaagcacttgccacgcttgctcatcggcagctcgagtatgggcattgagcaagcgaatggcttgttgtaattgggtgaaatcagaagccataggtatctcctttttaaattacaagtaatatattttgacaacagaagatcttggagttacactctagaatatattacatgtaattaaatttcaagaaattaggtggtcctttgaaagcagcgattgtaactcatttagatcaagcacctatttatggcgattttccagccccaaagccagcacctgaggaagcattgatctcggttttggccagcagtgtcaatcaacgcgttcgctcgcaggcggatgggtcccattataccaaaacgcctgagcttccatttgttcccggacttgatggcgttggtcgcaccagcgatgggcaactggtttattttctaacacgcgacccaaaattcggtgctttagctgagcaaacagtgacgcagcaacagctaatgtttccactgccggaagatgctgatcttgcgaaaattgccgcgagtgtgaatccggcaatggcaggctggatggccttgcacatcaaagcggggcaggttgttggtaagcgggttcttgttcttggtgcaacgggggcggctggcaccgccgctgttcaaattgctaaaacaatgggtgcttcacatgtggcagcggttggtcgaaatcctgataaggtggcggccttaagcgatcttggtgctgatacaacagtgcaacttgatgacaatattgccttggcggctttaccgccagccgacattgtgcttgattttctatggggcgcacccagcgcaaccgtgatgatgacactgctaaaagcgcggcgtgatcatgctgccaagttgatttggattgagattggtggtgccgctgggccaacattgtccttgccggccgctgctttgcgcagtaccggattaacgttggttggcagtggccaaggcagtctgacattggctgactatcaacgggaattgcccgctttgttcacggccttagccgctggaaaatttgtgacaccaacaacggttctatcactcagtcaggtgcatgatcactggcaagatcgcggtgcggctcgacttgtgttccaaccttagcccatgcaaaaggcgttctcgtttgtgagaacgccttttgtcatgatcgtggttttcatgatgccgaagaacacattaagtgaagcattcaggatgtacgccgcacattggcttaacgaatcagttaaaagaataaggtcaggcaggtaagggcaccgggaattgcttgcacaaagtagatcttcttgctaacggtcgcgccgccgtatagacccacgacggtgacaaagccggttaacagccgcaaggtaatcaattgatcaatgccgtgcagcagtactaggctgagcaacatgacaacagcgagagcaccgttatagatgccttgatttttcaatgcaatttgagcattgggttgtttaacaaaatcaagcggcatgctgaagttttcggcctgactttctggtttgccgaacatttccaaggccatgatcgtcaaatgcaataaaccgagcaagccgacaagtaaggtgctgataagtgacacgatgtcacctccgtttctttctagacgaaactggttcccagtttttctaaacgcgttcgcaggcacagaaacctgcacataaggaccttcaacataaatgaccaaagcccggccatttatgttggaggccgcttatgctccggtttctaaacgtgcctgctcacgctctgcgaaaacgcgttcactgacccagaaactgggtcagctcacgctctgtggttagatgaacggtcggaattgggctaaggcaaatccagcgactgtcaccaatactaacgctgcaagggtgctccacacaatcggtttgctcaggtgatggtcctttttgccagcgaaggcgatctcgattaggccgatgaggccaattgcgattagaattttaaccaccgtcaacaacggattgcgcgcaaaagcaaagcgcatcaagacaatgccgctcacaatggaaacaagataacaaacgcgggtgatcatcgtccataacataaactggcgagtcttgctaaaaagagcgatccccgctgcaatgattagaactgcccatgaaacaagatgcatccagagccacataaaaatgaccctcaattttcaagccaagtgcaacgatgataacgaattcttgatagtggtctaggctgttacgccatgccgtcactgctctagctacgcgtcgccaccccatctggccggagattgcggcgtttggcacggcaaggaacttttagcctagcacccgcctacgattattcggaatttaacgaatcacaagtcctacaagggaattatggctcacgctcgtccctacaaatcagccctaaatagcaacattaccgctaaattgactgttatacagatcagcgtagaagccgtttttggccatgagttcatcatggttgccggtttcaacaatcgaaccatgatccatcacgatgatgttgtcagcgtcgcgaatcgtggaaagtcgatgtgcaacaacaaaactggtgcgattcgtcaacagtcggttcatggcatgctgaatatgaatttcagttcgggtatcaactgaactggttgcttcatcaagaatcagaatctcaggatcggcgacaaacgcacgcgcaatcgtcagcaattgccgttgcccttgagaaatatttgaagcctcttcattcagaatcgtgttatagccatctggcaactgtcggacaaagttatcaacgtgcgccgccttggcagccgcaagcacttcatcgtctgtcgcatcttctcgaccatacttcaaattatcccaaatggtaccggtaaacagccacgtatcctgaagcaccatagcaaaatgcgagcgaactgcctctcgcttcatatcacgcgtgtctgtcccgttcaagcgaatcgaaccgccactgatgtcgtagaaacgttccagcaagttgatgatcgtggttttgccggccccagttggtccaacaatggccaccatttgccctggtttcacttgcaaattgtaatccttcaacagcagcatatccggtgtatacccaaactgtacgtgatccatcactaatttgttcggatcatttgcgactgctggcacaccagacggctcgtcttgcatgtcctgttcgtccagaacagcaaagattcgttcggcactggcaatcgttgactgaatcgtgttagccaagttggccaattgtgaaatcggctgagagaactgttgcatgtattgcaggaaagcttgcacattccccagtgtaatcgcaccgttggcaacttcgataccgcccatgattgctacaaaaacataaccgatgttgttcaggaagatcatgagcggcatgatgatcccagaaacaaactgggccttccaagcagcattataaaaggcttggttctgaccttcaaaatcgcggacttcatcgtcttcacggttgaaactcttgatgatgacttggccgccataagtctcttcaacttggttattcagcaaccctaaggctttctgctgagcagcgaagaacctttgtgacttaggcgcaacaatcccgaccacaatcaggccaagcggaatcgtcaccaaagcaatcagcgtgagtttccaagagatcgtcaacatcatccagatcgtcccgacaaacatcacagcacttgtcaccatttgtgtcagactttgctgcaaagttgaggcgatattgtccatatcattaatcgcccgcgacatgatatcaccgttgctgtgcgtgtcgtaatacttaatcggcacagttttcatcttgtacttcaaatcttttcgcagttgataaaccgtgttctgcgaaattcgggtcataatgaactgctgcaggaaactgaacagtgcactgcccaaatacaagactaggacgattaagataatctgtttgatcttgtcaaaatcaactggataagtgccaactgacatgccagctttttgttcagcttgccccttcatgacgcctttaaaaatttcagttgtggcttcccctaaaattttcggcgtgcgaatctgaaagacggttgaggcaatcgccaaaaccagtacggcaatgatcccaatcagccgattgcgcatgtaaccaaacaaacgcgccgtcgtgccccagaaattcttcggcttttcaacgagaccggcacggccgcctggacccatccgagggccggacggctgcttcgtggtttcagactttttttgatctgccattattgctcgtctccttcccgaatctgtgacttgataatctcctgataagtcgtgttggtggccttcaactcagcatgtgtccccttgccgaccatcttaccttcatccaacactacaatcgtgtccgcatcagcgacggttgatactcgctgaccaacaatgacaacgacttttgtctggattttagcatcggcctttaaagcggcccgcaaattagcatcggttttaaagtctagcgcagagaatgaatcatcaaaaacataaacagatgcatccttgaccaaagcacgcgcaatggctaaccgttgacgttgcccgccagagaaattaccgccgccttgttcaacttgatagtccaggccttctggattggccgcgatgaaatctttagcttgggcaatttcaagggcatgccagatttgatcatcggttgcctcatcattcccatatttcatgttatcgcgcaccgttccggtgaaaagattggctttctgcggtacgaaagccacagcttcatgcagcttcttcaaatcaacggctttcacgtcctcgccgtcaactcgaacatgccctttttccgcatcgtagaaccgaggaattagattgaccatcgtcgttttcccactcccggttccgccaataatcgccagcgtctcaccaccagtgacctgcacatcaatatcactcaaggctggctcttccgcatggtgataacggaattggacgtgatcaaactgcagtgcaggatgggtagtgtctaacgactttggtgaggttggcgtcgtaatccgactatgttgatccaaaacttcattcaaacgaaccgcagaagcctgcgcccgcggaatgaacacaaagatcatagaaagcatcatgaaactcattaaaatctgcattgcatacgtcatgaacgcaatcagattcccagtttcaagtgcttgttgcgcgatcaaatggccgccccaccaagtaatgccaatgttggtgccactcataatcaacgtcatcactgggaaaaccgcagcgatgattgaaaagaccttcacggcattgtgcgtgtaatcttggttaaccgtttcaaaccgattttgttcaaaatcatcttgacggaaggcacgaatgacccgaacgccagtcaaaccttcccgaaaaactaagttaatgttatcggtcttcttctgcatagccttaaacaacggcacagcaaaatacataataatcaataggaaaaaggctaataatggcagactaatcaagaaaaccatggtcagggtatgactcttttgataagccaaaaagcttgccccgatgagcatgattggtgccatgatcatcattcgcaagatcatcatccaaacgttttgaatttgggtgatgtcgttcgttgtccgggtgatcaaagagcttgtgccgaccttgtccatctcatcatgagaatagttaatgaccttgcgatagacgtcggaacgtaatttttgtcccagtttttgcgatgtctgcgacgcaagaaaaacatttcccacgctcgcaagaatactgagcaaggcaaacaggatcattttcatcccggttgcccaaatgtaatcaatatcgcctttggcaaccccattgttaacaatatcggctgtcaagtttggtaagtacaggttgctcatcacctgaacgatcatgaacaggacggcgccgatgacggcccagccagacatgcgtttttttgcaagcttaagcataatttcctcctaacacgtgcattagatcgcaattgcggtcgaccgtcttgcacaatttaatgacgttccccttcactggcaacgccgtactgcaaccagtccagaatttgattggtgcgttgcttcaactcagcaacggtcacctctttacctttagtctggcgtgaataaaaatagccgattgtctgcatgaacatcccgacaatctgacgaatgagcaaactgacatcatcgtcgcttttgattcgtaactgacgacgatcaatatttgccagcaaatactgatgtatctcatgatgcccacggggccgctcagctaaaggtgatccggccatttttgaggcactgtggaaatccatatgcaaaaagacattgcgataaagtgctgcatgcggaccttgaaccagcgcatcaatcgtcagcccgaaaaattctgacatagcggcaaaaagatccccgtgatgtttggccatcacctgttgcaaagcagcaactgcgcgatgccgcacctgttccaataaataaaaataaagatcggctttgtcatcaaaatattgataataactaccgcgcggaatccctgcatcctttataatatgactaatactagcatcattaaatggtgcgcgggcaaactctttattagcggcatccattagacgtttttgctttgcttccggtaaccgaaaaaacgttggtttcggcatgacggcctcctttcacggatatgacaatttgtcatgtgacaagctgtcattatagtcgcggttgttttaaaatgcaatcaaaaaacgacaaattcagtcgaaggtctgaggttgtcgttttaacaaaattcttattactgggacatgactggttgctgttaaataaccattcagcccaagaaatcactttggcgactgatccgaggcagcatcgggtgccgttgatgttgctgagccgcgaagtgccaaaatgtcgcgttcacgagttaaattaacgccgcgcacctgccactgcttctctgtgatgtcaacccgcgtcacactggtattcttcaacagcataaacggcaagtcctctggcgccagctgatgaatcaacgcactcagtaacataccgtgcgaaacaactagaatgtcactgttatccgggctttgggcgatcacttgggtaaaagcctggtgggcacgagcaatcaaatctggtaagtcctctgcctgatgggtcggatctgcttctcgaattgaccgcacgagtccagcaaaacgctccgatccgcgccaagcccgaaaagcggcagccaccccaaattgacgaatcgtgcgggtgatgacggcgttaccagaatcaccttctaagccgccaaaataatattcacgtaaggcggacaattgaatcaatggcggttgcggctgatgaccagcaataatccgatgagcggtttcaattgtcctgccgcgatcactggtaaagacttttgcaaaaggcactggccgtagcaactcgcctaatcggtcggcagcggcgcgtcccttagccgtcaacgccgcatctgtgatgccttgcaattgtcgtgccgcattcataggcgtttcgccatgtctaaccaaatatagccttatcgtcatgtctatcactccttcagtccgtgcacctatgccatctcatcatcattgtcgcatcgtgactgtccactgcgcattctcgcttaacgcacacacttctcctttccatggtatcatgaaacccgtaagcatttctgaatggaggccttttttgtgatcaacgcagccatcatgatactggcatatgcccatgcccatccgcaaagttatcaggttcgcacggtaccttatcaaaatgtcaccagtattcttttagacgaccgtgtgttgtttcctgaacaatcactctttttcccaccaaatcggttacgggttatccgtttgccagaacattttgcattcaataatcctgagttaggtgcatggttattaagcctgctgcctgaattgagtgaagacgctgagcaggcttcaactaataatatgtggttaaccacgagccacctgaccaaggcacggcgcctgctaattgaggtgtcatttgaataatgctgtcaaagccgtcttcacccgtggcctgcgcgcggtgctgatggctttcttccttttcatcgcacgcgcttttttaacttggccatggctgttcttcatcatcggcgcttttctgctttatggttgtctttgttttggctacgctgcctttttagcttggacccagcgctcataaccgggattaaaatgatttagacgaaaaaaagatgctgtgaacaaacaagtatgtctgttcacagcatcttttaatatcgcgcttgggtagatagggatcgaacctatgattatggattcagagtccactgcgttaccacttcgctactacccaataacttaacaacgagtaatatcttaaaaaatttttgcgcacttgtcaacgtctttttttatgaaggtgcaaaatacctgattctggcgtaaactattaccaatacttaagaagtgaggcgcaagaatgaaaattgaatctgcatgcacctcgattctggtcggtaagaaggccagcatcgatggttcaacgatgatcgcacgtaacgacgacaccttcagtcccctaacaccacaacgtttctatatgcacgcgggctggaaaggcgagaaatcgctgcacgttaaatcacctttgaacggttttgaagcagacttgccggagaacggctatcgctataatgctgtcccaaatgttgagaacgataaactcggtgattacgaggaaagcgggatcaacgaacgcaatgtcgcgatgtcagccaccgaaagcacttacggcaatgaacgggcgttggggtttgatccgttggttaaagatgggcttgatgaagacttgatcgtcaacatggtgctgccattcatcgaatctgctcgtcatggggttgagtatctgggtcaactcatcaagcaatacggctctcctgctggcaactcggtgttgttttccgacaaagacaatgtctggtatatggaaatcgtgactggccatcattgggttgcacagcgcattcctgatgatgcctacgcgattgctgctaatcaggttgctatccagcaggttgactttgatgataccgacaattttgtctggagtgaaggtattcaagaattcgtcgatgcgcatcacctgaacaccgacaaagaaggttggaacttccgccacattttcggcacgatgaatgaaaaggatcgtcactacaacacgccgcgtgtgtggtatggtcacaaaattctgaatccagaaatcgaagctgatcccgaatcagccgaattgccattcatcatgcataccgatcacctgatcaaccgtgaagacattgcccaaatcctcggcagccattacaacgagacaccatttgatccttatggtcatggtagtgatgccgatcgtttccgttaccggccaatcggcttgaaccgtacgcaaaattcacacattttgcagctacgccgtgatgtcaatgaaggacttgctgccattatgtggctagcgattggcatgccgactttcagcccatatgtatcgttttattgcaacgccaacgataccgatccaagctactctaaaacgccgaaaacattcgatatcgatgccgattcagcttactggctgcatcgcctcttggatgtgttagtcgaagcgcattacacccagtttattcaagcagatcgcgattatttaactgccctgaatcgcgactatcgtgaaatgatccaagccaccgacgacggtgccaaggatcttggggataaagagttgacgcagtatttaactgaagccaattacaagttagttgatcacaccaagcaagctactaaagctttgattaacaactatgtcatggaaagtttaaaactgtcgaagttaacgtttaatatggataaaaatctttaagttataagtgaatgacatcaagcggtccgaatcttgcggccgcttttttgctgacaacttcttacaaccgatccggcatacctcacccaaatggcaatcaaaaggaggcaatgatcgctatgtcaaaatctcgtatcgaagcgtttagcgatggcgtgtttgccattttaatcactattttggtgcttgaatttcatcccgttgctggccgaccagggacgctgttgcaccaagtaaccggacaaatgccattattaatcacttacctcacctcttatttttacgtcggtaccttgtggcttttccaccacgactactttactcatgttaagagaaccaccacggcgctgaatattttgaatctcatcctgttattcaccgcaacgttaatcaactacagcatgtcactggttgcaatggcgttacgaaccttgaatcatgctgacatgcaggtagcgtttattgtctacgacattgtcgctctcttaatttcgctttcttattggttgatttatcattatctaagcacccatccacaactcaccgatcatggcatcaccagtcctacacaacgtatcgatccgttaatcagtggcttaatttatggtagttccattttggtcagttggctgaacgtttggatcgctggcgtcttgctacttcttggtatcgtcttccatttcatcgcttatttacgcatgcgcctgcctgctatgcattaaggttttgggacatgttgccaagtccctattcttttccttttctgacccacaaaatgtgtctgcgtttattttcaatcatgaaagcatcccccaaaataggtttgaccgcccgatcacacttgacgtaacatggcattattgtcttaaacacaggcagcaagcggctccgtgccttgcaattattttaaaaagggggcgttacccttggtgcgcgaaattcagttacgctggttactgacaggtgccttacttagtagcattggcatgagtttcatctggcctttaaccagcatttatttgcataatcgcctagacatttcgctaactgtcatcggtgtcgttttactgcttaattcgcttgggagcgtcgtcggcagtatcattggcggacgtctgtacgaccaaggcgacccctaccgccttgctttgtttggtgtcgggctcaccggcttggtcttgatcggtttgaccttgtggcacggctggccagcctacagcatttggctgaccttactgggcattggctcagggtggaacattacgatggtgaattcactcggcacaagcatccgatcaaaagacggccgctatgtcttcacgatgctctactttgcgcaaaatgtcggtgttgtggttggcactgcgttggttgggtttgtttatgatatcagtattaccctactttttttgattgccgttgtgttatatggctttttctttgggatcgtgctaatcaaattccgaccggcggcaaaaacagcgcaaccgacacgaaaagaaacgacgaccgaaacaccaaagccgagtttgcctagtgcaaacaagctgatgttgaccactttcttttttgccttgctcatcttttggctcatgtatcaacaatggtcatccaatttgtccgtctacatgactggactaggcattccgttacgcaattacagtttcctgtggaccttgaatgccgctttaatcgtcgtcattcaactctttttaaactggttcaacgaacacgtcaacggcattcagattatctatcaaattctttttggtctcgtgatggttgccatctcatttctcattctgatcaccgcgcacacatatgcgcttttcatgatcgcaatgattgctttgacaactggcgaagcgaccgcatcccctgctattcctgcactcgttaacgatctgactccgcgtgaaatcaaaggccgctaccaaggtttcgtcaattcttggggttccgttggtcgcgcactcgggccattattcggcggtctaatcatcgactggctcagctatcgcagtttgttcatcattgccgcagtcggtgtgtttgcgctagtcgctgtgcttatcgttgtttggatccgaactcggcggcgattggtgcgatatcagtaatccgaatcgaactacttggaaacgcagccttaaattcatttatcgaaaagctacggcgttgtctgacgaattgaattggcaatgcactaaaagatgccttaccacgaaccttttagggaaaataagcgccactaaaaaatcaggtcgtgggctctcgcaattgcgaaagtccacgacctgattttatgcagccttgttgtctgttgaatccttcaagttcttaatggcctcttcaaccgtccgaccagttccaaaatggttctgatcatgtgcgtcaattgctacaaacaactggtttttagtgtctaattgtaatcgatattgcatcatgatgatcgcctcgcttaatcaaacttctggcctgccaaagccttcaaacaggctctacctttatcatagaacttatgtcaaggcagtttctggatcagtaacagcctttgacaatcaatgattgacgcaccttatcaaatgcgtgatattaacacaattaataatgagcatgctaaactcaaaaaaggaggtaattgcttatgcaaataaaaagaaatatcaactggtttcatctcattttgagcattgtcgtcgttgagcttattgggtccctttccggtctactcgcaggtaatatcaagggcatctatacatccttaaagctgccgccactttcaccaccagccgctgtctttggaccagtatggatcatcctctacttattaattggcgttgctggttacttagtcatcaaagacacgacatcgcgtaccccaaaaaccatcaatctcagtctttttggcagtcaactgcttctaaacttcatttggagcatcgtgtttttcggcggcaatagctattggctcggactgatcatcattatagtgcttgatttggttgtccttgcctgcatacttgcctttcgcaatgtgaataaactggcagcctacctgtttgtgccatactttgtttggattttattcgctacctatttgacgttaggagtggcgatgatgaattagtggcttgctgaccaatacattgtatacatgtattggtcaaattaattaaattcttttcgttatgattctctttttctttgagccgaaacaaaattcagatatacttcagtgacagtcaaataagggcatcatgaacccacgtttgacttggcggtttggttagacatcacccctcaactattttggatcgtggaggtgatggtccatgcctaattggaaagactggagggttgggcacgctagaaatagcgttagcaatcttggttattgccaaagcgtattttatatacgcccaagcaaccaagatactaaaagaagctagccacgagggttagcttctacaccagtcttccagaccgtgtcgaggtcatcggggtaccctcccgatggcctcttttcaatatttacaatgtatcaacagtgactttttttgtcaactttaaggttaaatttgtttgatctacgctggttactctgactggtatattgcgaagcgtcttggttacagcagtttaaaggaacttcaccgcatgtacggccatgtcttcacgcaaatgcaggccgaagctgacaccaagttgcgggtgtcaatcggtcaagagtatcttggaaaaaaagggacaaagtagtaaaaatgccttcaaaagactgaaaacatcatcggtcgccacattccgtgctggacgctggattcagcgatcattaggggacttctaaaaactcaatgcatttatcaccgcccaaaacccttgaggcacaatagtttccacgtttcaggggggatttgcctttttccacgaatacttgttcgtgaaagtccccgatcaatgccccctaagttatcctttttagtcttttctccccaaaacaaaaacccccgaaacaccattctaaaggcagttcgaggatttcatttgttcttatttgttctatttctcacccgtacgggattcgaacccgtgtttccgcgctgagaacgcggcgtcttaaccccttgaccaacgggcaatgagtggcgcttaatatcgtacctaaattattctacaggaaagtgcgaaaatgtcaaatacattttgacagcacttggtgccaactgatgcgggttttcgcttttccctgtcagtcattttggctaatgatagatgatgccactcgtgttgctaataaagtttcttttgagccgattgatagtctttgaatgccccgatcgtcaactcgcgatcatgttgggtcagagcaagcatgtcgcctttcaagccggcattgatgaaatcatagatagcggcatcgcgaaagccaattgccgcagcatcgtctgctgtgttgccatagtatacctgcttaatgttggcccagataatggcgctgagacacatgggacatggcatggcagatgtgtagagttcacagccggttaagtcatgtgtgccaagtgcctggccagcttttcgaatcgccgtgatttcgccatgggcggttgggtcgtgatcgaccagcacttgattatgcgcgcggctgacaactttaccatctttgatgatcacacaaccaaacggaccgccatcgctaccattgacgtttgccttggcttcttcattggccattgccataaattcttttcgatacataagcgattccctccaaaaagacagtactcaccacgccaaaaattcactagcgagcattttcttgatggcatccgaatgattagatgccttatatcccaaaatccacgacaacttaagccttgatctgattaaccaaatccgcaacaactgcgtgcgtcaattgactagtagctggtgacaccgggttcttcccttctggatccgccacagcctgaacaaaggcctgaaccattggctgaaaaccgcgcgttgttaacatcggctgccaatcaggcgcaaatgtctgcgttgccccgccacgtccgtaaacgacgagttgatcaagattctgcacacgctgaacgccacttggagccgcaacctgagcttcttcaagattggtacctgcttgtaagtcaatcccagcttcaccgcggatgcccggtgcggtgaaaatcacactagcttgctgcagtttaccatcatcgccggtatgcaatgaatatcgggtatttggtttttctggatagcctgccaacattaaggccgtatctaccggatgaataaagagatcccacagtgcatgttctggatcgtcaggggcatcaatccgatttttgtcaacgcgaacgccggttttatcatcgacttcagccaagtcctgaatcataggcgcaaatcgtcgattgaatccaaccgttagcagcacgtgctgggtatcggctaaatcatataattcattgatttggcccatatctgtggcaagtggtttatcaacaaaaacgttgacgcctttttccagaaaatgtttcacatactgataatgggtttccgttggcgtgtggatcatgatggcatcgagcggttgcgcatccaaatcctctaaagtcgtgcccgcaatcgcgagtccgtcttgtgttgccaattgttgcaatttatcgtcgttgcgggtgctcagtacccagtgcacttgattctgcatttgtgtgtaaactggcagatatgctttctgcgcaatcgtaccaagtcccatgacaccaatcgttaacatcgtttcacctgttctttcatgacaaaataatttactttcacactagcacaggcccctgtcagggtaaagataagcattcgtaatgatccgcctgcctagtcaaatgccactattattaacacagtataccactggtcctgtccttctattttacgcctctccgttcttaacgaccattcagcgacaacttgaaaactttcaaaaagaagtttacggttattatgtaaactaaaataaagtagccgcttttgtacgctgcttgagcctaaacggatcgtcacatcaaacgcgagatgacaactagtccgctcttcttttttctactcaaatttaagcgacgcctaaagcgacacaaagtaccattaatcatacaaggaggactcgttgtgaaacgtcactgctctagctacgcgtcgccaccccatctggccggagattgcggcgtttagcacggcaaaggattctttgcctagcattccttcccacactgtcgtagaaagcatacgcggcctaaaagcctgctttgatgtacccgccatcgcttaatttcttgcgtagttgcaacattgctgtataggtggccagaacgtaaagttgatcttgcggggagcgttttaaggtgctgatgacatcatcaagagctggcttgctgacaagcgctttttcgggcacacctgcgactgtaaggcgtaaaccgatgtccttgtagcgttcgccgccgaccaaatagctggcggccttttgactggcaacgagttcttcaaaattgccgtcccaaatccaactagtatcaatgccatctgcataattggcattaagcagcattgcaaaaccaaacggctgcttggcggtttcgatcatgctgaggacctggttgaggccgactgggtttttaaccaaaatcaaggttaattttttcttgccaagttgaatgacttcttgacgaccgaagaccttctcgtcataagcaaaagcttggctgatttcagtcggggtaacaccgaacgcccggccaacagcaaaggcggcgagcgcgttgtagatgttatacatgccaccgatgtcgatgtggcatggttgatcatcaatcatgaagtcgctgctttgtggggtcatttgggtgacctcggtgatttgatgggttaaagcggggcgtttgaagccgcaatgcggacaaaaataattgcccaaattggcgtaagtttgtgcatggtagtgcagaatgtgctgacataccggacacaagacaccgtccgtattcggcggggctttatgatcgccatttgccgtgagttcaaagccatagtaggtgactggattaggcagctttcgggagctgaaaatcggagcgtcgccattagcaatgaccatcgcttcaggatcgcgtgtcacaccgtctaaaattttctgataggtggtataaaattccccataacggtccatctggtcgcggaaaatattggtgagaacaaaggcattgggttttaactgagcggcaactggtgcaacattggcctcatcgacttcgagcacagcgataccgcggccatgaccgcgcttcggctgggccaaaaaagccgttgtgataccttgcaacatgttggagccagtggggttcgttaagacttctttatatttctttttaagcaccttaacaatcaggctggtggtcaacgtcttgccatttgttccagtcaccacaataacatcgtagttttgaccgagcgtccgcaagacttggggatcaattcggttggcgatctggcctggtaggctcgacccgccttttagaaatgtgtgtaagaaccagtaactgctgcgaccaatggcagttgccaggctagcttttgcagaaaatgccacggcgttcttcctctcaacttaatgggactattttagcataagttgcaagcaaaccggcgggcgtggtgttctttgcacaaaaaatccgttatactgtgagctgtgatatttgagatggaggcggcatatggcccagcttttctttcgttacggtgcgatgaactccgggaaaagtattgaaatcctgaaggttgcgcataactatgaagaacaaaataaacgcgtgattttgatgacaagtgccgtggatgatcgtgccggcgtcggtatgattgccagtcgaatcggcttagaacgcacggcaattccgattacacacgaaaccaacctttacgacatcatcaaggcaactgaccctaaggctgcctgtgtgttgatcgatgaggcgcagttcctgcagaaacatcacatttttgaagcagcacgtgtggttgatgaattacatattccagtcatggcgttcggtttgaaaaatgatttccgcaatgagctgtttgaaggttcaaaatatttattactctatgcggacaaaattgaagaaatgaaaacgatctgctggttttgtgccaaaaaagcgatcatgaatttacggattcatgatggccagccagtctacgaaggcaaacaagtactgattggtgggaatgagtcgtattatccagtttgccgacatcattattttcatccgccattgaagcagattgaccctgccgattaaattttaaatggcgcttgacgataagtgcccgcattggcgcgtttagtgactagacgtgtcgattgtgacgccggtaaatgcattttaggaggaaacatggataagatttttgaacagttggatggtctgctggaccgttatgaagaacttcaagagctgatgtcagaccctgaagtgattagcgatacaaagcgttatctttccttgtccaaagaagaaggcggcatgcgggatgttgtcgccgcttacaagaaatacaagcaagtgctttcagatattaaagaaagtgaagaagttctgcgggaaagcaaagacgacgacatggaagctttggccaaagaagacctcgaagacttgcagaagcaaaaggctgaccttgaagatcaaatcaaggtactgatgctgcccaaggatcctaacgacgataaaaatatcattatggaaattcgtggtgcagcaggtggtgacgaagccagtctttttgctggcgatttgttgaatatgtatatgcattacgctgagcgccaaggctggaagaccgagatcattgacgcaactcctactgaagtcggcgggtacaaagaggtcgtggtcatgattactggggacaacgtctactccaagcttaagtatgaaaatggggcgcatcgtgtgcagcgcgttccagtgactgaaagtgccggccgcgtgcataccagcactgcaacggttggcgtgatgccagagtacgatgaagttgatctaaaaattgatccaaaagatattcggacagatgtttatcggtcatcaggcgccggtggtcagcacgtcaacaaaaccagttcggccgtgcggatgacccatattccgagtggcattgtggtctcaatgcaagatgaacgtagtcagcaggaaaaccgggcccgcgcaatgcagattctgcgttcgcgtgtttacgattattatgaaacccagaatcaggaaaaatatgatcagaatcggaagaatgcgattgggactggtgatcggtcggaacgaatcagaacttacaactacccgcaaaaccgggttactgatcatcgaattgggttaacactcaacaagttggatcgtatcatgaatggcgaactggacgaaattatcgatgcgttgatcgttcacgatcaggcacaaaagatggaatcgctcaatgtctaaaacgtatgccgaggcgctcaagtgggcgtctttgttgttgaccaaggacgggattgatcctgacggtgcgcggtatgtcttgatgacacgtgcggacttcaccccaagtcaattgattttgcatcgtcaagatctgatgcctgaaacacgttggcagcaatttcaacaggatgtcgaacgcttgcgtcagtttgagccggcccaatacattgtcggggtagcccctttttttggtgagttgtttaaggtcacgccagcagttttaattccgcgatttgaaactgaggagcttgtggcttgggccgctgaagagcaacggacagcacaaactggcttggatcttggtactggcagcggtgcgattggcttaaccttagcccgcaagttgccgcaaacaacgatgaccttgagcgatgtttcaccagaagcacttgcggtcgctaagcaaaatgctaaggaacagcaggtggcagttcagtttacggtgagtgacttgtttgcagctctaccagcacggtatgactttgttgtgacaaatttgccttatatcgccccagaagagacgcctgtgatggatcaaagcacgctgcgttatgaacctaagttagcattatttgcagggcatcatggcctcgccgtttttgagcagtttgttgcagcgttgcctcagcacttaacagctggcggggcggcatacttagaattcggttatcgccaagagccggcattgcgcgaactttttgctaagcaactgccacaggcgcaggtgacttttcgacgcgatatggcagatcatcctcgtatggccaagctgcaattctgaaggttaaaacgcatggtgtgacccttgaaccgatctgctacaatttttctactaagtttgagctattttaaaaagaacatgatttggaggcaacatcttgtcaaaacgttatcacgaatctgatattccggaagctgtggctgcgctgaagcgtggtgagttggtggcctttcccaccgagactgtttatggtctcggggcggatgcgaccaatgtgacggccgttggaaaagtttatgctgctaaagggcgaccgactgataatcccttaatcgtaacggttgccgacgccgatatggtcggacaatatgccgcgattaccccgcttgcagcaaagctaatggaggctttttggccggggccactgacaattattctgaatattttgccaggtcggctgtccatgaaggtgactggtggcttgcagacagctgccttccgaaatcccgataacgcgttaacgcgcaaattgattgcgacagccggcgtacccattgtcggtccatcagccaatacttcgggcaagccgagtccaacaactgctgaccatgtgttgcatgatcttgacggcaaaattgccggtgtactcgatgatgggccaacccaagtcggtgttgaatcagcaatcattgatctcacggtcacgccaccagctattttgcggccgggagccattggacccgatgaacttgaaccgttaatcggacacgttgatacggcagcacatcatgttggccaaaacgaagcacctaaggctccaggaatgaaatacaagcattatgcaccagctgcgcaagtagttgttgtcgatgatccagcccaattttcggcagcggtcgcttgggctaaacaaactggtcaagtgtttggcctgttggcaactgatgcaattttggctcagtatccgacgataccaagctattcacttgggaaggatgttcaaagcgctgcccacgctttatttgccgggttacggtggtttgatttacatcccgatgtcacgctggtcttagcacaagccttttcaaaaactgaattaagtgctgcttacatgaatcggctgttgaaatcggctggcgatatgcattttcaaggatagtcgcggcgaatcatagcgctaaccgtttatgagtgctggactatcgaggactcaagtttagccgtcgtgctgaatcgttatcttggatgatggcagctgtttaaacgaaacagaacgccaacattcagctacaaataagtagattttctagcagacccaagatgatttgctataatgagaccaactgacagagcctttgtgagttggtttttttaataaaagcaaatgcaacgggtgttttgatggcgcattttaaaggaggaacttacatggatttcatggcacaagatccagaagttttcggtgcaattcataacgaagaggaacgacaagaacataatattgaacttatcgcttcagaaaacattgtttccccagcggttcgggcggcacaagggtcagtgctgacgaataagtattctgaaggttatcctggccatcgttattatggtggtaatcaatacattgatgtggttgagaatctcgccattgatcgcgctaaaaaattgtttggggccgaatttgcaaatgtacagccgcattccggttcacaggcaaatatggccacgtatcgcgcctttttagaagatggcgataaagtgctggcaatggatctaaccgatggcggccatctgactcacggcagcccagttagttttagtggtcaggaatatcatttctaccattatggtttggatccgaagacagaacggctaaattacgccaagattcgtgagcaggctgaacaggtgcaaccgcgaatgattgtggcgggggcttcggcttatagccgcgagattgatttcaaaaaattccgcgaaattgccgatcatgttggggcctttttgatggtcgacatggcgcatattgccgggttggttgccgcaggtttgcatatgaatccggtgccttacgctgatgtggtcacaacaacgacgcataaaacgctgcgcggcccccgtggcggcttgatccttgctaaggcgcaatacggcaaggccattaattcagcacttttccccggtattcaaggcgggccgcttgatcacgtggttgcagcaaaagcagttgcattaggcgaagcgttgcagacatcttttaaaacatatgctcagcatattctggataacatgcaggcgatggtgagtggttttgaagaagatccgcatttgcggttgatttctggtggttctgataaccacatggtcttgattgatgtaacgggttatggcgtaaatggtcgccaagttcaagatttactggatgaagttggtatcacgactaacaaaaatcaaattccaggagagcagaatggcccgtttaaaaccagcggtatccgagtaggtacggctgccattaccactcgcggctttacagcagatgagagcaaacgagttggcgaattgatcagtgccgcgattgcccagcgtgatgatcagccagctttggaccagattcatcaagaagtgcttgcactgacagcccgtcatcctttatcatagttagggtttgcaaacaaatgattatcaaagaaaacgtgattgacttcttttgaaaccggtctatcagagggcttaggacgtgatgctcacggtagcacatggcgactaagacctttatatagcggtttctaggatgaagaatgcgtttaggaggcgccaaatgggcaaatttacagttttgaatcacccgttgattcagcataagctgaccctgattcgggacaagcatgctggaaccaaggagttccgcgaaatcgccaatgaaatcgcggaattaatggtgtatgaaatcacacgggatctgccacttgaaagtatcgaaattgagacaccgatgggtaaaactatccaaaaacagcttgctggcaagaagcttgcggttgtcccaattttgcgcgcgggtttagggatggttgatggtgttttgcggctgattccagccgcaaaagtcggtcacattggcatgtatcgcgatgagaagacccttaaaccgcatgaatactttgttaaaatgccgccggatattgaacaacgggatttgatcattgtcgatccaatgctggcaactggcggatcagctaacatggccattgaggcactcaagaagcgcggtgccacatcaatgcggctagttgtcttggtggcagcgccggagggtgttaaagccgtccaggcggccaatccagatgtcgatatctatgcggcagcgttagatgatcatttgaacgaaaatggctatattgtgccgggtcttggagatgcaggcgacagactttttgggacaaaatgacattctttggcatgtgtaaaagcacgtgcctttttcatatttcttcaaaagaattttcatagccgcaaaaatagatggtcaaaagccgcccaaagccatgaaaacactgatgaaaaagccgctatggcggcaaaagtttctgctttcagtgctttgtcttttaggtgaaatggtgttagagtaatgattgtgtttcaggggtctgccctagtaaacaacgattatcgaagtctccgcaatcgtgcatcatcattttgatgatacaaatgatatgacgtcacttcagtaaggaggtgaattctgtgaacgaacaatatccctcgatcaagctttttggcttaagctttaacctgacgaatgacatcggcgttttggtttcggcagttctggtattcttactggtattctggctgtctcgcaaccttaagatgaggccaggcggcaagcagaatgtgctggaatggatcatggactttacgaacggtatcgtcaaaggtaccatgcctggttcggagcgttatacttttaatttatttgcgtttacgctcttcttatttattttcattagtaaccaaattgggttattccttgaagtcgatatcggcaaagacacttggttccgttctgcgaccgcgtcgcctgtcatcacgatgacgttggccatgatggtactggtcctctcgcattacttcggggttgtcttcaagggtttcaaaggatatctcaaggggtatgcgtcaccggtcgcaatcctgcttccgatcaacctgcttgaagagtttacaaatttcattacactctccatgcggctgtatgggaatattttcgccggcgaagtcttagtcctgctcatcaggcaatttgctttctcaggcggggccgtcagcttcgtctccggattcttgcttgaggttctgtggcaagggttctcagtcttcattggtagtattcaagcgtacgtttttgtcacgcttgggatggtttacacatcacacaaaattgtgtccgagtaactaaattaggaggaaatttcttatgcaattcatcgctgcatcaatcgccgccggcatcgctgccttcggtgcttcaatcggtaacgggatggttatcagcaaaaccctcgaaggtatggctcgtcagccggaaatggctgggacacttcgtgggactatgttcatcggtgttggcttgattgaagccgttccgatcttgtctgtcgttgttgccttcatgttgatgagtcgttaatctggttcatcaataaagaagggagtggcaaaaaatgactttaggtgacacactcttcacactagtcacatttctggttctgatgctagccgtcgggaaagtggcctggaagccagtttcaaaaatgatggcggatcgtcagcagaaaatttccggagatctggattatgctgaaaagtcacgcaaagacgcagatgctttagtagctaaacgtcaagaagaactgcaacactcccaagccgatgccgttaagatcgtgaatcaagccaaggaaaatggcgagaaactgcggcaatcattggtcgacgctgccatcgcagaagtcaccgcgatgaagaagaatgcgcaaaccgacattgatcaagcacgtaaagatgccttggccagtgccaaaaatgatgtggcagacctaagtttgaccatcgcgcaaaaactgatcggtaaggaactcaatgcagacgatcaaaaaggtttgatcgatgactatattaaacggttaggtgatgcaaatggcagtcactaatcagatggtcgcaccccgctatgccaaagctttattggaagcggcacaagatcaaaatcaggtggagacggtccatgaagagttacaagcgctacagtctgtctttaacgacaacccaacgatcttgactatttttgataacgctcgaatcacggcagctgataaagatgccttgatgacaaccttaaccaaggatgctagcccgctggtcgctaacttgttgaagttaacccagcaatatgggcgattcggagcattaccagccatcatcagcgcgtttaaccaagcgtacgatgaggaagccgggattattgcggcgactgtgacgactgcagttgctttgtcagcagatcaagctgatgctttgcgcagtaccattgctgcgcgttttggcatgaaatcgacccaactggatcaagtcgttgatccaagcgtcatcggcggtgtgcgaattcaagcacgcggttcggttatcgatggtacggtcaagcaccgtttcgataagatgaaagctgcactgctggcagactaatgagtaagtaaaagaggtgaaccggatgagcatcaagactgaggaaatcagttctctgatcaaaaaacaacttgaaggatatcaggacgatttggcggctgaagaagtcggcactgtgacttacatcggtgatgggatcgcacgtgcgactgggctggaaaatgccatggccaacgaattgctccaatttagcaacggctcatacgggatggcgttaaaccttgaaacgaacgatgtcgggatcattatcttaggtgacttcgatgagattcgcgaaggcgaccaagtgaaacgcactggccgaatcatggaagttcctgtcggggatgccatgatcgggcgagttgtcaattctttgggtcagccggtcgacggtttaggcgcgattaagacggataaaacccgtccgatcgagtttaaggcgccaggtgttatgcaacgcaaatccgtatcagaaccgttacaaaccggtttgaaagcgattgacgcgctggtaccgattggccgtggtcagcgtgagttgatcattggtgaccggaaaaccgggaaaacatcaattgcgattgataccattttgaaccaaaaagatcaaaacatgatctgtgtgtacgttgcgattgggcaaaaggacagtacggttcgtgcccaagttgaaacgttgaaaaaatatggtgcgatggattataccatcgtgctgactgctggcccatctgaacctgcaccaatgctgtatatcgcgccttatgccggtgcagcgatgggtgaagagttcatgtataacggcaagcacgtcttgatcgtgtatgatgatttgagcaaacaggcaacctcatatcgtgagctgtccttgctgctccgtcgtccgcctggtcgtgaagcctatcctggggatattttctatacccacagtcgcttgttggaacgtgctgctaaattgagtgataaactcggcggcggttctatgacggcgttgccggttattgaaactcaggcaggcgatatttccgcgtacatcccgactaacgttatttctatcacggatggtcagatcttcttacaaagcgatctgttctatgcgggtacacgtccagccattgatgctggtgcttctgtttcccgtgttggtggtgatgcgcaggtcaaggcgatgaagaaagttgccgggacattgcggttggatctggcatccttccgtgaactggaagccttcacgcaatttggttctgatttggatgcagcaacgcaagctaagttgaatcgtggtcgccgaacggttgaagtgctgaagcagcctgttcacaaaccgttaccggttgaaaagcaggttatcattctttacgccttaacccatggcttccttgatccaattccgattgaagacattactcgcttccaagatgaactgtttgatttcttcgatagcaatgcagctgatttgctcaagcagattcgtgacaccggtaatttaccggataccgataaacttgatgcacaaatcaaggcttttgccggcggattccaaacgagtaaacaacttgctgcagcgaaagactaaggaggtgccgcatggctgaatcattaatggacattaagcgcaagatcgcatcgaccaagaaaaccggtcagatcacgcaagccatgcagatggtttctggggccaagttaagtcagatcgaaaagcgggctaaaaagtatcagatttattctgataaggttcgccagattgtgacccatttggctgctgggcagcttcttgagttagccaacgctgcagaaagtgataccgattcgggcgacaagagtcaggtcatctccgttgctagcctgcttcagaagcggccggtgaagaaaaccggctatctcgtgatcacaagtgatcgcgggctggttggcagttacaacagcacggttttaaaagccatgatgcagatgatcaaagatgaccatgaaagtcctgacgattacgtcatgatggccatcggtggtgtcggtgctgatttcttcaaagcacgcggcctgaatctggcttatgaatatcgcggtgtttctgacattccgacttttaatgaagttcgggaaatcgtaaaaacagctgtgacgatgtttgacaatggtgtgtttgatgaactttacgtttgttacaaccatcacgtcaacactttgacctctgctttccgtgcagagaaaatgttgccgatcagtgatttggatgtcagtgaagtggccgataccaatgttgagtatctgattgaaccagatcttgactcggttttggaatcagttttgccgcaatatgcggaaagtctgattttcggcgcgattatggatgccaaaacagctgaacatgccgcttcgaccactgctatgcgtagcgcaactgataatgccaatgacctgatctcacatctgtcgacccaatataaccgggcccgacaagctgcgatcaccactgagatcactgagatcgtcggtggtgcggcagcactagaataatcacgcgcccgctggtgttggttcttaaacacaccagctcggtgctcatcataacgcgcttgctggtgcagaaacctgcgtgtaaggaccctgaacgcaatgaccaaagtgcggtcatcacgttcaggcccacttacactccggtttctaaacgcaccagctcgcgctcaatttacaacaggaggacgaaaatgccaaattcaactggtaaaatcgcgcaagtgatcggtcctgttgtcgacgtagccttcccaatcaatggcgatctgccagaaatcaataacgccttgaccgttgccaagaaggatggctcccagcttgtgctggaagttgccttggaacttggtgatggcgtgatgcggactattgcgatggattccaccgatggtctgcaacgcaacatggcggttcaagatactggcggtccgatctcagtccctgtcggaaaagacacactgggtcgggtgttcaatgtgttgggcgaccccatcgatggcggtgaagcctttggaccggatcatcggcgcgacagcatccatcgtgatgcgccaaaattcgaagatttgaataccagttcagaaatcttggaaactggcatcaaagtcatcgatttgctcgaaccttacctgcgtggtgggaaggtcggactcttcggcggtgctggtgtcggcaaaaccgttttgattcaggaactgattcataatattgccgaggaacacggcggcatctccgttttcactggggtcggcgaacgaacccgtgaagggaacgacctttacttcgaaatgaaggaaagtggcgttctggagaatacagccatggtctttggtcagatgaacgagccgcctggtgcccggatgcgggttgccttgaccggattgacgatcgcggaatacttccgtgatgttgaaggtcaggatgtcctgctgtttatcgacaacattttccggttcactcaggccggttccgaagtttctgctttacttggtcggattccatcagctgttggttatcagccaacgctggcaacagaaatgggtcagttgcaggaacggattacatcgactaaaaaaggttcagttacatcgattcaggcaatttatgtgcctgctgatgactacactgaccctgcgccggcaacgacttttgcgcatttggatgcaacgaccaacttggaacggcgtctgactgagcaagggatttatcccgccgttgatccgctggaatcatcttctagtgcattgacgccggaaattgtcggtgatgaacattataaagtcgctaccgaagtgcaacaagttttgcagcggtatcgtgagttacaagatatcatctctattttggggatggatgaattgtctgacgaagaaaaggtcgttgtggcccgtgctcgccggattcagttcttcttgtcacaaaactttaacgttgcggaacggttcactggccagccaggttcatatgtgccggttgaagaaacggttaaaggctttaaagctatcttggatggcaaatacgacgattaccctgaagatgccttccgttcggtcggtcgcatcgaagaagttgtcgaaaaggctaagaagatgggctttgctcctgacgatcagaatacggatgctgacgaaaagccggctgcacaagctgcagctaactaaggaggcgacgcgttttggctgaaacgagcaacgttcttcgggtcaacatcgtgacgcctgatgggttagtatacgatcatcacgccaggatgctagttgttcattctgtcgcaggcgaattgggtattatggctaatcacgaaccaatcgtgacaccacttgagatcggtgaggttgacgtgcaacgtgttgacgccagtgatcacaacgattcaattgcggttaacggcggttttatggaagtatcagaaaatgttgcttccatcgtcgccgattctgccgagcgtgagcgtgatattgatctcagtcgtgcgcaagctgcgcgcgatcgtgctcaaaagcgcattgctcaagcaaagaatgatcataatcaagacgatcttcggcgggcacaagtcgcgctgcgacgggccatcaaccgaattaacgtcaagaccagtcattaaacatgaaaagcagttctctcccaacttggagaggactgctttttgcttgctgcttgatgaaagttagcaaaacctgcaatcaaggccacttatgctccggtttctaaccgtgcctgttcacgctctgcttgcgtcttatcgcgttctgcgggaagatacctcatgaggtgatcatatgtttcagacaatcggtttaaacggcgcgattacaatcgtgtcgcattttgttttcatcatgctcgcgttccgtgcactcaatgccttgcgctttgaacagttcatcaaagctaaccatgttcgtgaggcacaggtcttgttactcttcattgcggttgcgctaggattcttagtcagttcgttctttctatcactcttacaatcagctttaaacttacctaaacttttcctgtaaaaacctcgtcttaactatggtataatgcgatagttagtcaatttacgaggagagatatatacccatggcaaaagatattgggatcgacttagggacggccaatgtgctgatcaatgtaaaaggcaaaggcatcgtcttaaatgagccctccgttgtcgccattgatacccataccggcaaagtgctggcggtggggacagaagcctataaaatggttggacggacaccgggtaatattcggtcgatccggccgttaaaggatggcgtcatcgctgactttgacattaccgaagcaatgcttgaatattttatcaataaactaaatgtaaaaggtgttttttcaaagcctaatattctgatttgtgcaccaaccaatattacggatattgaacagaaagcgattattcaggcagctgaaaagtctggcggccgccatgtttacttggagttcgagccaaaagtagcggctgttggagcgggattggatattttccaaccacaaggcaatatggttattgatattggcggtgggacgagtgatattgctgtcttatccttaggcgaaatcgtcacgagtcgttcactgcgcttggcaggtgacaaaatggatgcttccattgctgcctacgtgaagaacaagcataagttaattattggtgagcataccgcggaacagatcaaaatcaagattggtgccgtttacgaagccgatgagaaagaaacgattgaagtccgtggccgtgatattgcgactggtttgccacgcgaagtttcggtgacatctgttgaagttgctgaagctttacatgagacgatgatggcgatcattgaaggcgcaaaaggtgtgcttgaaaagacgccaccggaattgtctgcggatatcattgatcgtgggattatgctgacaggcggcggcgccttgcttaaaggtatttcacagctttttgctgcagagttgaaagtgccagtgttgttggcggacgatccattagatgcagttgcacttgggaccggtgttttactcgataatattgaacaccatcgccagtactaggagcgagctatggactcacaatatcctaaacgcatcttccacatcattaaaatttggctgatgatagccttaatcgcactgatattgggcttattgattggctttgctcttggggaaggtaatccgcttaagttgttcctaccatcaacatgggtgcacttctttaagtttctgcgttaggagtgtttcatgaaacaggttctgacatggttagtgcggggctaccagcgcttcatttccccgttgctgccgccgagctgccgatattatccgacatgctcaacctacatgattcaggcgttgcagaaacatggcgccatcaaaggttccttaatggggattgcccggattttacggtgcaacccctttgttaaaggcgggcttgatccagtgccagcttttttcactttgcggcgtaatccgtatcccgaaaatgacttggatcttagtgacattcaaaatctcaatcataagctaggaggccgtcatggctaaggaaagaaatatcaaggtcacacaggcagatgaaactcgaaatggtcatacagtttcggttttaaaaatcggtgaccgggagattggctttattgaaccggacggcacgcgattttcagcatttgtagccggctcgactaagcctaaccggttcaaaacactagatgccgcagttaatgcgttgattgccgaataccatttacatcaaggctgaaacaactctggcagcgcgcatcgcaacatccagtgctccgtgattttagaggtaaatcggtatttgaacggttttatcatcaacatttagctagtaaagaatatgcttttgcgaaaatcgaaggcattttaagaacgaaacgtgaaccaacgcgtttaggcaagagcgtgaactggcacgttcagaaaccgggacataggcgaccttgagacgacctgttgggtattgaccctttagtttcaaggctgttatgtgcacgtttctgcgtcagtgaacgtgtttaaaggagggcagcccgtggagtcacacgaaatcaaatcaaactcagagggtgatcggattgattatggcatcatcctgtcagtcatgttactggctttgatcgggcttgtgtccatctatctggccaccgctcatgatacttctacgctacagaatcctgttcgtgccacggttatgcaggcggcgtggtatgtgattggcggtatcggcattttcttcgttatgcgatttgatgcggagcagctttggcgcattgtcccgtatttatacgggattggcatttttctgatgattgcggtattgattttttatgaccgcaacacagaagccagtacaggtgcgaaaagctggtttgcccttggcccgatcagttttcagccgtcagaagtgatgaaacctgcctatattttgatgttgagtcgcgttgtgacccaacacaacgctgctttttcacataccattcaacacgattggcagttaattggccggatggttttgtggacattaccgatagcagtccttatgaaatttcaaaatgactttgggacgacacttgtttttctggcgattttcgctggtgtcaccttggttgccgggattaattggcgcattctcgtgccgattgcacttgtggctggcattatcgggacagttggcattctgttagtgacgcagacatggggtcgatctattcttggtagtatcggctttaaaacatatcaatttgcccgaattgattcgtggttaaacccttctggtagtacaactggcgacagttaccagctgtggcaatcgatgaaggctatcggttctggtcaattgactgggaaagggccaatgcacattgcagtgcctgtcccagtccgagaatcggatatgatcttttccgtgattggcgaggctttcggttttgtaggtgctgcggttttgattctgttatactttatgttgatctaccaaatgattagggtcacgtttgacacaaaaaatgagttttatgcttacatctcgactggtgtcatcatgatgatcctattccatgtatttgaaaacatcggcatgaacatcgggttactaccattgacggggattccgctaccatttatttcacaaggtggttcattcttgttggctaatatgttatcagtcgggatggtcttgtcgatgcgctaccatcatacgagctacatgttcagtcgcgacacagaagattttgaataggggagagcaaaatggcaacaacttatttttggcaagatgaactggctgccgggcaaattcgtctcggcttgacccaagaggctcaagaaacgttaggcaaaatcaagtatgttgatttgccaacaattggcacgagccttaccaccggcaaaccttttttaagtgttgaagccgaaaaagccgtgttagatcttgaggcaccgttagcaggaacaattgtggacgtgcatcaggaattgagtgataaaccagctttgttagacgaaaccgatcataaccaaaactgggttgtgacagtttcaaccaaatagctaatcaaaaagccgacccgcatttttaaaatgacggtcggctttttgcatggcacattgtgatttagcgcgacttattcgaagaagcgcttggcaatttcttgataaattttgatcgccgttgtgtaactgttcaggtcgatgtgttcattcacttgatgactgaagtggttatcaccggggccatagacaatcacatcaaaatggttagttgatttgatgaactcggaagcatcggttcctccaaacgcaacggctaattcagctggtttaccagttaccgactcgatggcagcatttgccgaagttaccaagtggcctgttttatcggagtgaaccggcagaaaacggtgcaatactttcaacgtgagtttcgcattggtcgtggcgttgacatgtgccactaagtcttcaagcattttcacaaccagttcaatattggccgatggggtcgggcgaagattgccacgaaggaaagcgtgggctggaatggtgttgacttggtcgccaccattgatgaccgtgattgaatgtcgaaatgggccgagatccgggtcagcaggcgccttatcaaaggcgtgatgttccagtgcggcaaaagtcgttagaccatcgatggcattgacgcctttttcaggcctagaactatggacagagacgccttcactgtcaatctcgtaattcacggtgccagcatgtgcgtattttaagattttagtggtgggttcaccaacaactaagccagcgagatcatcggcatagccttgctctgtcagcaaacgtgcgcccatcgcaccgtattcttcgcctaccgttgcaatcaagcgaatcggatgagtgaacccggattgtttgagggcgatcagggccagcaccatggcggccaaaccgcttttcatatcatcggtgccacgaccatacatgacattgttaacgattttgccggaaaaaggtggatagtccaggctgactcgtctccaggactcacaacgtcttcgtggccagtgaaaccgagaacgcgatcaccatggtttaattcggcaattaaattcacgcggtcttctgtgtaggggatcagcttggtaggaatatcggcagcctcaagttcggcttgcagcaatttggcgacggcgagctcgttgccatttacagaattgatttgaatcagcttttggagcagggcaattggttctgtcatgattgcaccatcctttgtcgcgacagtcagctgttgcagactttgtgcgcgagttttgttgagcacagcttacactctttttgatttaaaattcaatgattgacaagttaaaaaattgtgataaacttacttgtacaaacttgaaattgattgtaaacggactgagtgagtagttaccgcgaggcagtacagaaaacctgatgagctgagagcagggtcgctagcggaaatgaagatggcttggcacacacggcacaccgagcaaattgcgaggctgtgatggttggcacccattatcctgcacccggatgaattcgtccgctgagtggatcacgttttgtgtggtcaattagaatggtaccgtgggccagagctcacttctaacaaagattgataatttgttagaggtgagttttttttcggtcttttttatatcaatggcaagtttatgcgtctcggactgcaggccgacgcacatattttggagagcgcgagtcagcccggtaagaaacggaagcataaataggcggggacgtgatagccgtattttggccactaggaaacttatgtgtagattgatgggttggcgaacgtatttaggaggagaagacatgaaacggttttggaaaattttgacaaccatttttgttttaggattagtcttggttgggtgcggtaaaagtagcagcaattcgtccagtagtcaaaagcaaacgacggtgaagatcggggtcgttggcgcggataatcgcgtcttgcaagcagttgctaaaaaggttaaaaaagagggcattacgatcaagatcgtacagttctcggattacaatcagcctaacaccgccttgcgcgatcatgatattgatttgaacctgtttcaacatcagtatttcctgaataactggaacaaaacccacaaggctgatctagtcagcatcgggcagaccatcattgcaccactagcgatctattccaaaaaaatcactaaaattagccagatcaagaaaggtgacaccatcgcacttcctaacgatccgactaacgaaggccgcgcattacagttacttgaaactgctggtttaatcaaactgaacaaaaagattgccttgccaaccacgcgagacgtgaccgaaaacaaattggaacttcaactgaaggccgttgatgctgcccagacagcaagttccttaccagacgtggccgcttccgtcgtcaactctggcgttgcacacgatgccaaactggatcccaagaaggctgtttatactgaaaaagtcgacaagcaaagccaaccatggattaacgttttcgttgcaaacaagaaagataaaaataatgctacttacaagaagatcgtcaaagcataccgaacaaaagacatcgctgacttgattgagaaactttatcatggcagtgaagtcccagcttggacgcagaaattttaatggtgagttgagagaattggtatataaataagcaatgttgagggtaatccgagttgaattctaggatagaacgcagagagttggcgaagcggagaggggggtcagccgtgaaattgttgttgacggtttaccgcttacaacaaggccaggatttgaaatcgcgcgggctttgcgtgagttcaaagctgtgcccacagctctagcttcgcggtcgccagccttcctcgccgcggagccagctcggactatgggagatgctttactggaataaaactgaagaaaaagtatcagtcgcattgcgaaaacgcgttcgcagccgcagaaacctgcacataaggacctcaagccaaatggccaaggctcagccatttaggcttgaggccacttatgctccggtttctgaacgcggctgttcacgctctgatttaaacgcgttcaccagcccagaaacctgcgtataaggaccacaagtgcaatggccaaagccccagccatcacacttgtggccacttatactccggtttctaaccgggctggttcacgctctgagtactttatcttgacattttacctaatcatcgtctaaaatcgatttaattcatttcgggaaacgaatgacgtgagtgagtagatctaataagactgtacagaaaacctgggtagctgagagcagggtagttaattggatcgaagatggctcattgatcggcatcgctgagcagtggttaagcgatgatggctggcggcctttaatccgcacacaggtgattgcctgttattgaggacgcgatggcgtcgaattagaatggtaccgcgagctaggctcgcttctaaaacttgtttttagaggcgagcctttttgaatgctttcatcgcttgcacacatcatttgtttacctgaacgaggaggagaaagttcatgaaattttggaaaaaggcaattttgacgtttgcactgattttaccagtatttgttttagcagcttgtggcaagtcggctagttcaacgaagaataccacggttaaagttggcatcatgagcacggataaagaaatttggactgatattcaatcacgtttgaagaagcagggtgtgacgatcaaacttgttcagttcactgactataatcagcctaaccaagcactggaagatggcgatattcaactcaacgccttccagcatcacaatttcttggataactggaacaagaaacacaacaccaagattgttgatatcggcgcaacctacatcggcccgatgcgcgcgtactccaacaagatcaagtcgttgaaggacgttaagaacggcgatcagatctcggtaccaaacgatccttccaacgaaggccgtgctttacagttgttggcacaaaatggtttgctgacgttgaaaaagggtgtagcttcaccgactattcgcgatatcactgaaaataagctgaatctgaagtttactgaattggatgccgctcaaacagcccgttctttgaatgatgtcgcagttgctgttgtcaacaatgatattgctgctgccgctaatctgaagccagctaacgcaatcgcagttgaaaagattactaaggcgtccaagccttgggtgaacttcattgctgccaagtcagccaaggacaaggacaatgcgacctataagaagatcgtgaaagcctatcagacacagcggacagctgatcttttgaagaaagtttacaaaggttcaaccttgccggcttggaactataagttttagttagaaacggggacaatcatgtcagatcaagcagttgtgactttaaaagatgtggacgttgagttccacggcaaaacccgctcggtgcatgccgttgatcatgtggacttaacggtcaatcgcggtgatatttacggcattgtcggatactctggtgccggcaaatccacacttgttcgcaccatcaacttgctgcagcgcccaactggcggcagcgtcaacgtcctaggccaggatatgttggccttgtcgccggcgcagctgcgcaaggaacgcaaacgtatcggcatgatttttcagcattttaatctgatgaacagtcgaactattgctgacaatgttgcttttccattaaaaggaatcaaatcgaagcaagcgatccaaaagaaagttgcggagttgctcgatctggttggactcactgaccgcgctaattcctatcctgcgcaattatcaggtggacaaaagcaacgcgtcgggattgcccgcgcgctggcgtcagatcctgaaattctcatttcggatgaagcaacgagtgcacttgatccaaagacgaccagttctattctggagttgctccagtcgctgaatcaacgactgggactgaccattgtactgattacccaccagatggaagctgtgaagcagatctgtaatcgtgtggcggtcatggatgatggggcaatcattgaacgcggtgacttgttgcaggtcttttccaatccgcagcaacagttaaccaaagacttcattgatactactttgcaactggatcaggcgattgatgctgtcatgcagcagccgaccgtgaaaaatctggggccgaatgatcgtcttttacgattaacctacgtcggtgattcagccgatcaaccgctggtggctaagctgtttagtagctatcatgtcacggcgaacattctgtttggtgacattcagattttacaggatacgccgtttggcaacttaattgtggttctttccggtgaccatgatgaagttgaagccggaatcgcgtatttgaaacagcaggatgtcaagattgaagacattctcaagaaggaggtttagacagatgggacagttctttacaaaatattttcctaacgtggtccctatctggtcaggtgacggcggggtgacccaggcaatcaacgaaacgttgtatatgaccgtgttgacagcagttgttgccggcattctcgggattgtcattgggattctgctggttctaaccgatgaagatggtttattagcaaaccaaccgttttattttatcctcgataaattggttaacatttttcgggcggtgccattcatcatcttgctggcaatcatgacccctgtgacgcgagccattgtcgggacggggatcggaccaactgcagccttggttcctttaattgcagggaccacaccgttttatgcacggcaggttcaaaatgccttattgacagttgatcctggcgtcatcgaggcagctgaagcaatgggtgtttcgccgctcggcattgtgttgcgggtttacctgcgcgaaggtttgtcagaactcatccgagtttcagtcctgacgatcatctctgtcatcggcttaaccgctatggcaggtgcagttgggggcggcggccttgggaatctggcgatcgcggtcggttaccaacgttaccaatacgacgtcatcatcgtttccttaatctttattctggcgatcgttttcttggtacaatttatcggtgacttcttcgcacgaaaaacacatcattaaatataaaactcgttttgtaagcagaactcatgatagcgttctgcttttttttgaacgcgtttgccgctgttctttttatgacgtagaatggcgatataactaaaagtcaaattccagtcgggggtatcattgtgcacacacttgagattaaggatttacatgtcaaaattaaagcagaacctgagcatccggagattttgaccggcgttaatttaaagttagcgactggtgagattcatgccattatgggtccgaacgggacaggaaaatcaacattagccgagacgatcatgggcaatcctgcttatgaagtgactcaaggcgatgtcttaattgatggtcagtctattttagacatggcagttgatgaacgcgcgcgagccgggctttttctagggatgcagtacccgcaagaaattgctggtgttaccaatgccgagtttattcgggcggcgatcaatgcacgccggccagaagatgatcagattcgcatcaccgactttttaaagcaattggacgacacaatggcgaccctcgaaatgccggaatccatggcggatcgttatttgaaccaaggcttttccggtggtgaaaagaaacgcaatgaaattctacagttgatgatgattcacccgcactttgatttgttggatgaaattgattccggcttggatattgatgcactgcggattgttgccaaaggggtcaacttattgcgtggaccagattttggcagcatgattattacgcattatcaacggctattggattacatcattcccgatgttgtgcatgtgatgaaaggtggccgaattattgaaagtggcggcccagaacttgctaaagaattggagaagactggctacgaacaccttaaagtaggtgatcaaaatggctgaagcagtgactttaccggcacctaacttgcccaagtttcctttagctcggtatttaaaacttcagcctgatgccgtccgagatcgtgtgattctacacgcaccgcaatcggttgcctatgcagcaggctccagtgaggttcaacggttcaccccagtcacgtcattggatgcttggttacttgcacacccccaaggcgcgaccacgattgatattccggcccattttgtaagcggtgatgagccgattgtcttgactggtcctaagcaagcgggtggactgctttatgttcatgtcggcaaaggcgctaaagttacgattcaggaaaaatgggcgagcggcggcaatgttttaggcgtttggcttgtgttggttattgatgccgatgccgaagtcagctggctgagttatgacagttttacagctgagaccgtgattgcaaaccgtaccgccacgcttggtgccaatgctaaattgaattggaccttggcagggttttcgcgaaactccggcctcaaccgggtggatgtccgcttattgggccaaaacgccgaggcaaccgtcaacgtgggtgtgcttgcggcaggaagtcaacatgtcagttacacaacctcggtaaccaatgaagcacaacacacagtagggcatattaaccaacgtggcgtcattactggcagtgcccatttattattcaatgggattggtcacatcatcaaaggtgcacgtggcagtgatgcccaacaagaaaatcgagtcttgatgttgtcgccacatgcggaaggtgatgccaatccgattctgttaattgacgaaaatgacgtcaccgcaggacatgcggcttcagtgacgcgtgtgaatgctgatcagctatactatctcatgagccgtggtttatctgcgacattagcgaaacggttggtcattcgcggtttccttgaaggcggcttggctgaaattgatgatgtccgactgaagaaagaactcttcgcaacgattgatcgaacgctggtggctgaagatgcgtgaacaatttccattttttaaagctcatcccgagctggtctatctagatacggcggcgacttctcagaaaccgcaagctttactagatgctattcaaaattactatgtcaatgataatgccaatgttcatcgtggcttgtataaattggcttatgacaccaccgaggcttatgaaaacgtacgccaacaagtggccggctttttaggtgcggcgagtgctgacgagattatttttactcgcgggaccactgatagcttgaacttggttgttagtgcttatgggccgcaagtcgtcgcggctgggtcacaaattgttgtgacgggtgcagagcatcacagtaatttcattccttggcagcaattagccaagcgccagcaggctacgttcacagtgacgccggtaaagccggatggcacggtggatattgctgccttattagcggccatcacgcctcagacgaaggtggttgcggtggcgcaagtgacgaatgttgcaggtgatacgttaccgattgccaaaattgcggccaaagcccatgcagttggggctgttgtcgttgttgatggcgcgcaggcggtagcccatctgtcagttgatgttcaagctatgggggcggatttctatgcattttctgggcataaaatttatggcccaactggcattggcgccctctatggccgcgctgatttattgcagcacatgccgccgattcagtttggcggtgaaatgatttcagaagtccgcgatgatgtcagtacttgggcagacggcccaattaagtatgaggctggcacgccgcacattgctggcgtgatcggattaggcgctgctttaacgtggtttgatcagtctgtgaatgcagcagcatttgacaacgaacatcaattggcagatcagttatgcgctggcttggcagcgattccagatgtgaccgtgtatggtaatcaagcaagtttggcgactgtgtcgtttaacttaactgggattcacccgcatgatcttgcgactttcttagatgagcagcaaattgcggttcgtgcggggcatcattgtgcacaaccgctgatggcgcgactaggggtgccagctacggttcgtgctagtttcggcgtttacaacaatgctgacgatgttgaacgattgattcaggcagttcaggcggcaaggaggtatttccatggcattgactaagctggaccagatgtatcgggcggtcattttggatgaagcacaacacccgcgacatcacggggttttgccagcttttgaccatgaaattacggttcgcaatccaagttgcggtgatgtcttgcatcttcaaatcaaagaggatgccggccgggtaacagacgtggccttctctggcagtggctgtacgatttctcaagcaagtgctagcctgatgacggaacagatcattggcaaaacgccagcagacattgaaccaatggtcgaaacgttttctgatttgatcattaacggggatgtgccaaacgctgatattttaggcgatgcagcggttttaaaaggcgtccaccaatttcctgcacggatcaaatgtgccactttggcatggaaagcagcggcgcaagttttgacgcagaaaggtgaagaccatgactgagacaaaaaacactaaaaacaatgaaactgtcgcggcagatatcgactttttgccagaagacaatccagcagattttaaggatgatatcaagccggtgtattctacaggtcggggcttaaccgaggaaacggttcgcgctatttctgcggagaagcatgagcctgactggatgctcgattatcggctgcgtgcttatgcaacgtacaaaaggctggcaatgccgaattttggcccggatctttccgatcttgacttggacaacatgctttattttcaaaaggcgacggatcgaacctatcgcgactgggatgacgtgcctgacgccattaaaaatacgtttgatcggttaggcgttccgcaggctgaacgaaaatatttggccggcgccagcgcccaatacgagtctgaagtggtttaccataacatgcgggatgaattcgaaaaactcggcattattttcatggacatggactcagctttgaaagagtatccggaactcgtgcatgattattttggcaagctggttaaacctagcgacaataaatttgctgctttgaacggtgctgtgtggtctggcggtagttttatctatgtgcctaaaggcgtgcagacagatgtgccaattcaaagttacttccgaattaatgccgagaacaccggtcaattcgagcggacgctgatcatcgttgagcctggcgcgcatgttaactacgtggaaggatgtacggctcccaactattccagcgacagtttgcacgcggcggttgttgaagttttcgtcaaaaatgacgcttactgccgctatacgacgattcagaactggagcaagaatgtcttctcacttgaaaccaaacgcgcacaggcactcgacaacgccactatggagtgggttgatggcaaccttggcagtaaaactacgatgaagtatcctagcgtgtatcttgacggtaaaggcgcgcacggtacgatgttaagtatcgcggtcgcaggtgaaggcgttgatcaggataatggcgcacgaatgattcataatgcgccgaataccagcagttcgattgtctccaagtcgattgccaaagatggcggcgcggttgattatcgcggcacagttcgcttcactaaaaaggcagacaatgccttttgccacgtagaatgtgacacgatcttgatggatgaaaaaagttcaagtgatacaattccttataatgaaatccataatgccacagtgtcaatggaacatgaagcgaaggtatcaaaggtttccgaagaacagttgtactacttgatgagccgcggtatttctgaagccaaggccactgaaatgattatcatgggctttgttgagccatttactaaagaactgccgatggaatatgcggttgaattgaatcgtctgattggtatggaaatggatgggtctgtaggctgaaatcgagttcttattttaatgtcgatttttgaagaaaagctggctaaattgtcatctgcaatctggaggttgcggatagacgtttagacagctttttttattcgacataaaaatattaggcaagcctaactttttgctttatgatagaagcggcaacaaaaccacactaatttaggaggccgcaaatggataactatgataaagcaagaaaggttttgcaatcaacggcattgtcaaaaatagctcagcagaccggcatcagtatcgggcagatttggcattatcgtgatcgtcacgaaggcattgaaaaggcaccagaggcctatgtaaagaagattgccagtttgtatcgaaataagcggtattgaaatcgctagaataaggggcttgttaatttggccaaattgcaagaggcgtcaagataaaagctatgaacccacaaaacaagtcgtgagcctgatagcgatcacacgtcatgggtgctacaattaaattactgatttgcaaactgaatctcaattttttgcatgctattgcgtgtgccatgatcgcgaggaggtgtaccatggctgaggatcttgaacattttatcaagacaatggcgctggggattccaacgattaaaccagacgaaaagcgagcttttctcggtaattttcgtgagcgagttgcgatggccattacgattaagcagttacgcgatgcacgaatcaccaccatgcttgatgcggtgttgactcgttatcctggttatcgaatttttcttaatggccgaatgggcgaaagtctggtcaatcaatacatgatgcaggccctagctcacaactatcctttcaccattatgaatcaaccggggatgcgcgtgactaagcgcgttttgcaaaccgattttggctgggtattggcacacccgactcagaaaatagcccgacccatccttttataagctggcgacgcacgccgtttgccagttgaacattgcaaaaagtgcggttagtttctgacgacaatcacgtatttacaggaggtccattttgacgcaacttgatacaattcagcgaacggtacaacaactccgcgatttgctgaataaaggcgaaatttttacagcattaccgaatatgttgggcaaagtgattgagagcgtggcagttgaacctgctaccccgattaaaatacctagagacgacaagacggccattgtcaaaatcagagctatccagaagcggatcaagcaaacaagtgatcccagcgtgactgatgatgagattgactttttggtagcacatttggcaagtaccaaccctgcagttcgggataaaggcgttttcttcctgttcaatgatttgtttcaggcggaagccttcaccaatgagcaaattaaaacgcttttcaagcggctgcaagcaccggatattttgttcaatcatatttttgaaccgcaaaacaatggtatctttttgcgcagtttttcgctgatgattctaagcggcatgatctatgctgatcagaatcgttaccacgtgttgactaaagccgattatttggcgactgttcagaatatcgccgtttatattctgttagaaaaagatggccgtggttatgttgagaagaagggctgggcacatgcctatacacatattggcaacatgctggaagaattgagtcaagttggggtcttaccgcgagctgagaaagttttgctcatggccgcagttgtggaagtttggcggcgcgttgaaacaccgcttgtttttggggaagatcatcgcatggctttgtatctgagcagcctgaccaacgtcaataagttttacagtgaaactttattgatgtgtctcaagaattggcagcacgccttggtgaatgttcgtccgcaagaatcctacagtttttgggttcggtggtacaaccgcaatcgattgttgcaagcattggccctgcgagctgatttgccacagccaattgccgattatattcagcaaattgtggatcttttttagttcagatggtcaatagaagggagcacggctttgattaaggctattatttttgatatggatggcgtgattgtcgactcagagccgtgtgccttagaaaatcgactggcctatttacgtcaggtggggattgaagccgatgatcgcaagttggctgggttattagggcgcaatatggccgatgtttggcgcatcattgcgccttcgaaagatgctctgcaacttcaagcaggttatgtggcctacaaacaggcccatccgattccgtatgcaaagattgtaatgccgggtgcaggccaactttacaatggttgaagcagcatgatatcaaaactgccattgcatcagcctcagatctgacctttatcgaaaagatgtgtacagagacaggcttgcgtcagtattttgatcaattgcttagcggcgccgacttcacacgcactaaaccggcacctgatgtctacttggcagcgctgcaggtgctggacgtggctgctgaggaagcgatcgcggtggaagattcaacgcttggtattgccgccgcaaaagctgctggtctatataccttagcagtcccgctacgtgatccccggttcactcaaaatcagcaagcagcagatcaacggattaagaaactaaccgatattatgggaatagttgatgataaaaatgcttataatcaataagcgtttttattctgcatttatattataaaatttatatctcgtggcttttagatacaaaagatcaaaatctaaaaagatattttttaaaaattgaataaatatcagttgttattattagcttttaaaaccacttatccgtataatcgactctaggttaagggttaagccttgccaaaattctatgttgatgcacttaactgaaacactggggagtgataagtatgcgaaaggagcagcaaacactgcggatcttgggggataaggtccgttattatcgcaagttgaagggtctatcgcaggccgagctggcggcaaatatttgcacgcaagctacaattagcttgattgagaagcgtaataaagtgccaagcatgaatattttgatgcgattaattggtcgtttaggaattcagctggatgacattgttgtcgagcatcatgatcgggttcagcaactgttgaccggtattgattttcagattcagcaccaccaatatgcacttgctgcggagaatttgagtaagattcggttggataagatcaagaatgatgatgaccaaaagcgctactattattatcaaggaattatcgaactattcaaaaacaatgcaccggatgaggcgatttatttctttggccgagtcctgagcccgttagttaactccgaacgtgacctttttggtattctagcaacgctggggttaggattggcctatgctgccaagcatacgtttgaccgatctcgagtttatattgatcaagcgttacgcatgttgaaacatgtgccactgtctgacagtaaatatctggatgttgagttgacaatttattggcacattgcccgaatttattatgaactcagtgactttaaggccgtcctcaaatacactgatctgggtgttcgagaggcagtcaagcacgataaacttttccttctagatgaattgtttgcattacaagcaagggcgctcaagcttttgggtgaccccgatgcctctaaaagttatcaaattgcgatcgcatttgcccgagtgacaggctcaacgcctttggaaacgagcttagtcgcagaaatggtctcgcaaaaaccaaatattgagacagcttgaaaaatcctcatagatgctgccgtctatgacgaaaaaaatacctgaaaacatcggctgatttaagagccagatgtctcaggtatttttttattttttaagcaggttttaatgacctatctaacttgaatattaaaattataatgattatttatcactgttgtcagttggctttttagtgcttgccagtgccggtttgttggccaaatcggtccggacaaccaagacatcgcaaagtgcgtttcgtgtcacatattcagtgacggacccaatcagtaagcgttcaacagcgttcaaaccggtggcgccgatcataataaggtcgatattcttagcctttgggatatcacgggcgatgatcgtcttcggagcgccatactcaatactgaaactgaccttgtccaatcctgccttcttggcttgatccacatagccttccatggtactcttcgcgttttctgtgacttgttcaaccatcgctgagtcaaaactggaaacgttctggaacgcgcgggtgtcgacaatatgaatgagaatcaattctgcgtcattccgttttgcaacggcaaccgctttcttgaatgccaactcagcttcgtatgagccatcaatcgcaaccaaaatatgttgatattgttgtaacattcctcatcacctctaccttcattgtacttgatttaatcatggaattaaatgaaaagcgtttcacaacttcatttgggtcagactaattagcacgaaaatcatggctaagaaggcaccaacgaccaaaatcacgagatttgcccagagcggaaagaaaaaaccaccaatgatagcagcaatgccaacaaggacaaacaggcaagcaaatagtttaagaaaacgggttaaacccggcgttggtttcttaataatcaaaaagttttgttcacgatgcgaccatgtataggctgctaaggcaaacgttactatggcgtaaatgcccattaacaagagagtcacgagagtcctcctatctgttttctttattatgccatagctggcagggaatggcggggggatttttctgaaaattgagtgacttttagacgctcgtgttcccacttaacattaacggattcggtctacctgggccttgaacgcgctggccaaagagcagccatcacgcctagggccacttatatgccaacttctaaacgctctggctcacgcttgaggctgcttttgcggaaggctataactgacgctgggttagctttctataacgcgttcgccagcccagaaacctgcacataaggacctcagccataaatggcaaaacccagccatttatggctgaggccacttacattccgactcctaggcgctcctgctcacgcttccacaaaaaaagccggcactgggccggccaaaaacaggtttggtttttgtgaaaggctaattggtgccgttttcttcccggatcgttgaaacccgctactagctatgtgggcccagacgccagagacattagccgctaagtgaaatagcagcaccgtccaagactcttccggtcccaaggtctcgatactgttcggtcaactgatagttaaggaagcgcgaacaccttagaactttcatagttatagtagcacgggaaggcaagtagttgcaagcgtaaacgcttacgttacctttttttagacttttgcgcatcacgttgccagtctttaagttgttgtagtcgctgagccagtgccgcttcgtatctgccggtggctttaggctgatagtagtgtttatttttaaggttgtcaggcagatattgctgtgcaacccagccgttgggatagttatgcggcagtttgtagtcgataccatggcctagttgtttggcaccgcgataatgggcatcgcgtaaatcatctgggatttggccggcattgccgttttcaacatcggcgagagcttcgtcaatagccttgataccggagttgcttttaggtgcgaggcaaagatcaatgacagcatcagccagtggaatgcgaccttccggcaatccgagacgttcagcactttgaatggcggtcaaggtgcgactggcagttgctggattggcaaggccaatgtcttcataggcaatgaccagcagtcggcgggtgatgctgttgaggtcaccaatggcgattagccgagcgaggtaatgtaaagctgcatcagcatcggagccgcggatggatttttgaaaggccgaaataatgtcgtaatgcgcatcgccgtttgtgtcgccagccaaagcgggcttttgcagactttgctgaatggtagttagatcaattgtgatcgtgccgtcatcgcttgctggggttgataataccgctaattcaagcccgttcaacgctgatcgtaaatcgccattggttgcatgggtgagataatcaagtgcgtcaggctgtaagtcaacctgatagtcaccaagtccgcgtttgtgatcggctaaagcccgtttgatggcgcttgtaatatcatctggcgtcagtggcttaacctgaaagatttgagttcggctgcgaatggctggctgaatgttcatataagggttttcggtggttgccccaattaaaacgatgcggccactttccaacaatggcagtaaaaagtcttgcttggttttatccagccgatgaatttcgtctagcagcaagatgacggtcccgctcattttggcctcttcagccacgatttgaagatcctttttagtgtcggtagcggcatttaaaatacggaaggcatacttggtgctgccagcaatggcactggcaatactggttttaccggtaccgggcgggccatagaggatcatcgagcttaatcgatgagcgctgaccatgcgacgaatgatgcgatctgggccaacaaggtcttgttgaccgacaacttcatctaaattttgtggacgcatgcggtaggcaagcggttgttgcaaggcgaaccctccttgtgtgtggcagtttaaaaatagacattaactataggaagtacttttaagatgattgacttagtttagcatagcgatgtgacttgaaaataggcggttgttgttgcacggggatgcttacgctccggtttctgatcgcgccagctcgcgctcttgttgtctgcgtgttaatctaattctagatcatcaaataaaggaatgacacatgttgaatcattattggcaactgatccagaaaaataacttgtttggcttacgggacgacactcggattggggtgattcggacggtgaagccggtgttggcggaaggcgagcagctgccagtgtgggcgaatgcgagtcggcatgcgttggtgcagcaggtgtcggctacaatgttacagttgacgacaccgcttttagacgatcccagcgaagttgtggcgtatttgcgtgcgggactcagccgcgtctgggcagcgctgccagaaaacggcaagctgccggttttcaccaccggattggaaaataatcagcgcattcgcattgttttgccggaagtgttgtttgagcggctttatacggcggaaaattttcaagggaatggccctgattatgtaacgtaccggaatcaaatttatgatttggtcgctgatgggttgatcacacaattgccgttactgacttatctctttgccgcttcaccggccaaaaacggccgggcattttggcctgcgccggatcaggaacggcaactggttcaaaaggtcagtgaccctgatcacttagcgcgaacattggctttggatgttgcagtggaacttgatccttatgcggcgagcggtgttacggaacaaatgttgaactttttaatcgacagttgctggtttgctttgagtcaaccagcgattccattgcccgcggcggctgaggtgcgccggcatagtttggcagaagcacagaagattgctgctggcgatcccacggcaccggtcgcgagtttgacagcaccgattgatgccatggcggtctggctgaatcaggtcggcctcacaccgcaacgcaaacaagcttttgagttgatgcaaagccgagtcctgaagccagaaacgacgattgcgggtcaggtggcggcggcttatcatgatatttcagcagctcaaacaccgttagcaacgcaagcccacgcagatttgtcaatggaagaagatttgccgggcttcagtaacttgtcaggcaacagtcaagccttgcttcaggcagtgattgatggcgggtatcagtggaccttgctggatcgggaacagaacattctgcagattgccagtgatactcagcgccatgtgttgattgacggtgcgttgactagtcgcacacctgctagtgccatggtggtagcagaacatcgccatgccgccaaaaaggtgttagcggcggctgggttacctgttgccagaggggccaagttcacacgttggcctgaagctaaagctgcttttgagcaaagctttgcccgtaaaagtatcgtcgtgaaacctgaacagcgtagtcatgggcttgctgttgagcaatttgcggtgccgccgactgccaaacaattcgcccaagcctttcacgctgctaaccaagatcacggcgtattggtcgagatgatggggcggggaacaacgtatcattttactgttataggtcgccgtgtggtaagtgtgttggaaaatgccgctgccaatgtggttggcgatggtcgtaaatcaatcaaagaattgattgcgttgaaaaatggtaagcggccgaatgcacggcagctcaaacttgacgaaacagcaaatcggcagttgaagttacaatcggttacgatgaatactgtcttgcggcgcggtcagcagattttccttgcttctgcggcgcacccgcaaacaggtggcgatatttatgatgttacaaccgaaatcgatccaagctacaaccaacttgcggttgccgctgctgatgcgcttgaattgccgattgccgccgttgatatcgtgattgataatctttatgacgcctatgctgctgagcatgaaggccaagctatcatcatcagtgtcgatccgattcccgacttaacgttgccacaacaaccagatatgggcgcggcgcattcaattgcacctgctttactcacgtatctgtttagcgaaaaataaaacatctgccgtcatgttcggcagatgttggttataactttttaaaaaaatcaaagccacgttttttcggcttttcaggatcttgctcaagtggtggcagatcaacattcgattgattaatcgccgtgtcggcaacaatcagcaatccagcggccttgtcggctgtttgcgcggtttcattagccaccagcgtgaatggcacattcgcatccgtgagcattttcatataggggcctgtgatggcattatcgagtttcccgtttagcaacgctttataaccatgagcgtgaaagtctttgagtaaaggctgcacttgcgcttgtcgtttggggtcggccaatgcttgattggtgacctgtagagcaacacgttctcgcaaagagcccatataggctcgacgttcatcgggtttggtctgcgggggaccgtaaatcgcactgttcagatgttcctgcatattatcgtctgacattaatggtgcctccttttaaacgcattcatatgccctcattgtaacatgttcttatcttggaaaagaggttgtggttctgtttacacttgaagatttcgccgtttttaaggcgacaacgctggcgacacgaatgcatttgattcgcgaacaattggatcccaagtttgctgaggccgccacggtgattgtgccgctgctgcaaacagatcagcaggcgatctattcgcacattgcgaagcatcaacgtcgctatcgcaatccgccgccgaatacatgggtcgcgttttcaaccagttcacgcggttacaaaatggtgccgcatctggcgctgggcttttgggatgatcggctcttcttgtggctgtcagttttacgtgaaagtaagccggcgccgcgggtattgacggggatcaccgcgatggcaacaaccttaccgggaaaatggcaagtggcaggggagcatacagataaggcgatgttaccactgacttcagccaatttagcgacagttggggctcgatttcagacgattaaaaaggcggagttccttctaggaaaagtttatttggcagatgatccgatttgggcagatcccgtgcggctttggcaggacatacaacagcgggttgtcgcccttaaaccaatgtttgatcagttggttcaaaacgtctaatgtcggggtgatcgcctgcaaatggatcattttgaatgctttgtatgagaatgccgcgagaattcagcgaaacctgtccgccgccatgtttagggtggtagaatcacactgtggtgttgctcgcctgcgcgtgttggtaaagttttggcgaacgcctattttgcctagttaaccacttggattagctagcaaactgcatcatgttaaaggagaaaagccatgccagatgttcgatttcatagtgtgtttgatattatcggtccagtgatggtcggcccaagtagttcccatacagcaggtgccgcccgaattggaaaagtggttcgcgatatttttggtgaagcaccagaaacgatcacgatttacttgtatgaatcgtttgccaagacttaccgcggccacgggacagatgtggctttggtcgcaggattattaggcatggcgccggatgatccgcatctacctgaatcaatgaagcttgcctatgatcaaggcattaaggttagctttgtaccgaaaagcgacaaagttgatcatccaaacacagcgcatatcgtgctgcaaaaaggcgaccactggctagccgtgactggggtatcgattggcggcggtaatattcagattactgaaatcaatggctttaagatttctctgagtatggggcagccaacttatattacaattcatgaagacgttcccgggatgatcgcgcaggtgacgaaaatcttttccgatgctggt

SEQ ID NO: 47 - DNA, 2652849 bp, Lactobacillus casei (residues 1,326,426-2,652,849 of 2,652,849)
attaacatcggtaccatgactgtgactcgcgaatcaaaaggcgagcaggcgatcatgattattgaaacagacgactatcaagatgatattttggctaagttgaaacaattgccgcatatggtgaatgtcacttacttcgaatgacagtcgtttttaattgctgtccctgatgttttgataaaggagtcgcctatgttttataccgtcaaagaattgattgaacaaagtcacgcatttccatctgttgctgcgttaatggtgcataccgaggttgaaaactcgacacggacggaggcacaagttcggcatcttatgagccgcaatctggaagtgatggaacgatccgtcaaagagggcatcgctggcgtcaaaagtgttaccggtttgactggcggcgaggcgaagaaattagacgcttatgtcaccagtggtcagttcatgagcggcaagccgatcatggaggctgttcgcaatgcggttgctgttaacgaggttaatgccaaaatgggcttgatttgtgccacacccactgcaggatcagctggcgttttagctggtgttctgcttgctatgcgtgatcggttgcatctaaatcatgatcaacagttggattttctttttaccgctggtgcgtttggcctagtgattgccaataatgcgggaattgcaggtgcagaaggcggctgtcaagaggaagtcggttctgcgagtgcaatggcggcagctgcgttggtaacagctaatggcggtacggtagagcaagcagcgactgcagttgccattaccttacagaacatgcttgggttagtctgtgatccagtcgctgggttagttgaggtgccgtgtgtaaaacgcaacgcgctgggcgccagtcaggcgatgatttctgctgacatggcgttggctggttgcatcagtgttattccggctgatgaagtgattgaggctgtgaatcgtgtcgggatgcaattaccagcgaccttacgggaaacaggcgaaggcggcttagcaacgacaccaaccggattgcgtttgaaagaggaaattttcggtaaataatcattgtcagtcttggctatttcagggcgtgatatttgtggagatgccccaagctgggtgttagcgtcagttgcagtttaaacggaaacacaggaggagctcgtgattcatttctatattgttcgtcatggggaaacagccggtaatgtcagccagttaattcaaggtatcaccaattcgcaactcaatgcgcgtggccgtaaacaggcattggcttcgggccgcgggttgcgggcaagcggtttgatgatcgaccgagtcgttgccagtgatctgcttcgagcacaggaaactgcgcaacaaattttactgggcatgcaggtaaagctggcaattgaaaccgacaaaggactgcgtgaagaaaatgatggcgtttttgaaggacgatcgttaaaagatgtttcacaggaggtttttggtgttccggattatcacattcttgtgcgcagcggtaaaatgccgctggaagcgattcctgatgggatacacgcagctgatgcaactaatcaagctgagaatacgcaacaagtggtttctcggtatgattttgccatgcgccgaattgtgacagccgcagaagctgcgaatgagaccaatgtgttggtcgtcagccatggcacggccagtctcctgtggttacgagcgcatggtggcgatttgccaaatcggaccgaactcacgaatgccagtgttagcaaggttacctatgacaacgggcgatttaaagttgactggatggacaacactgagattcgtgatcagggattaaaagaagaattatcgtaaaaatattgggaaagcatctgtaggcaagacggctatggatgcttttttaggtgcacagttgtctatatgttaggtggctcggttaagttcatcagagtaaaaagattgtgcgctatcgaaattcaccattcgcgcgtatacttgtccttaagatatgggccatcacagtttttgtgaccgtgataacttagtaaaaatagacaagcttattcatcgtcgttaagttgataagcacattcaaaaggagctggtgacatggagcaagacgtatttttagctaaggtgactaacttgatgcttgcaccgggaacgcgtgcatttgagcgcgaacaattgcgccaggccaaacatttggtagaggccgggcgaccagtggcggaaggctgggcgcaacttgaatcatctttgcggccattggcgatgcgtgataacctgaccccagatgtggctgacttttatcgagcagagaccggtgatccagcaggggctgtgcagacagatttgagtgcccattttgatcgcgacatgccgtttcaggagcgggccatttttgctggcggttgtttctggtgtatggttgaaccattcgtcgatttgcctggtatcaccgcagtcacttcggggtacactggcgggcatagcgtacatcccacttatgaacatgtgatcggcggctataccgggcatgttgaagcggttgaaattatttttgatacccgcaaaatgagctacgcggcattagtggcgctttattttcagttaactgatccgactgatgcactggggcaatttcaagatcgcggcagtcaatatcgtcctgtgatttttgtcaaagacgatactcaacgccagatagcggaagcggctaaggctgaattggctgcttctgggcgttatttgcggccaatcatcactgcaattgaacctgttgcgactttttggccagccgagaactatcatcaagacttttataaaaagaatccgaagcgctaccagatggttgaacggacgcgccgccagtttcttcaatttcagcgtgcacaaggcaacctgcgggtgatgttgaaacggcgtaaaaaggcataaattcgtgcagtcaaatggcagttgttgttgaaacggaggtactggcctatgcgggaaccgatacgacattggacgcaaaagaatatgcctgatcttcacggcagctatgcggtggtaacaggtggtaccagcggagttgggtttgcaatgagtgctgctttgttgcggcacggggcgacggtgatcatcgttggcaaacaggcatcaaaaggcgtcactgctgcagccaagttaagggcgcaaaccggtcaacaaaatgtcacgtttatgggcgctgatctggcggatcaagcagccactaaacacttagccaatcgcctgctgaggatgcttcctaagctggatattttaatcaataatgccggtgtgatgatgcccgctaaacgtaccttgacccgtgacggtctcgagctgatgtgggcagtgaattattttgccggatttatcttaacaatcgaactgatgccgctactattgcgatcggatcatgcccgtgtggttaacgttgcctcaatccccatgggtcgaccacatttgacctttaatcagtttgatggccatgactatcgcccttggacgatttatacgactaccaagctggcgcaagcgatgatggtggttaagctcaatcagctattgacagaggcaggacagtcggtgaccgtgactggctcaagtccgggattagccgcaacgagtttgaaaacaatcagctcaaggaaaactgcgtggttgatgcgaatgggtgcgttgagttttcgcctgctgccatttttccggcaatcgccagatcaggcggcattgccggcactgtatgcggcaaccgcccccaatgcgcaaggcggcgtgatttatgcaccacatgcaaggcgtggtttgcgaggttacccggcattatgggcttggaatcagcggcccgaattacacgatcagaagttgcttgatcgtttatatcgggcttcacgcaatgtaactggtgtatgactgccattttgggcacgttagattttctaagaagcgaatttgctaatgccgcaaaagcatcatttctgctgaccccatgctatttttgctgtgattagcgttgtgtaagcaattcacctaaaacagcacatgtagtggtgagcacactcgctaacaccaatatattgtatattcaagacttacatttaaaaaaatttgttgcataatagagcatagtcgttgtcaatgcaacgaaaacgaaagtttaagggagtcttgtttgtgcaaacatctgggaattattttagttggttgatgcatcagttgaaggggtggccgcagcagaactattatttgttctggtttgcttttgggtgtcagttgatgacccttgtagatgctaagataacgcccgtgactatcattacttttattgggacaactttgggtgtgctttgcgtcttggccattaatgccactaaagcagtcaatgggtggttaggtcttttgagtgccgcatgttttatctatgtcggctttatcgcccgcaattatctatcaatgtttgaacagctagcctatgtggtgacacttgatttgccagttttgattagcgttcggacttggaatgatgatactaagaacaacttgaagacattcaatgcccagaaatggatgctgtcaattggctttacgttgattgtgtgggcggtcagcgcctatttgatcggccagtttaccaatgatccgcggccaatttttgatggtttggcttttgcgatttcattgactggtgggattgtttgcttcctgcgatacaacaatcagtacttctggtggttgttcagtggcgtggctcagcttgttttatgggccattacttttgcgcaaggggatgccagtttagcgatggcgattaatgccagcatttacgtcattaatgatattttggccttcacggttagtccatggttcaatcggggccgcaagcagctgggtctaaaaacgatctaagtggtgctttagccgtgtttgtggtaatgtttgttgttggcgcaacataataaacataattgaggagcgagatctgtgatctacattttaggcagtattggtgcaggaaaaacgtcgctgacaaaagttttgtcagaagatatgcaggcaccggcatattatgaagatgttgaaggtaatggcatgatcgccaatatgttgcaaaaattttatggtgcaggcgttgagagtcgtaagcgaaccggcgcgatgttgcagattgcatttctcacgttccgttaccagcaattgaagaaggctgtgacccaagaaaacgcgatcatggattcttcgcttgaatcagacttcgtgatggcctcgcagttgcataaacacggtgaaatcgatgatgttgatttcaacgtttatgtgacactgtctcaagagatgcaaagtaatgtcaatggcagtccttggaacggttttcctgatctagcagtttatctgaaaattgatccagatcacgaaattgacgaaattcaaagtcgtggtcgcgatatggaggatattcgcgaaaaaccggagttggtcgattactatcggcgtgtcaacacagcttatcgtgattgggcgaagggttatacgcgctcgtctatgattacaattgatcgtgatcgttatgactttatgcactcagcagctgaccgtgccagtgtgttagatcaaattgaaaccaagcttgttgatctcggcaaattatctccgcaagcatttgatgcgttgcaagcgcaacatgcagatgggccgatttctaagtttgcatgatttccagttaaattgttagaaacaacgacctgtgtcatcctcatttttaggggataacacaggtcgtttttgatttgtttcataaaacatgttcacaaacacagcaactcggtcaattcacgcgatgccatcaattttcgattgcaagttcagtctatgatatgcttatggtataagaagccatggttcgaaaccctaactagcattggttgtcagtggggtaaaggacactgaccccactagaaggaggaactcattcgtgacaatttatgatcagcacatgcataccttgtattcatttgattccgaagcccaactccgtgattacttaacgcagacaaaggcgcctgtcgtgacaacagaacatttagagtttgataatcctgatgatggcggccgggataatctgcctgattatgctaggatgaaggcaacgcaggcggctctggccgaaaaatttccgaacgaattcttgcttgggatcgaagccggctattttgctcctgccgatgctcgattccgacagtacttggacaaccatgactttgatttgacacttttgagttttcatcatgatggtcattacgattatctggatgagcaattgatcaccatgccagctaaacagcagcttgaagattactttgaacggatgctcgctggcctcaaacgatttcatgatgccgacgtcttggcacactttgactatgccttgcgccgatttgacatcacaccggaccagctagaagcttggggcaagccgttgttggatcaaatttttaccattgccgtcgaaaatgacttggcgttggagttgaatacgaagtcaatgtatcgctggggcaatgcaccactgtatgatcaggcgattgcttggtatcaagcagcgggtggtcacttgtttactattggcagtgatgcgcatgaaggaccgcaatacgaggcaaactttgctgatgcgctagcgatgcttaaacgtcacggggtaaaagaaatcgccacgtatcgtcaacatcagcggacaatggtaccgattgagccgccagtgattgatgctgataatgcttattaatggcaacagggtgaggacatcattcacagcttcgaaaaataaagacgcccgatttttccatttgcagggaaaatcgggcgtctttcgttttctcatagataactgtcgggatttaagatctcagtgccaaggcgaagcaatcgtaggccagatggggctcagccgtggaaacaacacagcgaccgggcttcaagtatagagggaggattttgacaattataggtactgcactatgtgacgcatacgtttaaaaacattgtgcacgccctctagcttgaattacttgtgcaagagaatgcaaaaagcgcaacctcatgttggtactgaagttacgctgtgtttctgatccgagtgtgagtcgttcatgatgaaatcggctatttaaaaaatctcacgctaattaaagatatcagtagctacctgcttaagttctttcgccaaagaggacttggcgtggcccactacttcaagatggcaagcggcggcatcataagttggtaactgccaaaggacgatattccccttaacgcagctctcgaagtcagcaaaaggttttaacatttcgttcatgaagttatctgatgaagtcacgaacataccaatgaccattcctgttgcctcgttataatcgtcatttgatagaacaatgagtggtcgccgaatgttgccgttattgaaattgtgacctccgtattctttacctaaatgcggttcagcatcaacgaaaacaatgtcaccttgttttggcgtgttctggtcatacttctttacctcttgatgactcttcagaaacaattccgatctcttttttcattgctttaaaatcaatcttttgaatagctttcgtgtgccacgggttaattcgttgtggctcatactttaacgtaccctcatcatcaaccagtaaaaggtattcttgcccctcgttaacgccagcatcggcaggtactgttaaacttagcgagttgccagatcgtctagtggtaaaacgacctagtacgcgatcatgacgcttctttgtatccattaagatccctcccgtaagtacaagtatatacggacgtgtaaatgaccttacgattaaccatggttactgatttggtgatttatcaaaaatccagacacgaacgattggccatacagaaataaaaaaaagcgctgatgtgcgcgtcttttctataaaaagttctccaacccaacaaccaattcatcagccgtttgtaccttactaatcgcgactgcgacgccttgcatgaagctttggcggtcgaaggagtcttggcggatggtgagggcttcaccggggccgccgaagaggacttgttcgtgggcaatgtagccgggtaggcgaacggcgtggatcgggacgtcatcgacacgttggccgcgggcgtcattgtcgatggttggcaatggcttttgggtacgtccggcggcgattttgtgggcggtggcgatggcggtgccagaaggggcatcggctttgtcctgatgatgcatttcgatgatctcggcatcagggaagtaggcagcagctgcttgcgcgaatttcattaaaagaactgctgagagcccgaagttcggggcgatcaagccaccgaggtgtttggcattggcaagtttgatcagtcgttcctgattggcagggtccatgccgctggtgccgacgattggatggatgccggcattgatggcagcttcaatgttggcagcaacggcgctgggattggtgaagtcgacccagacatctgccacgtgtgcatgaagctggtcataggtgttgagtacttgcacgttggcaggcaagttgtaactttctggattaagatcggtgattttagggtcgaaaacggtacttaatgcgaagtcttgatgtgactgaaccattttgactgttttctgacccatggaaccacgaaaaccggcaacaagaacctgaatcatgcgagcacctccgcttcaatggctgatagttctggaacgcccagtagatgggcgagttcctgctgttggctggcgttcaggggtagtaacggcaaacgtgggctgccgacttgaaagcctagcgcattgagtgcagctttggttggcgcaggggatgggaaatggaatagagctgccatttttggcaacagttgacgttgcaaggcggcgactgtggtgatgtcgccacgatcgagtgcggcgtacatttcacggatactgtgggcgtaaagatgggctgcaacggaaatgactcccatcccaccgagtgtcttgatgttgagtgcctgagcgtcttcgcctgtccaaacgttgaaagcgtcgtgcttggtacggtcaatgatgtcactcaaggcagggaggctgccgcattgcttgatgccttgaatcatgggattttgcgccagtgtcgcaacggttgctggtaacatatcaacaccggtgcggcctggaatgttgtaaatgacgatcggcttctgcgccgctgcagcaacggctgtgtaatgggcgatcataccgttttgatctggcttgttgtaataagggacaacaaccaaggtggcatcaataccggcaatgccgccaacttcatgagtgaaggcggcggtttctttggtgttgttagaaccagaattagcaatcacaagtgcgcggccatgaaccatatcggcgaagcgggtataaagcgtgattttttctggatgaccgagtgttggtccctcgccggtggtagcaccgacgacaaaaccgtcagtaccttctgcgattaaatgatcgacaagtcgctgcatgacgccatagtcaatttcgtcgcgatcattgaatggcgtcacaatcgcggtgatcagttctgctttttgcatgatgaccctcctataaacgcgctacccagcccagaaactgcgctagttcgcgctctgtcttaatgtaactacgaatgatgacttatactggcttacactttttcaagcatccgatgttcaaagaagtgcacaacggcggtgacaccgggcacgagtgcggcttcgtcaggtgaaaagtcggctgcatgtagttgtgagtcagggtcattgacgcctagccagaacatggtgccaggaatcttatttaataggtagccaaaatcctcacctgtcatgacaggctttgtatcaacaaatgtcacgtcaggatcatctttcatcacttgaataaagtttttggtgagtttgtcattattttcaacgggatagtagccgccttggttcaaggcaactttgacttggcagttaaaactggcggcaatgccttgaccgatgtcgcgtattcgttgttgcagaaagtcaatctgctgctgggtgaagccgcgtaaagtgccttcgagatgtgccctgccggcaatgacattgcggatcgtacctgcgcgcatcaagccaaaagtaatcacggcgctgtcggttggtccgacattacgggcaacgaccgtttgaatctgactgatgaagcttgccgccgccacgatcatgtcattggcattttgtggcaaggcagcatgaccgcttttgcctatgaggtcaacgttgatttcggttgtgccggcaaaaagggtgccgaggcgtgtgctgatcgtcccagccggcagatctgggcgatcatgcaggccataaaactcatcaatgtgccaatcgccggtgaatgcgcccatatcgtaggcgagcttgccgccatttttactttcctcggctggttggaagaaaaagatgaggttatcttttggttgatgttcagcaaaataactgaggatgccgagggcgacagtcatgtggatatcatgtccgcaagcgtgcgcgatgccggaatgcttagaggcaaatggcaatccggttttttcggtaaccggtaacgcatcgatatcggtccgatagccaatcgtacgctgcggatcgcgcccttggaccttgacgagtaaagcggttggcaggtctggcaaggtgcggatggtgagatatgtttggggcagcccttgaatggtttttagcaataaggcgtgcgtttctttttcctgcaaggctagttcggggatttgatggagttggcggcgaagggtgatgaggtcagcttccttcattaataagtcacagctttctgagttcgtcgagtaggacggttttggcttcggtttggtcattcacttgtttgatgactttcgcaggaacaccagcgaccacggtgtgcgcgggaacatcgttaatgacaaccgcgccagcagcaataaccgcgccttcaccgactgtggtgccttcgaggacaacggcattggcgccgatcatgacgtgatcaccaatcgtgacgggcttagctgaaggtggctccacaaccccggcgagcacggtgccagcgccgatatggcagtgcttgccgacgattgcccggccaccaaggaccgctcccatgtcaatcatggtgccagcaccgatttctgcaccaatgttgataatcgcgcccatcatgatcaccgcattgtcgccaatgagcacctgatcacgaataatggcgccaggttcaatgcgcgcattagccgccttgatatccagcagtggaaccccggtgttgcggccggcggtttcaacataatagtcatctaacttggcttttttcaaaatgggtttaatttctgcccagtcgccaatcacggtgccggtatgtttaccgatgaaagcatgaacgcttttggggaaatgcagctcgcttagtttgcccttgagataaaccttaactgcggtggtttttttgctattaacgatggtggaaataattttttgagtatctaactgtgccataatcggcctcctatttggttgcggcagtggcgtcggtttgagctggagcaggctgctcagttggtgcggcgtaatgtaagtcatttttaatgagatcagcatcggtttcgcgggtcacgaccaactgggcttggccattttccacgaaaacaacggcgggtcgcggattgcgattgtagttggatgccattgagtagccgtatgcgccagtgtcaaaaacaacaacgacatcgcctgatgtggttgtgggcagcgttgcatcatcgatcaaaatatcgccggattcgcaatacttgccgaccaagtggacatgttcagctggcgcagcatttggctggtcagctaaaacggccgtgtaggttgcttgatacaaggcggggcgaatattgtcgcccatgccgccgtcaacggcaacgtatggccgcaatcccgggacatctttacggctgccaacggtatagagactgtagccggccggcccgacaatcgaacggccgggttcaatccagatggctggtaacggccagttaagcgtttgactttgtgatttcaaggttgccagaattgccttaacaaaggcttctggtggcagcggatcgtcttgcttggtataagcaatgccgaagccgccgccaacgttcaggactttgggaatgaagccgaattgctgatgccagttattaaggacatgcagcagcttttgggtaacggcttcgaagcctgccacttcaaagatctgggagccaatgtgggcgtggatgccaagcaggttgagatgatcgtcggctaaaatgcgcttggcggcttcatatgcttgaccactagcgagatcgaaaccgaatttactgtcggtttggccagtttgatcataggcatgtgtgtgcgcgctgataccaggggcgacacggattaaaacgtcctgttgaccaacggtggcacctaaaaggtcatcaaggagatccagttcgtgaaaattgtccacaatgatggtgccaaccccggcatccaatgctcgtgtcagttcagctttgcttttgttgttgccatgaaaactgaccgccgccattggaaaatcggctgcctgagcggtgtaaagttcaccgccggacactacgtcaacgtgcgcgccttctgacttggcgacttcgtacatcgcaatggtcgcgaaggctttggaggcgtaactcacggcatatgacacatctgcttcttcaaaaacacgtttaaatgcgcgaatttgctggcgaatggcgccaacatcgtacacataaagtggggtttgaaatgttcgggccaactggctggcagcgaccccgccgatggttaactggccttcatgatttgtggcaaaatccataagttcatcctcccgaatttggcagggcgatggcaaacgaaaagggatccttttgtttggccacgcgtcaaacaaaaagatcccaacttgcaatctacttgaatgatagcgccccgcttaggtttctaagcgacagtacaggatttgttcaatcctggcccaacaggcttgccgatcccggcgcgcccatttcggcaaccgcccctttggcttgatgtcatcacgaaggatcccgctcgatcaagctactcatgttggttgcaacctctatctgtttgtcaccagcctataataaaaagacgtggacgtcaaataaataatgagagagcgcgaacaggaccgcttagaaaccggagcataagcggcctcaagcctcaatggctgggtcttggccagtgaggcttgaggtccttatgtgcaggcttctgggcctgttcgcgcgctttaagtgagataggtctgtcttcgaggcttttagttctcctatagttggcatttgtccgatagtccgagctggccctgcggtgacagagactggtgactgtgaactcaggtcattaaaaacaaatttaaaaacattgtctctatgcagtaacccgaaaacgtgtcatgttagcgacatgctggggcttgtgtttctgggagagtctgttaaagtacaggataaaatgacaaagttctcatttgtcgtgacgtctaggaggcagtttatcgtgcgtgtcgtaaaatttggcggttcatcgctagcaaatggttcacaattcgccaaggtcgtggcgatcatgaaggctaacccagctcggcaggtgatcgtgacgagtgcgccaggtaaacggcacccgggagacaccaaggtgaccgatttattgattcagtatgcacaggcagtgatgcggcatgaagctgtggctaccattgttgcagaaatcgttgctcgatatcaggcaatcgccgatgattttgagctcgaagcatcgatcatggccgcgattgaagaagagctagaccagttaccaaagttgactttcaagaacaatgattatttaatggcaggctttaaggcgcgcggtgaaaagttgaacgcgtttttaatgaccgcggtgttgaatcatgaggggattgaagccacctatggcgaaccgaagtcgttaggaattgtggtcacagatcatcccaatgatgccgaagtttcacgtgaaacctatcgcaacctcgctacatttcgacgaccaattggggttttggttgtaccgggattttatggctataccagcaatgacgatattgccaccttttctcgtggtggctccgatatcacgggagcgattttggctaacggtgttcatgccgatttatatgaaaactttaccgatgtcgatggcgtagcggctgctgacccacgggtggtggcgaatccgcaaatgattcgtgaaatgacctatcgggaaatgcgagagctgtcttatggcggctttggtgtttttcatgatgaagcgattctgccagcgattgctgggcaggtaccgattaatcttaaaaataccaatcatcctgctgctccagggacaatgatcgtcccagaacagcattttgtcccgaagcatgccattaccgggattgtaagttcccaacattttggggcgatctacctgcatcgatatctgttgaataaggaagttggcttcactctgaagattcttcaggtgttagcccacaacggcattagttatgagcacatgcccagcggaattgatgatctaaccattattttagatgatcgccagctaactgaggccaaacgcaagacaatttgtgccgagattcaagcggcggttcatccagatgtgctgaagtggattgatgactatgcgatcatcatggtcgttggtgaagggatggcgcaacgaaccggattgattcaaaccattctacaaccgctcgcaaccgccggcgttcatgtctcaatgattaatgagggggcctctcagatttctctgatgctgggaacctcacgtgagtcggccaatcgcgctgttaaaacgatctacaatgctttttttataccgattaatcaacgtttggaggtgcactaacatggtgactttgcaaaaggttcatggttccgaaaatagtttctttcttttcgatgaaacgcagttaactcagccgttgacaaacacgcaattagcaaccgtgacccaacagctaacgaacgctgaaacaggtttgcttggcggtgcggacggggtcttggccatcacggcggcgccgggaacggctggcaaaatgacggtggtcaacactgatggtagttttgctaaattgtgtggtaacggtctgcgcacggttgcacgttatctgagtgaaaaaactgggcaagcgacgttcaaggtgcacacggattttgctgatcttgccgttgctcgtcagccgcaactggcagaaggcgtaccggcctattcagtggaaatttcgccggttagttttgcgcctcaggacttgccgtttgccaatcttggcgttgaccgaattgtggatactgttttgccagcgattcatccgagcttgaaattcaccgccattgctgtgcccaacccgcacttaattgctttcgtctcacctgaggtattagctgggtccgatctcgaacgaattggcaagatgctgaatgccaaaaatccttattttccggaaggggtcaacgtgacttttgccgaaatcttagataaggataccttatttgctcggacgtatgagcggggtgtcgggttcaccaatgcatgtggcacaggcatgtcagcaacgaccttggcttttattttgacgcatccagaggaagctgcttttgatcgggtcaataccgtgtataatccaggaggaatggtcaaaacaattgtccatcatgacggcgagcgttactggattgaattgatcgggaatgcaacggttacggcgacgattaccttgccagacacggcgttactcgcaggcgactggcaacaagctgagattcacgcgactggcgaacaggctgagtatgaacgatttattgacgcactgccgcatcggaagttagcaaacacattgacagaaggagtttagatcatgagtggttatcacgtagcagttgttggggcaactggagctgttggcacccggatgttaaaaatggtggcagaaagtaaactgccgattgcgtctgtcttggcacttgccagcaagcgctcagaaggaaagcaagtcccttaccgtgatgggacgctgaccgtccatgagacgaccgatgattcattcaagggcattgatattgccttattttctgctggcggttcagtttccaagcgatttgcaccagccgcggttaaagctggggctatcgtggttgataatacgagtgcttttcgaatggcaccagaaattccgctggttgtcccagaagtgaatccggaagcgttgcggcaacacagtgggatcattgcaaatccaaactgttcgacgattcaaatggtcactgcgcttgaaccgattcggaaagcctttggtcttaaacaagtggtcgtttcgacctatcaggctgtttctggcgctgggcaatcagctgtcaatgaattgcttgatgaaactcgcgctgcattggacgacaaaccgcttgacccgcagattttaccaacggcgggtgacaagaaacattatccaatcgccttcaatgccttgccgcaaatcgatgttttcgaaccggatggctatagccatgaagaatggaaaatgatccacgaaaccaagaagatcatggctggggatatgaacagcgataccatcaaagtaaccgcaacctgtgttcgaattccggtgccaattgcccactctgaagaagtgtacttcgaagtcgaagacgacaaggcaactgccgatgatattcgcgaggcattggcgcatgctcctggtgtcgttgttcaagacgacccaagcaaacaagtgtatccgcaagcgatgaacgccgttggcagcaaagatgttttcgttggccgcattcgaccagatgccgaaaacccacgttttttccatatgtggaatgtttctgacaatctattgaaaggtgctgcttggaattccatgcagattgctgaaacgatggatgccatgggactcattcaacctaagtaaatcgttcggtaaaaaaaccggtatcatcattgttcaggaggttctgaacagcgacgatgacggcttttttgttgctttgagattgttcaaaaataacacccggatttcttgcgagaagcttaaggttggtacgcaaagattgaccatccagattaaataactataatagttaaaaaacaaaggagcagttgtcaaatgaaaaagcatcgttttgtcatcgcactggtgggtctgtcactctttgccgccagcagtacgattgcggctgatatgacgcaggcgaatatggatcaacacagtgtgacctacacgatcaaaggcgacgggttagtcatcttcgacaaaactcgaacctatcgaacaaaatcaaccgctgctgcctataaaggaactttcgccgccgatgcaccaacggccagctttgaaaaggtcgggacactggctaaccacaaggactatcgcgttacccgcaaaattaaagtgaaagctaagatgcaaggcgctgctgcacagacctttttctatgtgaatgggcatggctgggttaagggcagtgacttgacgcgggagtaaactaccgccaattgtcataactaaagactcgtgatgatcttttatcaaaaaagatcgtcacgagtttttttagcataagacatctcgattagaaaccaatatgtaagaatcctaaagcgggtggtaacttgacttggatatttaaaagcaagcaccttacgcgccgttttttcgaccagagagcacatgacgtacaaacacagaagatggtcccatgtcaagaaataagcgtaaacgtttgagtgacaaaacacgacgtttatttaaaacttgtcttttaacacgcacgaaggtttatggtgaatgtagtaagagcgcgcttactatagcatcaggaaaattgtcgaagcaaaaggaataaagagggtttttacatgaatggatttgtagaaatgacagtcggagatttgcgcgccgttcaaggtggcaaaggaaagcctatctactggaaagatttaagctggaaacagcagaagtgcatccttagtgttggtggagcgctagttgctggttcggttgggacatttcctggtatgctcgccgcgggggcagcagcattttggagtgagtgcttataatcaagtttagggaaaactttattgatgcggttatcttcacggtgtttctatttggcatcgatctattcttaggcggtcggtaccaaattggtagaaacctaatagctggcgtgtcattcttttcaattgtttgcatatctcagtacctgtttcgcaataaaaatgcctagcactttattgtcgatcaatattcttgggattgatttcgagctcaccaatgatttttaatggtgagctttttgcattggtaacgataaaatgtgttcaatcggcaagcatttccaacgaattgagacagccttgcttgaccgcacttatgtaaagataattagttatgctgtaattaaaataatagtaatttaaatgcaatagctaaagcatgatgattttcgttgacaaagtgatatccaccactatacaatcaaagctcgcttaaaaggttaagctttttatggatttatgcgggctaggcgtctatgagagagaacttgatagtgcattcaaggcatcctccaattatagttctatatctagctgacgaagacgtttcgtgatcaattgggggagatgaagtttggtaaaagtcttttttggtcccattcataaacagattgattcggttttggtcattcaattcgttgacgccggtattatctgggttcataactcaaaacgccattgggagttgactggtggcaagttagaaccgggcgagacgatagtgcaagcagctgtccgcgaatcgtatgaagaatcaggtgctgttgttcaagccagtgcgattgtgccgttgggctactatgttttacccactgggcacacgacagcggtggttagtgctaaagttgaacgtttgcaagctattcctgcgtcttctgagattgatgatcggcaagtatggtttaagcctgtcccggatgctgagcgatcttttcatgatgatatttacgcccagatttttcaacatatcgggtggccggatgagtagccgccaatacgggtttctgctgaatattttatcggtagccgtgatggctgtgacaccggtcatgaacaagttctcgatgatcacgctctcgccattagccgcaagtttctacaatgcgctagtttcattgatcctgactttgggcacgatcgcctttaccaaaacaaaattagtttggattaagcagccgattatttggacgttgggtttgacgaattgtttaggcatatttttgcaatatatgagtcttttcttccttgatccggtcagcgtcgggttggtcggcaggttttacattgtctttgcgatattgctttcagtgcttctgctacgtgaacgatttgatcgaaaagagattgttccgatcgtcttatgtatgattggcacagctttggtatctgacttttccggcgatgttaataacatactgggtctggcttgtgcgcttggctacacgtttagctttgccctgaccaacaccttagccaaaaaagctcttatcaacatagacgagaagatactactcttatataaccaaggcaccgccgtcgtcattctaggcggttttttattcggaagcgaacaattatccctcgcgccgaaccttggcataggtgcggttgccatctcagccttctgctctggttttttgggactgctactcttttatcgcggcctgaagttgatttcatttcgcgatgctaatcttattcgggcattgaatcctatttttgtcttagtgtattcattgccgttcttcacaattcaaatgacgccagcgtttctgcttggcggtttctgtatcattctttcaattgtttggatgtcattgccgatgaagaaggttggcgttgattgagacgaatgtttcttataggttcagcgaaagtataaatgcctagattgcataattaaagttaccacccagaaaatgtgaaaaaagacctatctacacgacacaacaccaaaaagtacacgacacaacaccaaaaagtacacgacacattataaacagtgctatactatttttagtgcgaaggagggttaattaatgattgatgttcgtaaacttatttggtcgagtgatcgtgactttaatcaagaagaaattcatgacaaacgctattttctagttgcagaacataatgatctcattacgaaggctcgtcatgatttgaatgcgcgtgaattaaagataatggattatgtcattgctcgaattaaacctgatgatgaccattttaatttaattaatacgtctatgtacgagttgaccaaagtcttggggctaaagcgaagtggaaatgcctattctcaattggcgggaagtttaaatgctatgcggaaaaaagacgtttttatatacaataagcaggaaaaacgattgaccatgacgggctggtttgaagttgtggatgtttgggaaaatggtcaggttcaattaaaaataaataaacaatttgctccatttttgcttaagcttaaagataatggttactatactcaatatttacttgccgatactgtacaactaaaaagcaaatattcgattcttctctacaagctaatgcgcgaagctgacaaagaccacggtcagaccatttccattgttcaaggaacccctgatgaatttaaaacatggcttggcgcgccaaaatcttatacatatggtcgcttgaaagacaaaatactaaagccagccattgatgaaatcaatctcaaaataaatgatttagatttaaacttatttcaagcacgacgcggccgacaagttgtccaagttgaaattcataataattttctgcgcagatatccaaggacagatcagtaaatgcaattaatcaaaatatatgttaaaatatctttaatcgaagaggctcataaacatcactaaaccgtgtagtccgcaagctacacggtttttttgtctcaaaaagccatcatctccgcaagaagatgatggcccggtgccaagcactgaactcggccgctacttactctacttgcgattgttcagcttgtcttctaccaagagcagaaagacaccgacaagtaaaggcgcgatgatcgcaatatcgaagggactcataaagcatcaccacctttgggcgcggtatcacgcgaaaaggcgtagcgactgacttagtatatcaaaaaaccagtctatgtccccgtataactaaaacatgttgcaaaattccattatttataactgccaaatagacggctccaaaaagaagaagatcgttctggggtgttttcagctaccccagacttttctggtgctcttttatgtatttggtcgctttcggattcagaactgctctcaggctcattatgaggtgcttccaacttcttaagcttgttttcggccattaactgaagttgttgagactgatcgagtagcttctgcattttctccaactgattgtccttagcctgaatttggcgatcttttgtatgaatctgttcttttagggttgctactttctcttgcaagcttgcttgcaatttgtcagataattgcttgctatttgcttgcacctttgcatggcgcgtacccactatctccccttttatcaaggattcatcagcaggagaaattaaatattgacctgccattttctttggccgtttgctcgctacttgcttgctgatgatttgctgaaccctttggcggctaacgcccaactcatcggcaagctctttgactgttttactcatattgctgtcctcacctcatgcaatctaatgtcaattatagcaatgactagacatgactacccataaaaatacccgaaacgatctcagaaatcgtttcgggtcacttatttgaatcagattttaggccttattttaagatgtttctggtcgttccgttagggtacactttatcggaattaaataagtgtcactctcattgtttctggcgtaaataatctgaaagattgtcactacccagcagttgataccgtttcaaatactataaaaaggcttgcggatcaggcacagtgtcgtttaataaatcaatgatcctgttcaattagattgcttcgatatttggagtattggtatgttgattaactcaatagtcttgttttatcaagcgcctcaccgcttttagcgttgcttgatattggacaatggctaatcattcggggcgaccgttggtcgtcaggagacgcttcagaaagcagtaagtaactacataattacggtattttcgcagctcaaaatccaagaatacatcgttactgtcaatagcaagatacgaataagcttaatgaccgtagtgtaataaacagtgacacctcgatcccaaagtaacttttataatgccacaatagctgaggctgaatctaaaatagcagctaacggcagctaagatgatgtctctttgaaagaaatatcattttgaagtgattcatgcactccatccttcgtttattggcgttaagaatactaaaatgaggtcatagaagaaagcttgaatcaaaatatttcatttgacacaaaaaaaaaaaaagcatatattcacaaaacagggttttaggtatccctgaaaatcgtggaggtgatttttaatgcaacaattcactagtttgtccgttgaagaactttcaaaagtatcaggtggctcctcaggtgtttggtatggtattgggaaagaattaggtatcatttgggctgctgctggcgacgcaggatatgatcgtgctcataagtatggtggcaagacaaaatattagaatcttgagagagcttattaattagttttttataagtccctctcagacacatgtgagacctactaccatcaagaaatgatcgttttgcttcttaggccatatagatctccagcaatgtatgtttcagtgtctcttatgtcataatatatttggaggatagttattttatgaattctttagatcgcttctctgtattaacgaacgagcaggcaagcactaccgttggcggttcgtggcagactgagcttgctaaatttattgctgaacaagctgctaaccatattgatgacattgtcaagggttttaatgctggtaatcaccgtcatcgaccatagggtaaacatattgaatggtcttgtaatcattgtggtgattacaagaccatttttatgtaaaaggtaaatttatgaaaaaagagcccttgttatcacaaatttttgtagtatggattgtcggaataggctggacattaattgcgcaactagttccaacaattctaagtatgatcggtatggatattgatgttttaaatcgtgacttccgatatcaattattgtttctatacactgaaataattggtattatttgtatgtttctttattaccacaacgatcattatctcatccctataagaggagaaaatgtcataaagcagtatttttcaggatggtgctttggcattctcttattctttagtatatgggcaactgttaacacatttgggggataccatatcgatgtagtattcaaaccaaaatatgcaagtttaattttcctattttccattgggtttggcatacaatcgttttttgaagaacttgtatgccgtggttatgttatgggttattggttaaaagaaaataagttgatgttggcaattatcacaaactcaattctgtttactttcctacacattggtaatcctttttttgactggtatgcagcaatcggcttgtttttgtttggagttctaatgtctcagtttcgaattatttttcataacatatgggtatgcagtgcagtacatgctgcatggaattttgctgaaggtattatctttggaacagcagtttcgggattgccaaatatgggattattattaacatctagcaatacaacatcatctcaaacactaaccggcggttctttcggcatagaacgtagcggtgtatccattactgtccacatcatcctgatcgctattcttgttttatccattaaacgaaaacagttaaaaagttaagcttgttctacaccatttcatagttgaagttttcaattaatttgttctatataaggactgcactcactctgaatttcagccctttttacatagtggaaatgagaggaatacatgtttcggtatttaaaaaaattatacgtatcccaggttgatgaacgagattgcggtttagcagcacttaatatgttgcttaaatttcatcgttctgattattctttagctcacttacgttccttagcaaaaaccgacaatgagggcaccaccgctctaggattagtcaaagctgcggaaacccttggctttgaaaccaaggccattaaagctgacatgtcactgtttaacgctaccgatattccctatccattcattgcccacgtgctaaaagatggcaagtatcttcactactacgtggtttttaaagcgactaaacatgcgctaattgttggtgatcctgatccaaccgtcaaaatcaccaaaatgtccaaacagcgcttcgaaaaagaatggtcaggcgttgctttgtttattgcgcccacagctgcctataccccccaaaaagaggaaaagggcagtttatttgcgtttgttccgatgctgattaagcaaaagcacctgattacaaacgttattttggccgccatactcatgacgatcattagcatcgccggctcttactttttacaagcaatcattgatacttacttacctaatgccatgagcaacaccttatctattatggctgttggcctaattgtagcctacatatttcaagccattttctcctacgctcaatcctttctactcatggttttaggtcagcggcttagcattgaggtcactctcgggtatattcgccatctatttgaattgccgatgtctttttttgctacgcgaagaactggtgaaatcacctcgcgttttactgatgctagcaagattattgatgctcttggcagcaccatcttaaccatgtttctagatgtttggattgtgttggcggtcggtattttcttaggcattcaaaacaccactttattcttactctcgttggtggctttgccagtctatattgccattgtttgggtatttaaaaccccattcaataaactcaatcaagctgaaatggaaagcaatgccatcctgagttcctccattatcgaaagtctcaacggtattgaaaccatcaaagcgatgactggcgagcaaaccagctatgcaaaaatcgaccatgaatttgttgagttattgaagaaatcctttgcgtaccaaaaaacggatcaacttcaacaagcgatcaagcttggggtaaagctgattttaaatgttttaattctctgggtgggtgcgttgttagttatgaaaaatcaaatgacactggggcagttgctaacctacaatgcgttgctggtttactttaccgatccgttagaaagcattattaatctgcaaccaaaacttcaaacagctaaagtagcgaataatcgactcaacgaagtgtatctagtcgaatctgaatttaaaaaagtgcggcccatcaagaatccgctagcgttggctggtgattttcagttaacacacgtgaattttaaatatggctatggtcaaaatattctaaaagatgttagtttaacaatccctgctcatgcaaaactgacgattgttggcatgagtggctctggtaagacgactttggtcaagctgctggttggtttctttgaagtggcagctgatcaaggagccatcactttgaaccaacataacctcacagaggttaatcgaaccacgcttcggcaatatgtcatttatattccgcaagacccgtttaccttatccggaaccatcatggcgaacctaacgcttggcggtcgccctaacctgacccaaacagatgttgaagcggcctgtgccgcagcggaaattaaagcagacattgaagctatgccgttaggctatgccaccgagcttagtgaaagtggcgccgctttatccggtggccaaaaacaacgtttagcaattgcccgagctctactatcacccgccgaagtcctgatttttgatgaatccaccagtaaccttgataccatcaccgaacgtaagattgtcaaccacttattggcaatgaaggacaagacgattatctttgtcgcccatcgtctcaatattgcggaacgcaccaataatatcgtagtcctggatcatggcacgcttgttgaacatggcacccatgcagaactacttgccaaaaacggctattatgcccgtttggtcaatgaataaggaggcggccatgtttaacaaagaaactttagaaaccaccgaattttaccgccatcgcttccaaaacttctcaacgcgcatcatcttacccgccaccgttgctttattgctcgccattctgtttttgttcttagctaagcgtgaagtaaccattaccagtactggagaactcactcccgcgaagcaagtcgtgagtctacaaaccactacctcaagtcgcatcattgataaccatcttaaagaaggcaaggcagttaaaaaaggcgatactttattgacgtatcacgatgttaataacccgacacagcttaaagtctttcaagaacaagaacagcaattaaagtcgcaacttgccgctcttgaccagttcaaaaccggtattaccaataatcaggattctttcaacagtgacgattcgtttggttatcgacaagccttaaaagactacctcacgcaacgacaaatctatacattaggttctcagcaaataaccggatcgcaacatacgaacaatgacaaggctgctaaagtaaatgtcctattagctcaaagtatcagtacgagcaatcaaaatattgcggcttaccaaacactccagcaagcgattcaaaacagttctgggtatgataccaatgctccttttagctacctttacaagagctttgagtcagaaagcaaggggttaactggtgatgagctagctaaagtgaagagtacttatatcagtcaaattagcgaaaagttggatagtgagcgagcaaatctagctagtctcaaacttcaacaagctaataacgagacagatgatgtcagccaactgcaagttgcggaaaacgatcaaaaagttttagcgttacaggcttctcaactaaaatcagttgccgatcagcgaactcaagcccaacaatcattgacagaactgtctggcaaaatagccgtattaaaagatcagacaaccgactttaccgttaaggcaccggcctctggcacactccatctcgatgagagtttacaaggtaaaaagtatttacccagcggttctactctagctgaaatttatcctgttatgacggagcaaaccaaagtcagtcttgctcttgcggtttcaccaacggatattacgagtatcagaaaaggccaacgtgttcgcctgcaaatatcgcgtaatgttccggttccattaaccttaaatggcactattgagcaaattgatgtcgcgccaaccatcactaaagccggtaatgtttttatggtcaaagcacgtgtcccactaacagctcgtcaagcacgaatgctacactatggcttaagtggccgagtttcgatcattacgggcaagaaaacctacttcaatttcttaaaggatcgccttttaaaccaaagttgatgcgttaatgtataacttgtattgtcctctaccatcaccaaagctcagcttattgttgaaattggtcctcaaaaaggtagacttaattatatggtataggaattttaacttttaaaaaacgaggtgatagcattgttaaatgttaaagaaacagtcctaacagaagcagaattaagtttaattactggtggcaaaaatggcgtagctaccaacgaatggaatgagttttggaaaggactacgacaatcttttggctggtaaatcagtaagaatatcgtaacaccaaaatggtgtaatctcttttagaattgagattagcaccatttttatttaaacaacatgtaagatttaaataagctctctggtgaaaatatgcatactacaaaactttatcgcctaaatatgtttgctactctaataggcattgttatcttttctgcatttatagctggcttttactattctggagctaattattatatgaaaattaaaaagccagttcaagttactcaaattgattttccaatacatacaacattgattggctatctgtataagggtatagcaagaagcccgactggaaagcagcgattgataaagttcagcgctactttaagaaaaggtacagacttgaagaatggcgatattgttcagcttacttacaataagtactatggtgttgtccgataccaaaaagtagatccaaatgaagtccctaaaaaagtgaatcttgaggattagctgaattacttatgaataccattatcaattgtccatttcttcaatatcaagcaaaactttaagtgaagcttaatttgctgtagtacaacctcataatcacgctgaaaattcaaccaactttccgatttttagatcgtcttgcaaagcaaaatctacggctctacgtcaactggtgttgaagaataaatttatcatttgaggcggttctccaagaaaaattgtgttttcgtttttataagtgtcaacttgacaggggatagtacccgttgcccgcggtgcttcggtgattggtatcgccgccagccgccatgaagttgatgtgaatcaactaggggttgaacattttgtcgcttatgaccgcgggaatcctgtcaaggaacttgccaaaaccgccgacgtcgtgattaatgccgcgatggaagggatcggtggtgatgatgatgtcgccatggccaaggacaatgggctgatcgtatctgtcagtcatcacgaaccgctcctcaaccgcggcatccgtttcattcatacccgaccgcttggcggctccgaagtcggccaagcacttaaagtcttgattaatcttatgtctcaaggcaaattaaccgtcaaagtcggctatgtattgccttttacccgcgaaggctttgtaaaaggccaccaattgctggatgagccgcatgaaggccgaattgtgattcaagtaacgccctgatcgcgtctgttttctagcacgggaagctaacggcgaaaaacttctttaagaggcaaactagtgctccggctttttctaaaaatgttgacctgatgacactggctaacggttttgtcacgctgagcgttttagcttgttgtcaccataagccggtggtagtctgataagcagcaagatagctcgccactgatttgttacgtcaacttttatgaaggagattctctcatggcacaagaaatcttaatcacaaccaccgaaaacattcccggcaaaaaatatgaagtgatcggcgaagttttcggcttaacaacacagtcaaaaaatgttatcagcaacattggtgcaggcttgaagaacattgtcggcggtgaaatcaaagcctacagtgatatgctgcatgaatcacgggaaaaggcgatcgagcggttacgcgacgaagcccaaaaagctggtggcgatgcagttgtcatgatgcggtttgactccggatcaattggcggtgacatgcaaagtgttgttgcatatggcacggctgtgaaatttctcaactaaaaagcatcccttcttcagccgaataactgcccatcatgtgcgccagaagtcagtaggatttgctgagcaaaattggctctagagaaaagttcatctctagttttgattttcttagtctctgtctgctaaatgacttctggtgcatttcgtttttaacagcaggagtttcgactgcccaccgccaattcattttttgaaaggattgtcacgatgtcaattttgaattatgccaagcagtcttcgtggccaaatggtttcggcttccagcaatcaccgattgatcttcgtcaagcgacaaccactgtcgacactgacatcacgattctcacaccatggatgaccgatcaagaaattgatgaccaggtcaccattcggctcgctggccaaggaacgactcggattaatgaaaccacttggacttttgtgcaggcccattttcacgtgccagcggagcatatcgttgctgagaaaacggtggcggagctccattttgtccatcaatcggccattggtgcgctttgtgtcgtggcggttttagtgccagttggtcaagctaacccgatcatggccgatgtgctcgatcattttcaaccacatgtcacgcagccaatcaactttgacctgactcgcctactgccaaaacaaggtacggtttatcagtacctcggctcgctcaccaccccgccgttaaccgaaggcgtgacttggtatgtcattgagcaaaccgagatcacaatgagttcgaatcagctcgcccgctatcagcagttttttgaaccgaataatcgccatgtgcaagcgatcaatcggcgaccaattttccgaggcgttttcaagcaactgaagcgtccagcaggagatgaccctcttcatggctaaatcagcaaaacgctggcggcgagtaagcatatcggtactggtaattttgcttttcgctagcggcggctattggctttggtggcaactgggcagccgcgcaattcaccagcaaacctatcgtcatacgggtatcgtcacagtttttgtccctggttatggcagtaacaccctcaccttcgggccaatggttcaacgcttcaagcaggataaggcatccgatcaagtcactacaattcatgtcagtgctgacggcaaacgcacgatcactggagccgaccgctataatggaaaaaatccgctcatcaacgttgtttttgccgatgctaagtcaccacaaaaggaagtccggcaactcaccgacttgctgcactggcttcgcgtccagcgtcatgtgactcgtgtgaatctggtaggtcattcaatgggcagcaatctgagctttaattacatgacgacaccgcatgccaatcttcagccgcaagtgatcaattatgtctcgtttgcgagcgagttctatcgtgatccaacggcccagattcgggcgttaccgaaaacattgcatatcttagtgattggcggacaggtcttcggggcaaaaggtgactgggccgtcagccttgctggtgtcaaacgtttagccgccaaatttaaggcggctggcttatccaccaccctctttgtttatactggcacaccagttggcgcttatcactcgacgctgcaccaaaatccttatgtggatgctgaaatcttgcactttttatttacctgagtagctaaaaactatctgcagcttgtggcttgattctcacaagctgttttttgttgcctcgataaaatcgcattcccaactcatttgtaaattgccaagaaaaaattctatttttcatttgctattttcaaccacttgccaagcattttgcaccacttaccgcctttctcaagacacttggcgcaatcgtcgttatgctaaggccaacaaatcgaaagcaggtgacatcaatggctattcttgaagcaaagggtctgaccaaaacatttggtccgaaagtagcagtgaacggcattaatttgacggttgaccgtgggcaattcgtggccttcttaggtcctaacggggcaggtaaatcgacgacaatcggcatgctgacaggcttgattcaaccgaccagtggcaccattaccgtcgccgatcacacacctgggcaagtggcctatcgtcaacagattggggttgtctttcaggatagtgtccttgatcgccaactaacagttaatgaaaatctacgattgcgggcgcgcatgtatcaacacccagacactgcttggttcgatcaactgattaagcaatttgacctggcacctattttgaatcagacatatgggacattgtcaggtggtcagcgacgccgaaccgatattgcccgcgcccttttgaatcatccccaaattttatttttagacgaaccgtcaactggattagatattcagacgcgccaaacgatttggtcagcgctggctgctttacgcgtccaaacgcaattgaccgtcattttaacaacccattatttggaggaaacggaaaatgctgacttcgtttacgtcattgatcgtggcgaaatcattgcagcagataccgttgttgacctgaaaaatcgctatgctgctcatcaactgacaattcgaacaacagctgccgatcgagtcaaaacagtcgccaatcaagccggattgcgggccgatatcgttgccaacgaggtgcacgtcaatatccatcatccgcaacaggctattgccttgctgacggaactcaccgatacgattaccgactttgagttccatccagctgatatgaatacgatcttcgtcacgttaaccggaaaggagattcgctaatgctagcttttattaaacgtaatctattgttgttttttcgcaatcgcgctggcgttttcttttcagttttgggcgcactgattgccttcgttctctatttggtttttctcaagaagaatatgaccggactgtggcccatcagtcatcctgaaaagctgcttgatccctggctaatcggcggcacgctcaccatcacggcagttacgaccacgcaagatggtttagcaagaatgattgttgatcgtgagaatggttatttaagcgactacctgttgaccgaagcttcttatctgcgcattcaatttggctatctggccagtgccgttatcatcggcaccatcatgcagctgctcatgttcggtgccatgtcaggcgccttcgccctgcttgatcatgtcgttattccatggcaactaactggcaaaatcattgctctcgcattgttcagcagtgtggtttggacaagttttaatttacttattttgagctttgtttcccgcgtgaccaccatgagcggcattgcaaccattgtcggtactgcagcaggcttcttcgctggggtttacatgccaatcggggcagttcccagcggcgcacaagccttgatgaaaatgacccccttcccatataacgccgctgcttatcgccagattctgttgcaacagccgttagccacgaccttcaccggcaagcaagaggctgcaagggccagttttgaaaaaatgttgggtgttcgcattgacgtcaacggcttgctttctagcagccacacttacctgattctgattggttttacgcttggtgtgagcatccttattttccttcttgccagattcagtcgaaaggccgccctcgcccgcgtataatgaaacgtaatcgtgcgataccctggcgtcatgcggaaggagactgagcctatgaaagtttcatttgatcaagatcctgacttgaatccggatgatattgaggtgctcatcaaggctgcgcggctttcaccggctgtgttgcagctcttgcaacaaattcaacaattatccgacaatcgaccaacccttccgctaactgttggtgaccgcgtcgtggtactggccgttaatgacatcgtggcaatcgaagtctacggtgacgagctcacggtccacacgatgaccaaggtctatacttcgcgtggccagttaaaagccattcgcgctaagcttgatcctcagctttttattcaggtagccaaaagtaccattctgaatatcaattatttgacatcactggaagcttctttttccggtaatatgaccgccttcatgagtaatcagcaaaaattgacggtcagtcgtaagtttcttcctgacttgaaacgtttattaggattgtgaggtggcccttatgagaatcgcaaagcagttattgaccgaggccgtcattggcatcatgatcggcgcaaccgtttatctgaccactttgatgttgcatttagacacgattaatccaacaccgcgttctatcgcgggactgttcatcatgagtgccgtcattggcatcctatcttcgattttcgatcttgactggctcagtttaccagttgcatatggcacccatttcatcagcacctttttgatcgtccttgcaacgaactacctgatgggctggcaattcttgattggctctgccttaaccagcttcatcatttcgttcatcgtcatctacgccttcatttggatcgcgctatacctctcttggcgcgtgacggctagaaaaatgacccgcattttaaaaaagcggttgaagaagtgagttgtcgttgtgtcactaacgcataatctgtttaaagtgtcggttattctattctggttaggttgttcccggtagttccgcggtcgccacccccgaatcaccgcgtagccagctcaggctatcggaaccaacatcattagcatagcaataaagatgctcaacccaatgaaaaagaatacttacaagccatccttattgtcagcatacccgccgttgtagaaaacgcgctcacagtcgcagaaacttccgtgtaaggaccttgaagcaaaaggaccaaaaaccggccctttcacttcaaggccacttacactacagtttctaagcgctcctgctcgcgctctcagaccaatgagcggttacttttttgcattggtgctaaaatagaaaggtcaaataaggtcaatcaaggaagtgatcatttttgaaccaggttgttatcttttgcatcatgttggcaatcgtcattttaggcaacatcttggcacggcacgttcctaagacccgttgccattcttcttgatcggccttggggcggcattatccgttatgccttctcttcgtaatttcacacttgatccatcagtcttctcctttgcgatcattgccccactgttgtttaacgaaggtcaaaatgcttcacgtattcaaattggccgctctttaaccaatatcgtgtcgttggcagtcggcctcgtgctggtttcagtcattattttaggctttggcgttcatgcgctgtttccaatcattccactaagtcttgccttcgcgctcattgctatcgtcacgccaacagatgcatcagcggtcagcgccgttgcccaaaccaatcctttgagcgacagccaaatgcaactattgtccaatgaaagtctgttcaacgatgcagccggcattgtcgcattcgatctggcactgactgcctatgtttccggacaattttcaccaacagacaccttgctcgattttctcttcgtcttcttcggcggtatcctagtcggggcagtcttaggtatgctgatcgtgaatttgcgggcctggctgattcatatcggcgacgatgagccgttgatcatggtcggtattcagttactgacgccattgttggtttattttctagccgaagaacttggcctgtctgggattctggcggttgttgcttctgggattgcgcaaggtgtagagcgcgatcgtttgcgactaaccagtgcccgcatgcaaatcgtcagcgccaatgtctgggaaatggtagcggccattctttccggactcgtcttcgttttgcttggcctctcgctgcccaatgtcatcgtcagcgccttgcgcggacaagctggcttgttcagtttgcttgtgggtattggcattttcatttacgcagccaagtcactggttcgcctactatggagtcgaaccttgctgcggactggtaaaaaacaccgctggcgcaacgccgtcattatgatgctgggtggtgcgaatgggaccatcaccttatctttggcgttttcaatgccacaaatcgttaatggccacagttttccgctccggcaaggcttgattctgatcgcggcaactgtcattttactcagtctgattgtgccggtactggttctaccattctgcgtgcctaagcagccaaaacgcaatcgccaatatgttttggttgcgccgaatgttatcagctggcattgatgccatgcgggatgaatccgttcatcatagcgaagcccaaatcgttgcagacgtgttgtctcaggaaatgattctgaacgataaaccttcgcgaagaatgcaacgggatatctttgataccaccataaaagttgagaaaagaaccattgaagctttacgggtcaatgggaccatcacgcatgacgaagcgcactattacaatcgctttattgatttaaatgatttcacagcagatcagcgaacgtggaaaaatctttttctccgcttacggttcacctttaatatgggacgtatgtataaaggtctagacgaagcgcaaaatgcttttttaaccacaccgcttaaccttgagccgattttttggaaacggcaatttactgagcacggtgaagatctattacctatcgagcaggccggctatgatgcggtgatgaagtacttggcgagtgccgaaaatagtcaaaatcgtagtgccatcaacatcgttcgccgcttctatcgtgatcggcatcgccgggttcatacggattccttcgatggtgatgtgctatatgccatgttcctaaaagcattccatgctgaatttgagttcattcaaggtgcttttgctgaaggcaaactcaaccgggagatcatgcaacggttgcagacacgcattacttttgacgaaattacgtacctacaaaatcagaatagtttcattgcttaaaaagaacacactaagtaacaacacttgatgatctaaaaaagggtactgcaacggttaaattgcagtaccctttttgtcatttaaaacccaattaatgcttggctttatcgtcagaatcaagtgccatttccagttcgtcagcggcagtcttcgtcacgctttcgatctttgcaagcacccggccatatggttttggatccttgttgatataccgtaatagtcctgccattcgcgctgtcatgtcataccagctttggtttggcataccggagatttgaccgacccgggcatttggcaaaacatcgatgagttgctcgactgcatttttgacaaccggcaacgcaccgcgtacctgatcggaatcggcgtaagtggcatcaaagatcagttgcatgaagcgatcaggttgtgaatgttttgatggtgttgcagctcgttcggcgcgcacacccatcacaacctgttgcaagccaagtaacgtcaatcggactaattgatcgtgttgcgaaacgcccaactcaggcattggcgtgatcccaatgaggctcagttcgtcattactaagccgcagagcagcattggcaacaaagtctgacagttgcaagccgagatgctcgcgagaatctgcaaactcaaaccgaaccttgattggtcgttccaaggaaagcgtcaagtagcgactcacaatatcagcacccatcaccagctgattaccttccaattcattccgatgatcgatcatgatcacaatactatcaaaagtagtgtcaacatcacgcaacacgtgaatcgtggcgccgatgtatggatacagatattccattgacggggcgaaatcaggatacgtcgttttctgtgaaaagacggtatacatccccatgttttcatggtcggctgctttgatcagctgtgttaaggcatcaacctgtttaccgcgggctttaacttcatcccctggttcccagccatagggatagagcgcattacggaagccaatgagactgtcgtcgtcgccttctgggaaaatagccgcgatccccatgtgcatggtacgcggatctggacggtgctcttcaaaactttcatcaataaagagttgcaactgtttgccagctaccaacggtgcttcatcatgagtaccataattagtatgcatgttggtaccggtcgttgcctgttgactggtcgtatcgctggtactgctgcttgcagtattagctgaattgtatttgccgttacggtcatttgaggttgaccgaatcacacttggtgtatgcgtttcaacgtgattaaccactgctggcacatggcgattgtcggtcgacgctttagctgtcattgactgtgaggcacttgatgccgccggctgagtcattggctgccagttttgaggatcagcgttggctgcgaatcgattttggcgcgtgcggttaggctggcgattaccatttggcttattgcgattgttgcgcgtatagccattatcacgccgggcaggttcgtgatcggttttattcacattgcgccgtggggccgttactgtccgcttcttgatgtgacgctctgtctgattgtcgtgacgctgctcagtcgattgctgacttgaagatgagctagccgatacagatgaccgattagcttcagtctgacgtttcttagcctcagcttctgcttcctgtgtcgcaacatccggctgctggcgaatcgtgaagcgatgctgccgcgtcggaatatttttctgaacaggcgtctgtttcggtgtttgctcgttgttgttgtgctcttgctgattgttggggcgctggttttgccgtgacgtgacagttgaacgcgtcacccgtttagcagtgcgccgtgccggttttgaacttgctgctgcttcagtttgtggtgcagtcggcgtttggctagttgcttgcgactgctgattggctgcccgcttagtttgaacacgcgaggcttttggtgttgtcgctggtttgcttgctgacacttgttcagccgatttagtctgtttggcttttgcagctgactgcttcgctgtcgtggctggtttaacctgtttacttgcagctggtttcttaggtgccgtcttcttagctggcgcctttgtaacggttttgtgagcttctgctggcaccttgccagacttaatgatgctttcaatcttagccgcggtcttgcggctcacgctttggccgcgcagtgctttacgcaaagtcggcacagaaacacccatcgctgcggatgtcgcattggtgttcaacttgtgttttgccatataggcatttaatgatgcagtgaatttgtttttgttatccaaaatatttcctcatatcctactttattgaatgatccgtcactagtttaccgcaaaagccgataacggacatagtgacttgaatgtcaagaagcgtgttaacggtgatgcctatttcatgtctacgtttcatagccacctgtttgcgccggttagacttttcttgtatagtcattacttgtatttctcaagacgaaagaagcgaaaataaccatgcaacgaaaactcagcagccgtcacatgcaaatgattgcgcttggcggtaccatcggcgttggccttttcatgggagcaggcgccacgattaaatggacagggccatctgttctgatcgcctacatcattgccggcctattcctttacatgatcatgcgtgcattgggcgagatgctttatattgatccggcaactggttcatttgccaagtttgccagtgaatacatgcatccgatttttggctatctcactgcttggagcaacattttccaatttgttgttgttggtatgtccgaaatgatcgcaattggcgaatatttcaaattctggtggcccgggttgccggggtggctgccggggttagtggccatcaccttccttgtactagcaaatctaatttcggtgcgaatgtttggcgaattggaattctggtttgccttgattaaagtcgtgacgatcgttttgatgatcattgctggccttggcgtcattttatttgggattggtaatggcggccatccggttggtatcagcaatctctggacccacggcgggtttttcaccggcgggtttaaaggcttctgttttgccttgtcaatcgtcctcggctcctaccaaggcgttgagctgcttggtatcacagcaggtgaagctgagaatccgcgaccgaccatcgttaaagcagtgaaagacacgattggtcgaattctgattttctacgttggtgcgattttcgtgatcgtcgccatttacccttggaatcagctcagcacgttagggtcgccgtttgttcagacatttgccaaaatcggcatcacatttgccgcttcactcattaattttgtggtgattaccgctgccttatctggctccaattctggcatttactcagccagccgaatgttatacaccttagctgatgccaaacaactgccacgaattttcaccaaactaaatcgtcatggggtacctttttatccggtcatcgccgtgggcggcgggattttactgggcgtcattttgaatgccttactgccttacattgcaccagccgcgaaaaatgttttcgtgctagtttatagttccagcgtcttgcctggtatggtgccgtggatcgtcatcttagtcagcgaaattcgctttcgcaaagtccacgctgatcagatggccaaccatcctttcaaaatgccattcgcgccttatagcaattatctcacacttattttcctcgcgttcactttatttttcatgctactaaacccagaaacaagtgtttcattattagtaggtgtcgtctttcttggtttggtcgtgctgcattacttgttgtatcaacgtcgaaagcctgcgacgcaacctgttaaagctaatcggcaatagcaaatttcagcaactaattgatatggagaagcgtgaaaactgtctcgtgacctgcaaaaaaatgcacgttcatgcgtaggtaacacgctttttttatcttccccgtattgtcaatctaagtgcaacagtttctagtccaatcctataagtggtacaagaaaaattgtgttttcgtttttataagtgtcaacttgacaggggatagtacccgggatgccatggccaaaatcgtgactgacaatacactagccattctagctggtaagcagcctgagtacatcgtcaatgcctaatcagtgctggagttgactaaccataaaaaaggcgcctgtcgtcacacaatgcgtgtggtaacaggcgtctttttggatgaaataccatttcatttaatcaaggcttacgcgagttccgcggttgccaaatgcttgcgactaacaaagctaacacaatgccaagtgttaaaccaagaccgccaaccaaaaaaggattggcgatctgattttgagtcatgacaagatcaagaacgccaattaagcccacggaaatgagcaccaagacaatacggtaccacgccgttttcgtcatagatgagccagaatcgtatatttgccaactgctttatagtcacccttagcctttgaatcaggcgttccggcagcttcgtaaaaaacggaatacttgccgtctttatctttagcgacaaccaagccttcatcgacaacatgttcggctttgtaaatttgggcactgcgtcgagccgcggcgaaatcaaaatcattggcgactgcatcgccggggttgaagaaaacaatttcttcgctcatgaagatcccctcgctttctggcttcattataccacgtcaacatcgtctcacttatcagtttgaagcgcctcagccttggctatcaggcttttggtaaatgctgcaaactggggcatctcctcttgcttgacatttaaagcgattttcacagggtcagctccttgaaccgccccacttgccgccaacacggcttcaaacaactctggcgcggtattgtaatctttaccataatacggatcgcctgtgccaagcacgccaaataccaacggcttagcggaaaaatcgagcttgctgagatcctcgtaaaagtcttcggtttcttccggaataacgccgccagtccatgtataagtggccaaaaccaatacatcgtaatgcttgatagttgttgggtcggtttgaatcatttcaccaagggtcacgtcccaaccataatgttcaaagaactgctgctcgatccgtgccattcctttggcattgcctgtaatcgatgcatataaaatgattgccttcatcgtcctcacctcattaccttcagtatactgataacatcagggttgtaaaagctttcaaaaaaagcatgcacacgaaaagttgtttttcatgcacatgcttaaaaaattcagctttcacagcgggcaagttccatgaatactcacgacgttgccactacaaaaacgttcaactggcagtttcaacagtaccttcaccttgcaagatgaaatgaacggcatctgccaactcattttccttaaaaaaccgaatttcctgatgacccgaaaaatcatcaatttcgataatcggttcaaaaccattaaatcgtcgtaactcttgacgcagccaagcatcccagacttgtgtggctaagccttgctgctgacccaaattacgccgaatgatgatattcttattgtccaaaattcgaactcgcaattgccgatcattttgatcagctgccaagtcctgtagataagcatagtgttccataagctcaccttacctttcaacaaaagacagcaagctaacagtgtctttgcgtcaagcaaacgacgaagcatcatcgcctaggtgtctatgctaaactagaggcaatgatccaaaaaacttgatacaaccaatgcgctaatggcgctagggggcaatatgacgaattccgaaactaaacaatattcatggcctaaattccggcgctcactgcgctttgggcgaccatctgccatcattcattttatctacttgctagcaattgccccatatgtgttttgggccatttacttcatcgggttaactgcactgctgctggtatcaaaaccaagtatgttgctcgctttgctaagttatattggcaagctattattacttgatcccatcttgcaaacctggcagttactgacatctttgaacttcgccgaaaccggttggatgctactgattgttatcagttattggtgtgtcatcgcaggcattgtcatgcatattgtccaccgcattcgcaaacggcagcttttccatcaactcatatcaggacaggcacagattatcacaaaagcagatcagaccttcgtcatggacaagcaccagcatcattacccactgcttaagcatcccgtgcgatggtggcaggccagtccggatcggcggtggtactaatggttgatctggttaatagcggatcaagaacaacatggtgttaacctttggtacaacttcattatacaaacgtacgttcgtaaatgcaatagctttgtttactgtcgctttgcaattggccattagaagtttgttttaccgctttaatcaagcaactcagtctgacaacgttacgattgaatgtcatacgtgcgcagactggtaaaaatcgttatactgttagtaaaggctcacgaggaggaatcgttttggctgaaaaagatcaaatcagtgcattttcacgggagattattgacttccagcgcaaaaatcatctaacagacacagagatggcgctaaacagccacgtatcagttgaacatatccacaatattaaatccatgcgtgagatgccggattcttccgtcgtcgccacactgaaggattacatggaacataagccaagcggcaaataatgatgccactgaaaagcgcctatgcaaactcattaaagtttgcataggcgcttttcgtttgccggctcagaatagctaactcatgagctaccgattacccaagtagccaatcgtcatcgcacccagcaagataatcaaaacaatcgtcgtaatccatacatataaccgatcgtgttcaactgcaaaagcgtaaatcgaaacgaccactcgcaacaccggggtcaggatcagcaagaagatgcccgtcatcaaaaccgcatacggcttcagtgccagcgtcccagataaaatatcaccaacacgtgttggatgaacgccggtcgcgtatcccgttgagccagtgactaacaataaaagcaggccaagaataatcaccaagtccgacaaaacgaccccaatctgcatgaccttaccgatcatgatttcaacgtcatcaatttcagttttaagttttttgtccatcagatgttcaccccgaatcctttaagtgccatctgaatacccatgtagccaataacaggaataaaaatcagacgtaagacttttgttggcagcatcggcatgatgcgtgagccaacggttgccccaatcaaaataccgatagcgagcggtgccgcgatttgcggctgcaattgtccgccaaaatagtacactgtcgcacttgctgctgccgtaacccccatcatcagattactcgtggcacttgatggctttagcggcatatgcatgatcgtatccatggcaatcactttaaaagcaccgctgccaatgcctaacaacccagaggcaatgccagccccgaacatcatagcaaatccgcctggcacatttgtcacagtataattgatttctttaccagtcgccttgtcaaaatacgcgccattcaatcgcagtttagtcgcaatctcatctggttttgactggcgctcttcaggctccttcagccgcattttacgaatcatgttgaatgcagaaaaaatcagcaaggcgccgaacaagacgtataagactttgccgtccacaagaccagtgacaacggcaccaataactgcgccaacggtggtcgcaatttctagaaacatcgcaacgcgcaagtttagcatctcatcttttaagtaagcaatggtggcacctgagctggtagcgataaccgatacaatactagcaccgatggcatattgaattggcaaccccatcaacatcgtcaaaatcggtgtaataatcatcccaccgccgatgccaagcacggcaccgagaataccgccaagtaaaccggtgaccattaacattatcatttgttccatttatctagcctcgttttccagcattttaggatggcaacgaaaacatcgccatcaatttgttttattttctaaggttagcccacgtggtaacaaggtttcaagccctcaatatcattcccgttgcttaccaactgccgccaaatccaccaccgccactgctgccaccgccaaatccactaccgaaattgtcagaaccgccgctgctaccgctgctggcactcgacccaaagtcggatacaacccaaaggggcaagtcgtattgacttaaatcctgatttttttctggatgccgaatatggaacaagataacgccaaacgtggcagccaacatttcagctgaaaaacgatctgtttctttaacattttcaagaaatttcgaccaagttgtcaccgcagcttgaccagcagcattcttttgttggcctaaccactgggcataactggcttcataaggtctgccttttgcaaaacggtcagctaatgcgggggttaataacgctgctaatgctgaaacagatggggccgccaccacatcttgatcggctaattgccgcagtggtttgcttgtttggtagtagtaccaataaggatatggtgcggtcaaccgcagcacgcgcgtccacgactcgaaaccacgacgagccaaattggccagaccgatttcgcgtagcttggcatgtgaccaagcgaatttgaatagtggtaaggaagctgtctgtcggcgtagcggaatgcctgctgccatcacagccgcatacaacggcatcgcctccaacgcaacggtatcacgcatagcatcacgcaatcgggcagccatcgccatgtggactacgaagaagagtaccagcaaggccatcaaaatcaaagcagcaatcaagattgcctgctgaatagcagcatcacgtgcccgtttagcggttatttgggcaggcgtcgcgatggcactttggtttgctgtcacgcgttgaccaatatgatcgagaaacagtgcgattgcctcatcgtagttctgcgccttcagctgtgttttcacgttcgaagtaacaatctcgtctgcactcccgtctggcacgacgtcttctaacccatagccgacctctagccaatacttacggtcttcgcgggaaagcacaagaagcaagccattgtcccagccttttttgccaatacccaatttagcaaactgatcattggcatagtcttcgatttcgtcatcatcaagcgacttgaccgtgatgactgcaagttgaggatgaccctttaccttggcaaacgtctcattattcaaacgattgaccgccgcctggctcttagctcccatcatgtcaccgtcatcgcgataccatgttcccgaagccgcttgaaccgactgttgcgttgctgccccaataccaagtagcaagacaagcgggatgagccaccaaagatatttgtgcatgtgaacctcctttgacgcgttttgacgcattcatcgaatcgagtcgcgctgtcaaaatttgcaattgttgctctcatgataccatgagccttcgaacagcttacacgccatctggcaaaaataaccatgcagcaaaaacgaccttctcactttcgagaaggtcgtttggctaactttgactgaatttaatccttgacgggatcaatttccacaaacgtatcatttggtacccgtaaaatcgagaaacggtcagcaatgttgccaacatgcatacctaaaccgtttaaaaagcctggcttgtaacgagcagtgactgttgccacgtaggcttgatcggccgtctgatccaattttttcaggtcttttttcgaccatggatagcctgccgcccgcggggtcaacggttgtgtaccggcactaacttcagcattgtgacttgtattttcgtatttagcgccgttagtccagtaagtgtagtacaaggttggattcttaccattccctgtttggacacgaacataaaaggaatgatcctcgccagtttgtaaaatgagatgttctgcgctgtggctaatagctaccgcacgactatcacgataatcaataggccgtaaccagctcacccaaaccatgccaatcgcggcaatcgcaaaaacaagcacttctgcaatgtcaattaacaccaccgagccacgaacttgctttccggatttaacaattgctttaatgtgccgttgccgaatgtgccagacgatgaaaatcaaataggcgatgagtatcacccatgccaacagtccgataagattccacgaattcataattttccccctacgccgtcgtattatctgcttgcgtcacagccaattgccctaacagattcaaataatgccacggtttatcataattcggattgaacagcatgtcgacataagccagctgatcaatcatgttacgattttggatcatcacagaaatgagattagctgcatttacaatatcatattgactataaaactgggcacccagaatccggcgatcatcagtatcatagacgagcaccatcgtaattttgacggtgtccggcatgaatggcggtcgaaaatcatccgtcatcgtgacactggcagccgacaggtgattgcgcttggcgtgagcaagcgtcaaacccgtcacacctaagttatgatcgtacaacttcagcgcgcttgtggcttgcgttcccatatatttaatcgttggtttaaacaagttagcgccagccatcatcccttggcgcacagcattggtggccaaaggcgcataagcgtccttaccagtgggattgaaatggacggcgaccgcatcaccagctgcaaaaatatccggattgctggtctgcatataatcattcacgtgaatggacccatcaggattcatatcaacttggccgatcagcaactcggtcatcggccggaacccgacacaaaccaccgccaaatctgcctgtatttcgcctttatctgtttgaataaaaacatgctgctcgtcactatcaaaatgcttggcaactgtgttgggtttcaactcaaccccacgtgttgtcagggcctcactgatttcatgactaagtggcaagtcaacataatgactaagtaaaggcgaaacaccattaattaacgtgacctgtttatggttgcggctataggcttccgccagttcgacaccaatatacccgccgccaacaatcgcaatatgctcagcatccttggcactttctttgattcgccgagcatcatcgtagtttttacacatcagcacccgcggaatactgacacctgaaatcggcggaacaacaggataactacctgtcgccatgactaatttatcatattgataatgttgttggttgcccgttttaagattttcggccaaaatccgatgatcagcggcatcaatgcttaaaacatcatgtttgagatgaacgtgaacatgcggccccagcgcctctaaagaagctggcgtagcataaaacatatcttccaatcggccaacggtaccttcaaggtataacgcgatgccgcaagaaagaaaggagatgtcttcccgccgttcaaagacatccacttctgtctctgggtgcttcatcaacagttcgcgcactgccgcagttcctgcatgcgtacagcccacaacgacaactttcatcagcatctgccttcctttcaagattgtcaataatgacattatgacacgaaaatggctaaacctaaagcatgtcgctaaccgctttctggcgcttacaagtataatgaaatcgttgcttcacaaatattcaactcataaaggagcgctgcacatgcacatcaccctcatcggcgccggccctcgcggcttattaattttagaacggctactcagctggcagcaaaatcgctttccaaaacgccaactcaccatcgttctgaccgatccttatccaattggcggacgcgtttggaaaatcgatcaagatccgaaccttatcatgaatacagcagcgtcacagatcaccttattcactgatcaaacggtcaccgatgttggtccattcttgaccggacctgatctgagcacatgggcactcacaactgcatctggttaccttgatgctcaccccgagttcaataaccgcgcgatcctattgcggcaagctgctgcactgggacccaacaactacgcttcacgggcgctttatggtgtctaccagcattggttctttgacatgcttgtagcccgcgctggtaacaatagcatcacgtttaagcagcaaaccgttgtcagtttagctaaaaacgccgctaatttcacaattaccaccgatcaaggaagctggcacacagaccaagttgtcatggcgctaggcaacctcaagaattccttgacgcgcgatcaaaaagcattggacgattacgcccacgctcacgatttgttttatcttgccccaggtttccctgaagaaggcgaccttagcaccatcgaaccgcaggcacctgtgatcattcgcggactgggcttaagcttctttgatttaatgagcaggttaactgaaggccgcggcggccgcttccagaaaacagcagacggcttgctggcctatcatcctagtggtcgagaaccgcacattttcactggttctcgacgtggttttccttaccgggcaaaaggtcgcaaccaaaaaggacccggtgaagaatgggagccacagtttttgacgactgaacagatcaatacttggcaagcacatggcgaagtgagcggtcaaaccttctgggaagcattgcaacacgaagttgaactagtttattatcggctcctgctagtgcaacgctaccccgatctagacgtgactgcctttgagcatgacttcgtcgccaatcctgttacgacgctaggcacattgccaattgccgccaaagatcgacttgattgggatgccttggctgatccaaccaagtggcatccaagcggtcagccttatcaagactttatgcggcattatctgcgtcgagatgcacgcgaagccatgcgtggcaccaaaactggaccattaactagcgcactagaagttttgcgtgatatgcgcgacccgattcgccagctcgtcgaacgcggtttgttgagtcaagatcagtacctcgatttcttcttgcgctggttcaactcgctgaatgactttctctccattgggccgcctgccttgcgaattgatcaattgcaagccctgctaggcgctgggatcgtcactattttgccaccggggatgcaaattaaaggcatcgatggtcaatttttattgaaaacgccaagtgatcccagcttttcggttcaggccaagagcttactcgaagcgcgtgtgccggctgtcaatgcgccaactgcgcaaaacgcattaattcagcaactcttgcattacggctatgcgcacacatatgagctgcagttgaacgctgacaagcgattccaatccggcgccatcgccgttgatcgccaaacccaacaactgcttgacgccaacgaacaccctcaacctggtctcttcttctggggcgtcccgactgaaggcgtacattggctcaccactgccagcccccggccactggtcaatgacactagtttgaaaacggcagaacagattgtgcagacaatttggactatgccaaaaccgtagccttatcttactcacatggatcaatcccagaaatgggattaaggtaatgacgagaactgagagcaaaatgagtttgtttttgccgatgaacttaaattcatctttgatcatgtcgagttactcgggtctgtactagaatttcggacagaaacataagagaattgatttatccgaaaatggcctttatggtctagtcgtcagggtgttgcacttgaattgtaaactggggcaattaatatatcccttttagacgtgcttttttaggaacactttttcgacttatctgtttatatctaacaaccccataatatttattgtaggtaaggcgaattatttccccactctttaaatttgtgccttttatttgaatcgtgttgaacttcatttggcgaggcttacctgatgagtctctagcaattcccttatattcatagcttatcaataatgtattagatattggaaaattgatcggggaaattttactagggttatctatttttatataataatcgactccagaataatgatacccaataatgaaagctgaaaatatgataacgcctattatggtggcaatcatatttaaatgataaagtttgtaagtattcatataattaaccaaaacgcaattgtttgaagttagaaaatcaaattaaaaacaatctttagtccgtttcattgatgtaaaaaggccttctttttcttactaaattggtatttgcataaaatgctatttagtaagagaaacaggccttatgagtattatcaacttagttaaatgatccaaaacagaactaattaagtgaccagcagcatttaattcaaattactgttctgaatgccttggcaagaagaacagtaaaatttttaaatcctgtttgatcggcaacgattgcttacgacaaagagttccaggaatcacgttttttaagcgtactttctaaaaaccgtcagtataacgaaggctttcccagaaacctttccaaagacttttccatgcattagtcgggtagtgcgttttccccccagaaattaatgctaattctttatcagttaacgttttttgatgagatgaaatcatctaattacctcccatttttcgaaaattttttaataacactattacagtatagtctagttttcataatgtcaattaaaacgttgtttataatttgaatcgtgctctgaagtttgtattagaggaaatgctacaatctaggagaagacattgactaggttctaatcctgattgaatagccgatccctccaaaaattgaaatacgttttttgaccggtaatgattgaaaccttgccggtcaaaccgtagtgcaaagaccgagcctgttgcttactgagcgatacgtttgccgtcaccataaagagattgccatttttcgtaatagttggggctgtatcgatgtttgaaacgataccattcaggattatcggcaccggaatattgcgcgaaacctgaaggcgaaccttttgaccttgtttaacgcttgtaatctctgttggggaaacggctagtgttaatttaatttgtttttgatgctttagtacaggatatatttcggctaaagtagtggctgttgaactaggccaccatatcttcgacccttgtagtaaatttataaacgcggttctgaatgtctcttaaaatctgtctcaaatattgacttcaatccaagaactggccttagggttccttgcttggctgctagatcaacatcagcttgcaagctaggccgcattgtcttcgctctttcagcattagccagtagtggattggacttctcccaagtctctggcgcaaaggcttcgtcccggttgtcagtttcgaaaatggcaatgaaataccgatcagcttgttcgcgaccggttaagattttggagacaaatttatattctttatacatagggccattcaggtctggccccgtagttgagattagggctagtaggctattgtccgaattgatctgtcctgacttcagtgtccgtaaaatctcatcagtgcgcgccagggcaaactcatcgacgacggccatatctcccgcccaaccatctaggctgtgcagatcagacgcaagcggaacagcgcggctgttgctcggcaagtcaatgatttcgttacggttgatcttcaaacgatcacgcaccgatttagacaccttgcatacctgacgcaaaccactagacagcatatcaaaggctaagtgggcttgggcgttgctgttggctgtgtagacaatctctcggttcatggctggcttgttttccatgaggagatacagcgcgccgaggcaggccattaggtacgattttccgttctttctagccatcgatatataggctcgatcataacgacgattgccggttgccttgtctctccacccgaacagctctgataccaagtatttttggaaaagttctagtttgagtggtgacccatcacgtgccggcatcagttcgataaactcaatggctttgttggcaaagtcctcatcaaagtaatacggccatggattcttcttgcgcttgctggctttcaaatctctgcgataacgtctcgctgcttgcttgatctttttacaagcaacaatctcaccgcttagcaccttgtcagtgtattcagtcgcatagttcacgatgacatcagctccgcgaacggatcgtcaggcttcttcttagtctcattcttcactgccaactttgcccggctgtagactgacaagccaagcaagtcatcaatacggatcatctgattagtggcatcaagtttcattttgactgctgggttagctttcacactatcggtggtttcaaccatcatgccttgttctttaaccagctcggcagctttctgaatgtcagaataggcttggcaatgactggcaatcagggcagcatccagttcactcactggaatgtcttttttgagcaatggtacaatacgctgccattcagtcactgcatattcatcaagccatgtagggggctgatcaactaattcttgataggtgaatagtgattcttccatgtcacgccggtctgccagcttctttttactcattgcaccgcgcatttgcgtaatagatttcagtggtgctcccatctcgatcacgtcctttctttataattacaattagacttatctaacttaattataacacatagtaccaaatacccatgatatattacggttatcacggattttcaacaacgaaactcctatgcttggttcccgagactagatgacatagcccccgtatttatgtgggggtagcgtgccgcgtcttctactttcgttttggttccgtggcaagcattacacagactttgtaagttgctctcgtccagtctgcggttccagtccacacgtatcggcactcgatgatctaccacttcagcttgtacgtataacccctttgcttggcatcgttcacacagtggatgtgctagacgatacgagtaagacagcttgcgccacgctttggacttgtagaacttaaagtaacgaccaccaattgctttgcgatatgcatagcgttcgttgtcggacgctcgtggttctggcttgtgcttatcacagtaccgttgattgaacggcaccatggtattgcacccagcatggttacacagcttcatgatcatgccaatacgcctgccatttcaggttcaggcttatcgtcgcgatagtaaagctgaacggttatcatattatctggtgcagagaatacccgaatgaatccgacttgccacctgtgtaacatcatgaacttgtcgatgataccgtttagttctccttgatacgcagtatattcaaatagtttcatagttctaagctcctttggttgtcttcttgagtgtcacaacatcgaatgcattgggatcatcatcgtaggcaatggactgaatcgcgtacagcgtgccattaagttttacctgtgtgctgtcatctatcgcgtcagtgtggcgtactacgatcgctatagtgtccgctaggtctgtgcctgtgatctggtaggtctgtgtaacagtgcggttatatgatccatagaacagggtgccagtcggctcaaatgtggagatgttaatacctgcgccagtcttatggctaactgtcttaccgatttcagccaccttgttcagacgggcaattgaatagttcttcatgctattcctcctgtaaaaatatttggtaaaatcgcaaaattttcggtacttcggtgataagcacttataaacgcctatatatcaacgctctactgtcaccgaacttcaaatattttcggtgacgtgtcaccgaagttttggtgacacaggattgatagtaactgtcaccgaacttgttttttctgtattcgttgagcgcgtaaggattgaacgattgtcaccgaagttcggtgacgcccgtcaccaaaaatattcgcgctaatcccttgagcgagtaaggttgtcaccaaagtgcagaaaatatcggcattcattttgttttcagttgaatcttggatttagcagtgatcccgttagacgcaaaccgatgtatcgccgtgtactaccggtgtcattgtcaaaccctctgcggctgcttacctttttcactccgtaggcatcgagcttcttggttatggcttgtgtcgtcgttctgtccatatagttgttgtcttggcaaaagcgcttgtattcggcagtaaccactgtagaggcctcgccacgatcatcttctaggttgatctcggcatactggtctaggaactctttgaagtggtcgtttgcatccagccactcttggcttgcgtttactaccgaatcaggttttgttaggccaccgcttttaagcgccttggcaaacatatgcatgcatttcatagcgaagcgtggagtttcttcgtccatcttggcatcgtcaaactgatcccaccagtgtgtatgtcgggtgtcaccgttaatcatcttgatcacggtcacccgatcagcaaagccactgcaatgatcactgaatgcgggcatctcgtttgcgctgaacaacaacttagcataattcataaacttaaagttctgaatgcctttaaactctgctgctatataatcaccaccagttagcgacttaatcacggctgtactcttgaggtaatctgccccaacgtctgccacgatatttgcttccttgccgtataggttggctgtttcaaaacgacggtcaccattggcaaggtctgctggttttgatgctgacacattgtcacgcccgatgaggttagtaattctgcgaataagtgtgcttttgacttcaccaccggtaccatacaaccacagaaacgcttggaatggacggtaagaccgatagaacatataaccaatgaattcctcaaatgtgatcgcggcatcgcccatcatagctgcaagcagtcgttcagtctctgggcaatcgtccctatctggatcgaccgcgtactcatgagcgttcagcatgtaattgtcagcgctactttcctgcatcttgttggtcagtatgctgtatgtgccgttagcgaatgcaactagttctggatgtgggttctcatcaaatggtgatcgcttgccgtattcctcgttatagctgatacgttgcaagaatcgtctggcgcctgtaatatcactttcacgatacagcccccatttgagcatctctttggtggttcggctctcggtggtcttagtgaactcacccttgccaaatgtgcgccatgttcctttgctaggctcatatatggcaccttcactcaacccagggaaactttctactcgtgttttattcatgaagtgatatccataggctaagaagtccaccttgatgtgccgatgaatgatcacacttttaggatcgttttcgtctttctgttctgactgaaaccacacttttagccaacttggcagctttttcgccagttccttgttgtacgctcgaattcctttttcagtcctatctggcggatctggatacttgttcacgtcaaatggttccaatgtgcttttagcaatgactttaagctgagtaaactctggcgacttgtttagttcttcctttaagctgtccgtatgcttcaccccctaacttcgacgcgcgatttcgcgcttgctgattgaattgatgattttgactagctcgccattaggcaaggggggacgcacatagcgctgattgacagtttgaatgagatcggcacagttatctggatcagctccggaacgaaagaccgaaccagcaatacttgctaaccactgattacggttgccttcatctgtaccatctaccagacgattaatgaaatgtccaaaccatgaatctgtgttgttgtggtaattactcatgttagggtggagctgacgttggatttcatctagtaaccactgaggcactggggctaatttggtaatcttgtgccctttaagtggttgatacatgccgttctcgcgaatgctaggaaaaaccggcacaccagtcgcaatatcgtcaaggccggttttctcgctattcttagagaacaaatccgatcgactagttagcttcaattctttgagataggtgaagaaaatatgaagtccgtacaatagccttaaaagttgtcactttaagaaataaaaagtgatgacttttaggatcaatagctggttagatggtcatctctcacactgtttgcaccagatccatcggtttctcccgacctctctggatttattacattttatgccgcgtgtttaccacgcttgaaacctaataccatgcctaacattccaagcaacactgtcaatccagcccacactgcgttgtcctcattggattcaccagtcttaggtaattcccccttagtgttgctcgaattggtaacgcgttttctagaaaaatctactggagctaacccaccattactctcagttaattgagctttagttgtgtcaattacaagccctatagcatttaaagtctggtttttgtcattgaccagttgccccttagcgttaatgtgctgacccttgttgttggtgtagtaaccttgggcagcaatttgggcttgctgtttagccttttcagcttcagcattctttattgcttcttctgcctgctcgtgagcgataatcttattcaatgcggattgagcatcatctagtttctgcttagcatctttctcaattttgagagcatcttgataagctttttgagctttgtcattcggcaccttagcatcattcaacgccttttcggccttgaccaattctgtaactgctttatcatggtcagcttgcgcttgtgcaaggttaatgtcagcgtcgttcaattcatccagcttaatttgtaaattctgcaatgttgcaacaccttcagccaatttagccttatcagcatcgagtagatttttagcctcttccagtgctctctcatcgctttccagtattgcctttcttccctcagtcaggctgtgcaacttactagcctcaactttgctatctactaataactttttggcattattcaagttagcaagcttctgactgatatcagcattcagactgtcaactatcttttgggcgtcagatacagcagtcttagataattctaattgcttattagtagttgttatattgagcttagattcactcaatgcggaatttttagcttttaaatcactattagcgttatccaacgcctcactcacaacatcaaccttagcttgagcattctgaaaggcaagcttagaagtgttagatttattttgaagaatagtcaattgtgcagtctgcttattcagttcatcagtagctgcttcaatgttctttctcaattctaaggtgctgttaactgcatcaagatatgaaacaccgttaatcatgcccttaatatctgtgccactgagatccgaatggactttgaatgcaatgccattaatcgtaccagtaatatccgcactgtcaccgatcgaccgaacagtatatgaaccattgttcgttacataagattcaattgagataccgctttctgggcccaaagaacgcgaaatactgtcaatcaaactaataatagaagcaatggaatttcgattaagcgcatccttagcagcctgtagtttagtttgagcagtttgaactacttctgattgggcgtcagttactttttgatcctgattcgctttagcgagcgcatccttagcttcttgatcaattttagctttttccgctgcgatagaggcttgtgaatttatagctgcattgactgctgcttgattagcttcatttttggcaattgcatcgttagcagcctgttcatcttgaacttgttgatccttagcctcggacaacttttgttcagccgccttggcatcagtaccattaactatggcttgagcttgatctacagcctgttggttagattgaactatttggttttgatcattttcagctttctgagcgttttgaacggtaacattggtctgattaactttattctgtgcttgtttaacagtttgttgctgatcagtaatctgttgtttgtttttcttattctgttcttgttgatcagcaactgcttgttgagcctggttgattttgtcaggagttgctttatccttggccttctgtgcttggtcaacttgtgctttggttttatcagcgttagtttgtgcagtttgctggttcttggttgcttcatccacttttgcctgagttacatcagaggcattcttagtagtatcagtttgttccttagcttgattataagtagtttcggcattgtcaactttggtctgtgcttctgtcttagcgtcagtttgttgattttgctgggtagcttcttgagcagccggtgtcttttcgtctgcgctcacgttctgtgtgttcgtcaatgaattactaatagttactgccccggcaactgcggcacccaacaatacgacactacgcgttttttcaactgtagtttgagtcattaaaattacctccacataatgtatctattataatttcatgcgccaaatccattatcacctaaaataaacgaatgtacagcaaaagcttatttttgcgttgatcccaacgtgccctgatcttctactgaagaataaaaacagtggaataatgactatcaagccacgattaaaggaaagaaacttgctgacaaaaccgatgattttcacattaggatatcaataagcactggccgattttgaccatggtcgtgtttttcacgactattcagaaacaaggataagctttggaaacattgtttctggcaatcgaatcagggagatcgctgattttatcagggggtataattcggcaaagtacgaggccattgaaaaaacgaagtgagtcgagaggaacatcatcaagcatttgttaatgatagggtgtatccgttcggacgaactttcctgaattgacaatcaacccaagcttgtgggagtaccctaatttgtagaaaaaagcttgtttttatggtaccaaatggtaccataaagctagaggtgatttttatgactagccaagtacatttcagaatgagcgaaaaagaaaaaaaggacttcgagattgtcctaagtcgtgtgggattaactcccggagaagcctttcgtatctttgccaagaaatccattgaagccggaggaattccctttgaggtctctcagccaaacacacgtttaaaaaaggctattagaagtcaagattacgttgaatttaacgatcctgaggaagggctggattggttaaatgaataagtttatttataaaccagcctttgaacgtcaatttaaaaaacattacaagacgattttaaaaggggggcgctataaaaaagaagattttgaagctgtttatcataaactattacaagatgaaccgttagatccacattataatgatcacgctttggttaatcgtaaaccagagcgtgatttacatatcaagccggattggttattaatttacaaatatgatggtgagtttgtgcgctttatcgacacgggttcgcattcagatctttttaattgaatttgcatttgaatcatcgccaacgtaagacctgcatagttcaacattgatatcacattagggtgtgatcttttgggcagacttcataacaaacttttttaataaagactcctatgctggaattacgaacagaaatttatgcgatcattacagcatagcaacttaaaaaaataaaagttcaaggaaaggctgttatccataagctaaatacatcagataggctacatatctatactttacaaagactgtcatgggagatggtagcatgaatgagaatcataaggagagactgtggctgacatcctttttggctgcaattgttgcaacaattgctttttcggtttatatcactgagtatcaatatggtggtgattcttactacatgaagattgatagtcagcctattatttcaaacgttgaagtacctgttggaataggatcaatagctggttagatggtcatctctcacactgtttgcaccagatccataataactagtgttcaagaaaaatgggtcatcaaaaaataaacgtcgtaaaatccccttttttcgtcgtattttcaattttttgacgatagaactgacaaaaaaattgaaaatatcaacgttaaaatttaagtcaccacaaaagcaattgctagccgtatattgtgtgtagggtagctagcacccccgaccgttttacctaagaaccaaatgtttagcaatgaatcactcaaagaaaatggagggataacaatgcaacaattcatgactttagataacagcagcttggaaaagattgctggtggcgaaaacggtggtttatggtcaatccttggtctcggtcttggattctccgcacggcgcgctaatagtttgtttgggcctactccagaaatggccttagatcttatcagcctattcaaataatacattcctagctaaacagcaaaaggaggatgtgcacaatgactaacttagaagataaagaacttagccagatcactggtggctttgcatttgtgatcccagtggccgccattctaggattcctagcatcagatgcgtggagtcacgcagatgaaattgctagtggtgccaaaactggctgggaaatcgctaacaagtacaaaatttattgatttgccaatcgattcgtagaactgcccagcaatctcgtctcattcgaaagctgatcgcaagaactgatccttaagaatagttgcttgatatactcaaggatgacgacatcgaccaacttagatgagattttttcaactttgtatactattttggtttatcaatatgatgacctagcttgcacatggcgatagcgtacgaagaaatttactgatagtaagcatcgtacctatgcttactactgcctatccataccatatatctcttaaaagttgtcacaagattgtcggtatctgcgccattgctttagttacttcaatcattttaacttcgattagcagtgaccagagatagctcggcgtctcaaatagatgcttcaatttaagtttattctttgtcacatgtttggttgatcgacaaacgtgaaagacaattttggatcttttattgaagtgcctgctcatgggatgtttaccgaagttcatttttgaggcagcaattagttccattttcaaaatccagacaacctccaactttcttgatttatcaagaaagttggaggtatttttgtggtagtcattttataggcacttattaactggatgcgatgtggttatagcaagcctaattcttttattgattgatccttatcacgcccattcgaagaaagagtgtaacagataacaagatattaggttgtgataatgcggatttatttctagtgcaacgtagacaaaatcaggaattttgtcgatgccttgtctatcataaactagtgtaaaagccgaagaagtaaacgtcgcaaaattgtctattccgcagtacttttgcactttttttaaaagaattaacgaaaaactttaaattaccaacgttaaaaattttaggaccacagaaccatttgtcggacgtatactgtgtgtaaggtagctaagcaggtactgaaaattagtggacttgttacttggcatggtgttaaaaggcattgaagcatgatattgagctttggctaccagctgggaaagtgggcagtcgcttaaatagttaatcaggaggtcaacatgatcataactggagataaaatggcaagatttattggatggctcggtattgtttttttacccgtgtacatgcttgcctttgcattaaaggtgattcctaaagttgacgttatcgtcccgttgttaatattaacaacttcttctttgacttttgcttcttcaaaatcgggcaagagacagggcaagttaaagaaataggtttgagaatctgtcgcttcttaaaagttattctaaaggtgtcatcaaatagacaggcgctgcaatcaaggactgaaacagtttttgattgcagcgcctgtttctcatgaactaatcagctggactaaggtgtatttatatctcaaaattaaacagcattaatgagtaagcactgctgtaacagattcacaggaaacaacactgaatctgttgtcgtattcagcagttaaatgaaacagttactagaaactttgatatttctgccaggttatgggaatatcggagttttttcaagttacctttattttcatcaccgtttagattcgcttctagtagagacacgaaaaaagagatataccattcaagcatcatttgacagatcattggtagcagactgtggtttattcgcggtcatcatgacctgacgcagggccgacactctacgaatgctgacctcaagtttgtcttgattatccatgtaaacaaaacggccatgcgtgtccaatttagaaatatgcgttgggttgagcaaaatgcttcgatgacagcgaaacaatgttgggtattggagcgatacctccttcaggtttcccggaaaggttgcgatttcgcgttctgcatgtagttccaacgtgccagagataccaggggttgtttgaatgtaaagtagctcatctaatataactgtaaagagatttgaatctatgctgtaattaaaaagtcgtggcgattgcaattgacgcgccttcaatcgcttgatggcgtaaacaatatttgatcgcagtcgagcttcaacttcaaaaagcacacttttatcaattaagtctaaaggtgcaattttgtgggccagaatcgacaaggcttcttcagtgtgactggtgatgaacatgatgtcagcgtataaagacttttttcgaaggatggtggcgatatcaataccacttacagaagatccagggatgtcaatgtccagcagaaaaaggcagtcattaatctcttctagatcaacagcatctaacaaatctgtcgctgactgagtggtgaatttgatttcggcatgcaatgcctcaatcataatataattgcgaagtgtactttctaggaaattcaagaagtcagcattgtcttccagaatgaaaatcttcagcatcgtttggtggttggtcatgaagtcatctccctataaacaaagtgatctttagttgcttgttaataacggcctttttaatgatgatatttttattctgctggattaactcatttatgatggtcaagccattgccatgcccgcggcctttggttgtgaaaccgggttctgcaaattttgctagattgaaatcatcattgatatcgttgacgacgcttgcttctagcccccgatctgaagccactagcaggacgctgaaatgagtcttgttaatcctgatagattcttctaaggcgttatcgattaagataccaagtgctctgatgacggcaaaaccggcattattactcagcggttggattgttccttcggtgtggatgtgtaatctaataccactattcgtcgcttctgaccacttcaaatagaggagatttcgaagcggatcactttcgattgctgctaatgagtcttttccactttcagcttgttgtattgacctttgagcttgcgcgatgatattgctcgtgtcagaagattgacttgctgaagtttgttgcaatgaaagttggagcgttgctagtaggttcttataatcatgaagaagcttgctagtattttccctttgttggttaagtgatgcatagtaagctcgtcgtgattcattggtgtgtttaacgaccagtagctcaagatagtatcggtaagatctcaaaataaaaaatagagagcataaattgacaaccatgaaaaaaatgaaggcagatagtatgagtagagcaagaacattatcaagctttaggagtataaaggtaaactctagaaagtacatgacagtgcaagaggcacctaggtaaaagatagccgacatccaaataccatctttttcttgaaccaaatgacgcatattattgacaatttttttcctcgtaccaaacaaccaaatagccaatatgagcagtacgatattggtgattaatttagacgttatgcttataaagaaaaagttattggtcattgataacgtgaagaacttttccagtagtgtttgaaaattgacaataatcaagttgatttccaaaaataggaaaacccagaatacatcagatcggttatgagtttttgacatgtagtaggcatagatcaatccaaagaagatttcaccaagtagcgatagtgttgtagacaacactatcgctaagatggaccaaaaaaaatgtgaatgagattaattcggttgaaaaaaatatatgacggaaacgttatgcctaggatgaacacgggtgatgttaaaagaatataggctagatcagaataagtttccatggagttgacctctgaatgctgagtagggttaaaaaatcattgtaacaaactaagaagagacgtagaagcgacgttaatcggcgaaaaccctacgtttatttttggaaaacaagaacaagccaaaagtctgttacattgaattcatgtaaagcaaaagaacacttcaacttgaatgaggaggaaaaagaaatgaaacagtttgatgagcagaaaatggtcaatatgagtgacgaagaacttttgggattcattggaggtgacagcatccgtgatgtttcgccaacattcaacaaaataagaagatgatttgatggtttgtttaaataaatcagggaaatcgtgtttacgaggtttcgctcccatctaaatcattaaggtagatgacataaaggtaaggccggtaaccaacttgttctggcagctctttaaaacaaaggaattagattattgatcatttgtttaattaaaagattatattactacgataataatatataaaaataactttatatattattaaagcggttaccgcgttatcggtgacagtatatcatatcttttctaaacaatttcatgctttgcacaattttcttggattttaagttttatgttaaacgcttttacagagaaagtggtgttccacaagccttcgcagaatttgactgattagtggcttctgggacagtcttctcctctgtaaggttaagggttgtcataacgacaacccattttttaaacagttcaaggtatcacttatttagaaaaatccagcaccaaccaggaggcatgcccatgatccatggcctttttggtctatttaattatgtgttgcacttagattgtaaacgcgggcgctatttcgattcataaagctacagaaaaaataatagctctgtatcacttagaaagacaaatacaaaatgttttttgtctaattcatgattcgcgagttttatgttctaacaaacaacctttttgaatagccatgattgttcagctgtgctcgattcggtgaaacatttgacattcggttttttttaccctactatatagaaggtcaaacaaatacggtgctttccgttaggtgaggctcctatacgaacaatgctgctgctcagaaacatcgagagatgccaattgagtcaactgcgtctgcccattaaggcttacgctaatgcagctgaagctcgcttctaggcgtatagtgctaaaactaaacgattgggatgctttttctgcacgctctcaatcggcgtgcattttttttgcctaatgaaaagctgaggaaaaggtggtgagcataatggaacaatcttcaaagagtagcggtagtagtagcgatttagctgatcccggaaggcccattgtgctgccgctacgatctcttaagtgaaattaatggatttggcagcatcgcggtccttctcgggaaacgggaaggagtttgtcgatgttgatgatggtttcgagtggcctgtcacgctacgaagcgcaaaaggcccaacaaacagttacaccacgtcctaatacgatcaacaaggcaagtctcttcttaccgttgttgatcatgactgccggtgtcagtggcttgatcagtgtgatcactcgcaactggcttcttacagttgttatcggcgtgtcgcttagtatgatgatggctgtgatcgtttatctgctcacagctgctacccgacatcagggcgatcccaaacagacggttttggttgtacgcgagggcttggttcgccaagtgagcgcaaatgaccttgtcgtcggtgacgtgctgatgttgacgacaggagaaaaactgcctgttgacgttgcgttggctcccgatgcacacgtttccttgccaagtgatttggccgggctgctggctttgatcggccggcaggtaccagcgggggtaggcattgctggcgctgtgatggcgaccgatgcccaagcaaccgtcacggcggttttgcgtgatggtcttgtcgaccatgcctttgcacaattgaacggaaagacggaaaatcatgcgccagcttcacttgtaacgagtgcggcagttggttttgtccttgcgctaaaacagatttttcgggtatccggcattgctgtatcactcctggcaagtgaattgttaagaagtaaacaagtaaatcgtgcacagcaggttcggttacatgccgaccttgcccaacacgccaccttggttggcgccatgaaacatcacagtaaaacaagtgattttcggcacaaccaagatccggtctcgtgaagcacgctaatgaatccattaaaagaggcacgcgcttgtgaagcgacgtgctctttttgtgtcttattttttataaggttctgttatagtcccattcgttaaaaaatgaggcacaacaagctcggaaaaggattcccgccagtgctgaaataaaacgcttgcaaggataaaaccgcaatgttacgcttggtttgtaaagattttcattagtacagttttcctgcgttaatgacaacaggaatggaaagaggttctgattatggcaaaacagcatgctgcagttgatttcaagaaactgttggaaaatcaagatgccgattttaagccgaccatccaaattctggatgaagcgggcaaggtcgtcaatcctgatatcatgcccgatctgagtgatgatcagttggtcgacttgatgtccaaaatggtttggcagcgggttcttgatcaacgagcaaccgcgttgaatcggcaaggacgattaggtttttatgcgccaagcgctggtgaagaggccagcatgattggcagccattcggccatgaaaacaacggactggttgttacctgcttaccgtgacttgccacagttgattcaacatggcttgccactggataaagcattcttatggtctcgtggtcatgttgccggtaatgaatacccagaagattttcacgcgttaccgcctcagattattattggtgcgcagtacgtccaaacagccggcgttgcactcggcttaaagaagaatggcagtgatgaagtggccttcacgtataccggtgatggtggcacgtcacaaggtgatttctacgaaggtgtcaactttgctggtcatttcaaagccccagcaatctttattgtgcaagataacggctttgcgatttctgtaccgcgggccagtcagacggctgcgaagactttagcgcaaaaagcagttgctgctggtattccaggtgtgcaagttgacggtatggatgccctagctgtctatgaagtgacaaaagaagcgcgggcatggaccgccgctggtaatggccctgtcttgattgagacgctgacctatcgttatgggccacatacgttatctggcgatgatccgacgcgttatcgttccaaggagacagatgagttatggcaaaagcgcgatccgttaattcgaatgcggaactacctgactgataaaggactttggaacaaagacaaggaagacgccttaattgatcaagttaaggatgaaattaaggacgcaattaacaaagctgataaggcaccacagcagacggtatctcgcttcctaaaggacacgtacgagaccgcaccgcaaaatgttgctgaacagctggcagaatttcaaggaaaggagtcgaagtaaccatggcacaaaaaacaatgatccaagccatcacggatgcgcttgatgttgagttggcgaacgaccctaagaccttggtattcggcgaagatgtcgggaaaaacggtggtgttttccgtgcaactgatggtttgcaagcaaaatacggtgaggatcgggttttcgataccccactagcggaatctggcatcggcggtttgtcgattgggttggcattgaccggttggcggccaattcctgaaattcagtttttcggattcgtttttgaaacgatggacagcattggtggtcagatgtcacgaatgcgttaccggatgggcggcactcgctcaatgccgatcacgattcgggcgccttttggcggtggtgttcacaccccggaaatgcacagtgacaactttgaagggttaattgcgcaatttcctggtatgcgtgtcgttattccaagcaatccatatgatgccaaaggtttgttgattagttcgatccggagcaatgatcctgtcttgttccttgagcatatgaaactatatcgttccttccggcaagatgttccagagggcacgtacacggtaccgttggacaaagcggcggtgacccgcgaaggttcagatgtatcgatcatcacgtatggtgcgatggttcgcgaagcgctgaaagctgctgataatttagccaaagatgggattcaggctgaaattgttgacttgcggacaattgcaccacttgatgtcgaaacgatcatcaattcggtcaaaaagacgcataaggttgttgtggtgcaagaagcacaacgcatggccggtgttgcatcaacggtgatcagtgagatttccgaacgggcgattctgtcgcttgaggcaccgattggtcgggttgccgctccggataccccgttcccatttggccaagctgaaaacatttggctgccaaatgctaaggatattgaagctaaagtccgggaaaccgttaatttctagaaagaagaggtgccaacatggcttttgaattcaaactgccagaacttggcgaaggtttggcagaaggcgaaatcgttaagtgggacgtcaaacctggtgatgacatcaaggaagacgataccttacttgaggttcaaagtgataaaagtgttgaagagattccatccccggtctccggcaaaattttaaaaattcttgttccagaaggggaaaccgcgtcagttggtgatctattggttgaaatcgatgatggctccggaccagcagctgcaccggccgcacctgcgactgcaacagtagcccctgcgacacccgctccagcaacgtctgctgtgcaacctgcacctgcgcaatcggtttatcagtttaagttacccgaactaggcgaaggtttggcagaaggcgaaattgttaaatggtcagtcaaacctggcgatcaaatcaaagaagacgacacgctgttagaagttcaaagcgacaagagtgtcgaagaaattccttctccagttgccggaacggttgttaaggttctggtaccagaaggcgaaaccgcgacagtcggtgaagcgctggttgatattgatgcaccgggtcataatgacacatcggttgctactgaggctggtgctgcaccgcagccagttgctgcaacaccagcagcgggtggcgtgccggccatcaccgatccgaaccgggaaattttagcaatgccatctgtgcgtcagtatgcacgcgaacagggcattgacatctcacaagtgccagcaaccggcaaacatggccgaattaccaaggctgatgtcgatgcattcaagacgggcgcaccagctgcatctgcacagccagcagcccctgctgctcaggcacaaccgcaaccagccacagcaaagccggttgcaccggcagcaccaaagccgcaagcagttgcaccatacgtttcgagtggtaatgaagctgaacttgaaacccgtgaaaagatgaccccaactcgaaaagcgattgctaaggcgatgcttgcttctaagcaacgtagcccgcatgtgacgagttttgatgacgttgaagtttctaagttaatggctcatcgcaagaagtacaagcaatacgcagctgataaaggtatcaagttaaccttcctgccgtatatcgtcaaagcacttgtgacggtgttgcgcgaatatccagaattcaatgcgtccattgatgatacaacggatgaaattgtctataagcattacttcaacattgggattgcaacgaatacggatcacggcttgtatgtgcctgtgatcaagaatgccgatgcaaagagtatgtttgaaattgctaaggaaattagtgaaaatgcccagaaggcttatgacagcaaactaaagctggatgaaatgcgcggtggctccatgaccatcagtaacgttgggtcaattggcggcggctggttcaccccagtgatcaatcaacctgaagttgcgattctcggagtgggcaaaattgctaaggaaccttatgtcaacgaagacaacgaaattgtggttggcaacatgttgaaattaagtttgagctatgaccatcgtttgattgacggcgcgttagcacaaaccgccttgaatctgatggataaattgttggcagatcctgatctgctgttgatggagggataagcatggttgtaggcgattttgcaatcgatttggataccgtcgtcattggttccggccccggcggttatgttgctgcgattcgcgcagctgaaatgggtcaaaaggtgaccgtgattgagagcacgttcattggcggtgtttgtttgaatgtcggctgcatcccatcaaaagctttgatcaacgcaggtcatcgctatcaagacgccttggaagcaagtacgtttggcattaatgccaaaggtgctgaccttgatttcacgaaaacccaggaatggaagcaaaataaggttgtgcataagctgacaagcggtgtgtcgatgctattcaagaaacacaagattgacacgattatgggcacggcgttcttaaaagatgaccatagcctgcgcgtgatgcaaaaagattcagctcagacctatacgttcaagaatctgatcatcgcgactggcagccggccaatcgaaattaaaggctttaagtttggcaagcgcattttagattcaacagggggtctgaatcttcctgaagtaccaaaagaatttgtcgtcattggcggcggctatatcggctccgagttggcgagtgcgtatgctaatcttggcgcgcatgtcacgattcttgaaggcacaagttcgattctgccaaactttgagaaggatatggttcagctagttctgaattccttcaaaaaacgtggcgtaacagttattaccaatgcgatggctaaagaagctgaagacactggcaaaggtgtcaaagtgacgtacacggccgatggtaaggaacagacgattgcagctgattatgttatggtgacggtcggacggcggccaaatactgacgatcttggtctcgatattgtcggggtcgaaacaactgatcgcggtttaatcaaggtcgatgctcaaggccggaccaacaaaccgaatatctatgcgattggcgacattgtgccaggtgcggcattggcgcataaggctagctatgagggtaaagtcgctgccgagtccatcagcggcaaagccagtgcggttgactacaaagcgatgcctgccgtttgcttcacggaccctgaacttgcaacaactgggatgacagttgccgaggcaaaggataaagggatcaaggctaaagccagcaagttcccatttgctgccaatggtcgtgccctcagtcttgcccagacagaagggtttgtccgcttggtcactaatgaaaacggtacggttatcggcggccaagttgctggcgccggtgctagtgatttgatttccgaactgaccgttgctgttgaaggcggtttgaacgttgaggatctggccttgaccattcatccgcacccaacactgagtgaagttatcatggatgatgctgaagttgcattgggactctcaatcaatatttagtatctgatagagatgtcatgaaacagtctgatcttcttgatcaggctgtttttgtgtcatttggttgtcgctaatggcgaatgctgtgagtatggcaacagctaatttttacaagaagatgagaaacggctaatatttcagttagttaacaattgcgtctaaacccctttttaattttgtcttaagattctgcttccgttaaaatgtaactaatggagtggaggggaagggttttcatgcaaagagtcgtggtgagcggtgccagtatcgggacccaagggcttttagaaacattaattgcatcacagttgctgttgacggtgggttgttatgaaccagatgaatcattgattgatatggttgggttgacagctttaagtcaaatatgtcaaaacacatttgcaaaagtcacgccgaaagttttaaaagcggcggatattttaatcttgaccgatatggggtcacctgatgccgatgattttattgagatgaatattgcggcaattcgcaaagttctcaattcagcgatggcggcgggcttcacaggtagaatcattgttgcgatgacacgtgatgaactttttacgtattttgcgcaacgtttttccggagtgaataaaagtcaggttgttggacttggtacgttcggtgcaacgtggcgatttgaacaatttctggctgctaggttggcagtaccggcgaaacatgtgacggcttatgtggtaggtacgcgacaagccccagtgttgatttggagccgagcttacgttggtgcaacgccggttttgcgcttattaaatgatcagacgatttttactgatggcttggatgcggttcgaagctttttgaggagtcccttgactgtcttgcttggcaggttggtgattccgattattgcggcgtatagtggcgatagtttgattggcacgctgacgcatctgatggatgtagaggatgacacaggtcaggtttatagttcgccagtcctcttgaatgatagcggcgttgtgacgctcgccacagttgctggttcggatgatgaggaagctgcgttgagtcaaacgaaagaaactgtacaggatcaaattaaggcgatagaacaaggagctagtaaacatgaaacctaattatgcctatccactcgacattgactggacaactgcagaaaaagtaaaagtcacgaccttttataccttagtcgaagatgcatatgaacacggtgttgatcgtgataatctgcttgcagcgtaccgtggatttaaggaagttgtgccagataaaggaaccgagcgcaaattggatcgggagtttgaagcactgtccggttattccatgtatactgttatacagatggcccgcaaaggcgtgagccaaaagattagggtaagggtgagttaaccatgacacaagatccagaaatgttgcggcaaacgattattagctggtttgctgctagtcgcaaacaaattctaaccgcaatggccgccccattagatgttgccaccaaaagtaatcgcaacgatttggtcaccaatgtcgacaaggcgaatcaacaatttttgattggcaaaatcaaagaggcgtatcctgaagccggtatcattggtgaagaaggacatgagcacgatgacactgatttagctggtctcgttttctttgtcgatccaatagacggcaccatgaatttcgtcagacaacaagcacattttgccattatgattggtgtttatcaggacggtgaacctgttgtcggcgcgattatggacgtcatgcgaaatgaagtgcttagcgggggcccaatgattcccgtcacccatgctggacaacaagtgaaggttttgccagacttgccgcttaaagatggcttgttaggtgtcaatggcccgatgacgattaagaatcggttgcatctaggcgatatcgcgttgaccagttctggcgctagaatgagcggcagtgcaggaatggaattcatcgaaattgcgctgggtcgacagatcgggtatgtgtcttacttacagccgtgggacgtagcggctggaatggcgattactaaggggcttggcgttgttttcagccgggaagatggcgcaccaatcaacttgcagcaaccaggtgttgtggttgctgctacaccaaaggcacatcaaacgattttgacgatgatggcggatggcggcaaagaggcttaagctaaaccaatagacaaatcatgatttctggcgcaaacttagtggcgccagtttttttcttaatagaagggtcgcgtgatagcccgctttataggaaaatgcaaggtctgtgattgcgtgaagcacttcacttttcagaaaatccagacagacttgtcattgtgtgttataatttcaaatcgtataactgtgtcagttgctggcacttttttaatgcggtaggcggccagtagtgccagcagaaaggaagtataaatcgtgaaaacacgtgacgatattcgcaacattgcgatcattgcccacgttgaccatggtaagaccacattggttaacgaaatgcttaaacaatcagatacacttgatcaacacattcaattacaggatcgggcaatggataccaacgccattgaaaaagaacgtgggatcaccatcctgagtaaaaacacggcagttaagttcggcgatacgaccatcaacatcctcgataccccggggcatgctgactttggtggtgaagtggaacgggttatgaagatggttgacggcgttttgcttgtcgttgacgcttttgaaggcccaatgccgcaaacgcggtttgtcttgaaaaaggcgcttgaacagcatttgacaccgatcgttgtcatcaacaaggtcgatcgtccaggtgcgcgccctgaagaagtcgttgatgaagttctcgaattgttcattgaattgggcgctgatgatgcacaactggaattcccagttgtctatgcttccgctgtcaacggcacttccagcatggattccgatttgtcaacgcaaaagcacaccatgaccccgttgtttgagaccatcgtcaaaaccattccggcacccatcgacaacagtgacgaacctttgcagttccaagttgcgatgcttgattacaacgattacgttggtcgaattgggattggtcggattttccgcggcaagattaaaatcggcgacaatgttaccgttatgaagctggatggttctcaaaagaacttccgcgtgacaaaactctttggtttctttggcttgacccgaaccgaaatcaactctgctaaagccggcgatttgatcgcggtttctgggatggatgacatcttcgttggtgaaacggtgacggcagctgatacgccagaagctttgccgattttgcggattgatgaaccaactttgcagatgatgtttgttgcgaatgacagtccatttgcaggccgtgaaggtaaaaatgtgactgctcgtaaacttgaggagcgtctgaagtcgcaattgcagacagatgtgtccctgcgcgttgacgacactgatcaggcaggtgcctggatggtttccggtcgtggcgaattgcatctttcaattttggttgaagagatgcggcgcgaaggctttgaattgcaattaggtcgtcctgaagttatctatcgtgacattgatggtgtcatgatggaaccgttcgaaagcgtccaaattgacactcctgaacaatatactgggacagtcattgatgcgatgagccaacgtaaaggcgaaatgcagaacatggagaacgaaggcaacggtcaaacccgtttgacattcttggcgccttctcgtggtctgatcgggtactcaaccgaatttctctctgctactggcggttacggcatcatgaaccataccttcgaaaaatacgctccggttatcaagaattgggaaccaggccgtacacaaggtgctttggtttccatcaacgctggttcagcaacgacgtacagtctgcaatccgttgaagaccgtggccagttgtttatcaatgccggcaccgaggtttatgaaggcatgattgttggtcaaaactcgcgtgaaaatgacattgcagtcaatgtcaccaaaggtaagaacttgaccaacacccgtgcagccgggaaagaccacgcagcagccatcaagacgccaaaagatatgacgcttgaagaatccattgaattcttgaatgatgacgaatactgcgaagttacccctaagaacattcgcttgcgtaagaagatccttaacacaggcgaacgtcaaaaagcggctaagcgcaagaaaattgccgcatccaagtaaataagttggtcaaaaagtcgtctgtaaaaggcggcttttttgatgtcttgatcacaataattgtgattgttagacaaggcttaacttgtcgactgagcggttgttaaatcagcatgtattggtgtaaatgaccgcctgaaaaaacagtttttagtgattaccgcagaacacggcttggagcgtgaaggcgatatgctataattagtccattaattgcttgaaaggccgcgttttcattgatgaataaattacggcacgtggattacttcatattagttccgtacctcgttttatgtgcgatcggtattgtcatggtgtactctgccagcgcttattgggttcaacggcaatatggcgttgccgaaacgaaatacttgattcaacaggcactgtttgtcctgctcggtatcgcgactgtgtttttcttttataatatgtccttgaaggtggtccacaatcgttgggttctgttgactttaatggccggattagttgtgatgctgatctatctcattgtgcacggccgcgccgttaacggggccgctgcatggatcacgattggcgggtttcgcttacagccatcagaatttgctaaaatgattttgattttttatctggcgcacatgctgacatcgcgcgaggatcgctttcaacaagaggactttcggctaaggcagatgtggcagccattgtttgtcgctggtatgatcatgcttctggtttttgtcgaaccggataccggtggatttgccattcttttcttgattacattggtcgtggttatgtccagcgggataccgatgcgttacggttttttgtgggtcttgatgttgatcgcgatcacagcactgggctactacatcgtgtcgcattatcattttcccggattggagaagaattacggctatcaacgattagtggccgccattcatccgtttgctaaagcgaatacggttggcaatcaggttgttaactccttgtatgcgatcaatcacggtgggctgtttggtgttggactaggcatgggcagccaaaagttgggctatctgcctgagccttatactgactttattttggccgtgattgccgaggaacttggcttggttgggacatttgtcgtattgagtttgctgtttttcctgatcatgcgtttttatctgatcggaattcgttccaagaacacctatcacacgttgatcgcgtacggcattgccacgatgatgctggtgcaaaccgttttcaacgttggtgccgtgactggggttttgccagttaccggggtgacgctgccgtttatcagttacggcggttcgagtatgatcgtgctgtcaatggcgatcggcattatgttaaatatcagttatcatagtgaacgtacgcaacgaaaggtagagaagacgcatgcataaagttttagtcgctaatcgaggcgaaatcgccattcggatttttcgtgcctgtgaagagcttggtcttaaaacagtcggtatttttgctaaagaggacgctttgtcaattcatcgattcaaagcacaggaaagttatcaggtcggagcaggaaaagcgcctatcgctgcctatttggatatggacgatattatccgaattgccaagcaaagtggcgcggacgcgattcacccgggctatggcctgctttcagaaaatgctgagtttgcccggaaagttcgggcagccggcctcatttttgttggcccgcgttcggaattactcgatatttttggcgataaagttgcggccaaggaagctgctcacaaggcaggcttggcgactattcccggcacgccggaaccaacgcgcgattttagcgaaattcaggatttcacagccacacacggttttccggtgatgcttaaagcagcatcaggcggcggcgggaaaggcatgcgaatcgttcactctgaagctgaacttgaggccgtgtatcaaaatgcggtgaatgaagcgaaagctagttttggcgatgatcggatgtacgttgaaaagtacattgcctccgccaaacatatcgaagtgcaagttcttggcgatgagcatggccatttgttgcacctcttcgaacgtgattgttcagtacagcgccgccaacaaaaagtggttgaaattgccccagctgtggcattgccaacagccttgcgggcgcgaatttgccaaagcgctgttgatttaatgcaaggcttgcactatgaaaatgccggtaccgttgaatttttggttgatggcgaccagtactacttcattgaagttaatccgcgggtacaagtggaacacacgatcaccgaactgattaccgatgtggatattgtgcagtcacagttaaagattgcagcaggcgccgatctttttgctgatttgcatttaccaaagcaggcagatttgcatgaaaatggcgcggcgatccagtgccggattacgactgaggatcctgaaaacaatttcatgccagacacaggcaccattaatacttatcggtcaccaggcggcttcgggatccgccttgatgttgggaatgcctatgctggggcagttgtcagtccttatttcgactccttattagtaaaggccagcgttcacgcaccgaatttcaccgctgccgtagccaaaatgcaacgcgctttacatgaatttcaaatcaccggcgtgaaaaccaatgttgctttccttgagcacttattagcgacagaaactttccggacaggtgaagcagaaaccgcgtttattgatgcccatccagaactcttgcaagttcaggcaaagcccgacacggcttcgcggttactgtggtacatcagtgatgtgacggttaatgggttcaaaggtgttgaacgacaggcacaaaaatattaccctgaattgcgctatgatgttcattttcctgctgccaagccgcaaaaagatttagttgccttgctgcattctgacggtgcgcaaggggttactgattggattaaggcacaaaaccagttgctgttaacggacacgactttccgtgatgcccatcaaagtctttttgctacccggatgcgcactcgagacatgttgacggtcgcacaggatatgggcaatggcttgccaaatcttttttccatggaagtatggggcggcgcgacgttcgatgtcgcttatcggtttttgaacgaggatccgtggacccgtttgaaaaaattgcgggcagccttgccgcataccttgttacagatgttattccgtggcagtaacgcggtcggctatcaaaactatccggacaatgtgattaaagctttcattcaaaaagcagctgatgatggcgttgatatttttcgaatttttgacagtttgaactggttgccacagatgacgctcagtattgatatcgtcaaacaaacaggcaagcttgctgaggcgacgatgtgttacacaggcgacattctaagtcatgcccaccctaagtatcagctagcttattatgttgatctggccaaacaattagttgcagctggcgccgacatgcttgcgattaaagacatggccggcttgttgaaaccgcaagcggcgacagagttagtaacggcgctcaaagatgtggtcagtgtgccgattcatttgcacacacatgacaccactggtaacggtatcgcgacttatgtagccgctgctaatgctggggtcgatatcgttgatgtggcgcaaagcagtttttccggaacgaccagtcagcctagtctagaaagtctttactatgcattaagtggcaatcagcgacagccagatgttgccattgaaaaggcgcagaagttgaatcgctattttcaggcaatcagaccttactatgccgattttagtaatggtgtgacaggtccgctaacggatatttatacagtccagatgccaggtggccagtatagtaacttgcagcaacaagcgcgtagcatggggataacggattttgaggccgttaaaactatgtatgccgaggtaaataccttatttggcgatatcatcaaagtaacgccatcctcaaaggtggtgggtgatatggcgttgttcatgctgcaaaatcacttgacacccgatgaagtgttggcgcatggtgagcaatatgattttccggcctcggtcgtggcattctttaaaggcgatctcgggcagccggttggtggttttccgaaagcgctccaagcaaaaattctgaaagggcaaaaaccgttgacggtacgtccagggcaattggcgaagccggctgacctgaaggctgttcgcgcggcgttagtacaagccgggatgaatgaacccagcacagaagacgttttgagtgcaattctgtatccggatgtctttaatgcatacgcccgcaagcaacggcagattggaccggtgacgaagttggattcgccatcgtatttccaaggaatgcggataggcgaaaccgtgtctgtgccgattaaagcaggtaagacaatgattatccagctcaacgcgatcggcgaggcggatgcaagtggtatgaagacgctgtactttactgttgatggtcaaaagcaggaagttcaaatccgcgatgcgcatcagaagagcgcggggttgcggcatcagttggcggaaccgactgatcgtaatcaaattggtgcaccgatggcagggaaaattgtttccgttgccgttaagtccggtcaagaagtggcacaaggggatgccttgtttgtcattgaagccatgaagatggagacgacggttcatgcaccatttgcaggtaccgtcactcatctttacgtggaggcaggcgccttgattaagagtcaggaactgctggccaagcttcaacccggtgtgaccaagcagtgagtttggaaggtgaaaaaatgtttgctatcaaacagcgacaaggacttgtcgtttgggtgtattccctcaaacaattaaaaacgctgcgtcgatatggcacgattatgtatgtctcgcgccgcatgaagtatgtttatctttatttggatcaagacgagttggctcagacaagcgccaaactcagtaaattacgatttgtcaaacgtgttgagccctcccatcggccagaattggcgactgaattcggtagcaacatcggccaatttaagccgactgaagaggatcttgaggtgaaagccaagccaaaacgtcgcttgcggccaagttcggctggcgatgagacatcagtaggtgatcacgttgcgcgtcattagtggagcatttcggggattgcggctgacggcagtggcaggtaaccaaacccggccaactgcagataaagtcaaggaatccatgtttaacatgctgggaccatactttgacggcggacaggcactcgacttgtatgctggcaccggtgcgttgggcattgaagcagtctcgcgtggtatggttcacgcgacgttggttgatcggcagtacgccgcaatcaaaacgatcaaaaccaatcttgcactaaccaaacagcctgagcacttcaccgttttgaagcaaccggtcaataaggctatccgccagtttgcggaagctggccaacagtttgacttaatcatgatggatccaccctatgcgcaacagcaagtattggcacaacttgcggcgtttatcagtactaatttgctgcggccaggcgcacgtgttttagttgaaaccggtatggatgtgacttatcctgatgagatccccggctacatcaagctacggcgccaaacctatggggtggcgcaggtcttaattttagagcgaagcgaggaaaacaatgactaaaaaaattgcagtgtttcccggtagttttgatcctttcacgaacggtcatcttgataccgtcaaaagagctagtcggttgtttgatgaagtggttgtagccgccatgaccaacacgagcaaaaagccgcttttttccagtgaagagaaattggcgctgatcagtgaaagcaccgctgggctaccaaatgttaaagccatggcagcgcctaaacgattaacagttgaatttgcccggtcaatcggtgcccagtttatgattcgtggtatccgcaatgtcgcggactttggttacgaggctgatattgcgacggtgaatcatgatctcgatcctgaaatcgaaacagttttcttgctggcagacaagcaatatgatgccttatccagtaccatcatcaaagaggtcgcggcctttggcggtgacgttcatcgttttgtgcctgcgcctgtcgaagcagctttgtatgcgaaactaggtgacgctcatcaaaccaagtaatcagaaacgtcggcgctggcgttggcttatcggactgttaatagcagtcgttttgttggctgtcttctttttgatcccaaccaattattatctagaagtgcctggttcagcggaatctttgaagccgtacgttaaagtcagtggcaataaagatgatgccaagggtgcctatatgttgacgacagtgggtgtcgtagggccagcatctccggcattacttctgctcagtaaggtgcaagcgcacaccgatattgtgtcgaaacaggatctgatgggcaatgatagtagcgctgagtatgatcagctgcaagcctactatatgaaaagtgccgctaataacgcggttgccgcagcatttaaagtggccaaaatgccagtgaaaacggaacatttgggtatttatgtcatgtccgtgctgccgcagtcgccattcaaaggtaagctggcgttaggagacacgattaccgaattgaatggccagcactatacaaccgctgatgcctatgtcaatgcgatcaaatctaaaaaggtcggatcaagtctgacactgacataccagcacaagggaaagaccaaacaagcaactggcaagctgatgcggctaccgcaaacaaaacgggcgggtattggtatcacactgacggagaacacggcggtcacaagtgaaccgaaagtgactattgatgccggtaacatcggcggaccgagtgccggtacgatgtttgccttacagatttacacgcaaattacacaccagaatctgcggcggggagcagtgattgccggtaccgggacgatcgatagcgatggtaatgtggggcaaattggcgggattgataagaaggtggttgctgccgatgccaaaggcgcaaaactcttttttgcccccaatcagccagctacaaaaaagctaaaacattatgatcccaattacgtcaacaactacgctgaagccgtcgaaacagcgaagcagattaagaccaagatgaagattgtcccggtcaaaacattgcaagatgtcattcgttacatggaaacttatgcaaaatcagcatcataagcgcttgccagttgatcgaacattggcatgaagagatggtgatgatgaagaactgccgaccaaggcagttctttttttcttggcctgcgtaatgtgttggtgaggtgagagagatgacgacacttatgttttggttgaaaacttattggtatgtaccgctggtggtgcttgtcggcgggttctttttctggcagcaaactaaggcagcaccagcacaatcccagctggccgttagtgttcacaccactcgcagtcatgcatctaatgttcatggtcagtcgaccactatagcgtccagtaggcaaacaagaagcagtaccagccgaccaacccgcggatttgtgcatatcaaaggagcagtccaaaagcctgggctatatccggttcgtgctgatacgcgttgggatgcggtggttaaagccgctggtgggctcacagacaaagctgatatcagtcaggtgaatttagccaagctagcggtggatcaagaaagtcttcagattccagagaaaggtggcgctgttgccaccgcgccagcttcagggactgccagcactggcggcactgctggccaaacaaatgcgactgctggtagtcgtgcagttgtgaatttaaacacagctgatgttagccaactccagacaatcagcggcatcggtccgaaaaaagccgctgacattatcagttatcgcgatagtcatggtggatttaaggatgtggccgaattaaaagaggttcacggcattggcgataaaacgtttgagactttagcacctcagctaacggttggcccatgagtggtcggtttattttaatggcagcaggtttgcttgctggtatcttgattggcattgggggatggttgccagcttgtttattgtggctttggctactcgttaaaacgactcgcaatctggtcatagtcgtaagtttggctattctcgttgggttaggacgtggcttgattgatgcccagcagtggcggcaaccgcctgttccccaaggatcaattgtgatccctgcgacagcactcaaacttaaagaaggttacgcaagttttactggtcgagcagctaatggggtgattgttagtggtcgcggcagcgtcaatcaggccgtcgctgcccgattaaaatcaaataatcaaccactcgtgctgcacggtcagcatcaaataaaacgtctagcgccggcaagaaatcagtttgagtttgattacgcgacttatgtttggcaaacacagcagttagcctacgagttagtgaaaccgcaattgagtttcgagtcaaggtcgccacaaaatatagcagagttagttgatggttggcgggttcatttatttgactattttgagcaattgccaacaaaagttcgtcaatatgcaaaaggcctatttctaggccaacttgatgaagactttttgactcagcggcaagctttcgttgacttagggatctttcacgttttctctgtttcagggatgcatctttttgcaattattgccggtttatactggtttgcggcgcgcttgcgagtgcctcaagggttagttgatctgagtctaatcgtcctgctgccgttgttgttactcctattgccacttggtgctggattgtggcgcgcagtttggatgcgattggccggtattgtgaatgatctttgcaacttggtttcagcgggcttgacttatttagcttcgttttaatggttaatttattttggcaaccgcgggttttgttaaccatgggtggtcaactaacttacctgttaaccggtttattagtggcgcttcctgccatgcgttcgtggcagctcaactggcgactggtacttgccagtatgccagtgattgcttggcacacgttcagcttcaatatactgacggttctttttaactggctgttaatgccgatctttgaacttggggtcatgccagggcttgcgatcgcgttgcttttgccacacgccaccttgacagccacttttgacgatggtttgcaattgttggaaaatggcttagttagtttaagccgtgtacctggccaaatagtcactggcgcttttccaagttggttagcgcttatcggtgttgtcgtgatgctgacggtgattgttgctaaacgctggttggcggcggcttgctggtttgtgactgtctttggctggtgttggtatcagccaaattatcgggtggtcatgtttgatgttggacaaggggacgcaattttgattgaaaccccttttcatcaaggtgctttgttgattgatactggtgggcgaattttcgggaagacgaccaatccacctgtccgacgagccattgtgccatatttgcatgctcgcggctatgctcggctggataccttattactgacgcatccggatatggaccatgttggcgatgccccgttgctatctcagctaatgccagtcggtcgactgatcaccacagcgacaagcattcagcatcaaatgattcaaaaagttgccaagcaagtgcaacatgtgcagctcgtggcggctgatgactggttgcgcattggacccgctaaatttcacgtcgtatcaccgaaagcgcagacatccggcgatcctaccaagacaaacgccgattcaattgtgctctatggtaaaataggcaacagcagttggttgttaactggcgacgccgaaaaagaagcggaagaaaagaatatcatgccgcgtcagctaacggccgattatttaaaagtcggccatcatggttcgaaaacatcaagtaccccggcattgatcaatagcttgcatttaaaagcagcacttatttccgccggtgtcgataatcggtatggtcatccccatccagaaacccttgcaacgttggctgcagcccacgttccatgggctagcactagcgagcgagaaatgctgtgggttgagccggggcaaaacaaacaggaagatcagctttttggctggttaccaacaaaggagcaaagcagcaatgcaggtccgtgattttatcaaacatcttaagaatggcgaacgaccgccgctgacattgattctcggtgaagaatccgcattgcgtcagcaggcacaacacgcgatagccagcatgattccggaagatcaacaggctatgaactttggccgctatgatatgcagcaaacgcctgttggtgcagccttgaatgatgcgacctcgatgcccttttttggggattatcgggaagtcgttattgacgatccgtattttttgacaggcgaaaaaaatgccgacaaagtcgatcatgatcttgctggtttgcaggcttattttgagaacccagtaccgtcaacgatgatggtcatcatcgcgccttataagaaacttgatgaacggaaaaggttgaccaaggcattgaaaaaggcggcgctcattgtgaatgcagcaccgcttgatgaacgggaggcgcgtgctgctttagcccaaacatttaagaagcaccaagtgaccattgatgcaccggcattggatacccttgtgcagcgcactaacggccagtattcgatcatgatgggtgaggttcgcaaactactgacctatgccagtgatggcagcccgctgaccgttgcagcggtcgaagccctagtacctaagcagctcaatgatcgggtgtttgacttggtgactgatgttttgcgcaaaaatgctgcggccgctttggcgctgtatcgtgatttattggctcagcgtgaagaacccattcgtttgaacgcattgatgctaggccagtttcgactattgctgcaggtgaaattattagcaaaaaaagggtatagtcaaggcgatattgctggcaccctcaaggcccatccatatcgagttaaattagccatgcggcaagtggatcgcttaccttatcagcagctcgcgactgcctacagtggcttggttgatactgaaacagcaatgaaaacgggaactatcgataaggcgttggcttttgaactatttatgctaaagtacacaggacagcagtctggcaagcatgtgcgcggttaagcaacatcgtgcggattgcaaatgatcgttagacgcaaaaatcccctcggatagaaacccgaggggattttatttggcatgacgccttaattacttgttaagtagtgcagaaagacgactcttgtcgcggccggccttgttcttcttgatcaggcctttgctgtttgccatatcgatagcacgggcagcagccttgtaaagatcctgactgttgtcagcattttgttcggttgcggtcttgaacttcttaacagcggtacgcattgcgttcatttgcgcaatgttacgtacacgagcagcttcttgcgtcttaacgcgcttgattgcagatttgatttgtggcatgagatgttcacctccaacagtggattatgataaaactgcataagtttcaacagtcgctattatacagaaggcttgggggcaatgcaataaaaagttgtaaagggaaaatgcttgataggcaaaaagacttgcaatcattgggcagctccggtaaagtaagtaagtacttttgaacctgatacttagtttagcgaaccaccgacgctttactcagtttcaggcaatactcagaaaggtggtacacacaatggcaattgaacaaacacaaaaagatgaaatcatcaagcagtatgcacggcatgatggggatacgggttcacccgaagtccaaatcgcagttttaactgcagaaattttggccttgaatgaccatttgtccgttcataagaaggatcatcatagttacgttggtttgatgaagaagatcggtcatcgtcgtaacttgcttgcatatctacgtaacaaggatattacgcgttaccgtgatctgattaaagcattgggtctgcgtcgttaatttaactttgaaaggtcgccttggcggcctttttttgatggttacaaactagtctgattagaaagcggcgtgtgaagggcttttaaatgtagtctgggaaacgtccttgtgttcaagccttttaggtgtagactatttgcgactacgagcgcgttatgaaaaccggaatgccagacaaaggagtaagcatcatgggagcggaatatcgtcaacgttatgaggatcatttgttgagaatcacggttttagcagcgacacatcagataacggttgtctttgcagcaatggctgctgatcagtgggccgctgcggggatcactaaaaaaggagcagtgcagaccgccgcagagggcattgcgctgcctcttcagcaattagtgcaggcgattgcgattggcttaattggtaaaacaccaaccttatcgttgttgccgtcagagttgcaaaaaacggtaaccactattttacaaaatcgtgaactgctaatgacagcaacaccgacaggactgacgatcatgcctcaagtggctggtacaatggtggacttttggcttgctggtgatgccgcgtttttatctgtaccggatgatcgtttgcaaccgatagatttgaaagcgtgggtgcaaaatatcctaccacaagctcatggcatgggcttcggcccagtaaccgggcaagcagcgttggcgatcctagccaacgaccgtggcaaacatctagcagctggttgctcatcagaagttgcagtcgttttaatggcggatcatgaagtagcggcctatcatcttgatgcggcacagacgagtgatgctggctatcagacagccgttgcagcggccaaacaaaatcaccacgttgtacaacgtttctttgagaatcacgtttagaaagaaacatctgtacttaggctcagttggcatgaagtctttgaaatgcatccaattgcgctctataggttttccttccgtcatgtggtacacttgtataagaatttattcggcggaagcgggtttgagtgatcatcattgccgcgcttccataaattaaccacgaggtgaaaccatgacgaagatcaatctggtcgctcttggtggggtacgtgaaaacggaaaaaacatgtacgccgtcgaagttgacgaccaaatttttgtatgcgattttgggttaaaataccctgataatgagttacttggcattgatgttgttatccctgattttagttatttaactgaaaatgctgatcggattgccgggattttcctgagccacggacatgcggatgcggttggtgccttaccatattttttggtggaacatcctgtgccagtttttggctcggaattgacgatcgcgatggccaaggtattcatgcaacatgatgctcaggctaaaaagttcaaagactttcatgtgattgatgagaagtcggtcattgattttggcgatgtgtctgtctccttctttaggacaacacatagtattcccggatcgttagggatcgatattgaaaccagcgaaggtcagattgtttataccggtgatttcaaatttgaccccagtgccacaccgatgtatcaaactgattgggcgcgcttggcacagattgggaataaaaaggtattggccttgctttcggattcggccaatgcggaatctccttatccaaatgctaatgaacatgaaatttatgatcacattaaagaaacattcgagtatcaggatggccggatcattgttgccggtgttgccagcaacattcagcgcattcagcaggttattaatgcggccgcttcgctcggacgacgcgtcgttttgaccggccgagatgttgaaaaagtagtcaagactgcgattcgcatggactacatcaagctgccgaatgaggacgtccttgctaaaaccaaggaactcaaagcgcttgccccagaaaaaacggttattttggaaactggtcgtatgggtgaaccgatgaagtccttgcaacgcatggcgacttctcggcatcgtttgattcacattcatgaaggtgatttagtctttattacgaccaccatcgcccatgccatggaaaccatggcagcacgtacgaaagacatgatttatcgtgctggcggagatgtgaaagtgcttggggatgatattcattcatctggccatgcctacaaaaacgatcttcagctcatgatcgacttgttaaaacctcaatatcttgtgccagtgcaaggcgaataccgtctgatggctgctcacgcggagattgcgcatgaagccggtatcccaactgccaatatctttattgttggaatgggcgacattttacgttatgaaaaaggtaaaatgactgcatcgggtcatgtcaatgcaggtaacaccatgattaacgggatcggtgtcggtgatattggcaatatcgttttacgagatcgtaaaatgcttgcggaagacggcattttcattgcagttgtgacgattgatcgcaagaaaaaacgcgtcgtatcaaagccgaaagtcacgagtcgcggattcgtttatctgaagaccagtcgtgatctgcttgccgaaagcggcacactagtgactgatacggtccaaaagaacttggacaacaaagaattcgactggacacatttgaagcaggatgtccgcgataaacttagtcgttttctgtttgaacagacgaaacgccgcccagttatcctgccggtcattatggaagttaatcaaaatagcgccaagcgccaataatcaaaaagaaaattcggatcaccatttccggattttttatttttgcagtgatgacacgctttctacagcacgacaggagggttcttatggcaaaaatggtttcattaccggataatgaaaaacgtcattttgacatcggcgagcaggctttgcagaaaggcaattatgcttcggcagcggctcattttgaaaaggcctatgaagcagatcaatcgtatgcaattgcccaaccgttggccgcaagtttgaatggcttgaagcagtttcacgaaagcttaaatgtgatgttgccacactatcaagctttcatgcagacagacgcagacgttcagttaatgttggatgcttggttagggacactcaattttgtcatggcacgtggcatgttgcgccattttgatgcggtgcggcgcgctacttttgaccgacaaattgacgctgccgaggcacttgctttaagtagccatggtgaacagattgcttcattggtgcgaaaaatcagccatctcggcggcttttcgcggcaggagcagcaagatttgttcagccaaattggcattttgccaaaagcggcgttagttgaagcagctgtgcctaatttggccgatcaaacggttcctgttgcgatgcgcgtgtctttgctagatttgttgacaagtatcagttataaccaacctgtcagatatcaggcatatgaccgcattgaaacccttgtgccaaatgagttgcctggaatggcggaggaaaaaagcggaccggccattttgacgcagttgcaagctgccttgggcgatgatgatcaggaactagggacggcattggttcagatggcgcgggtgcaaattgcctttctctatcccgatattgaccgtctgattccagatccagctgcattcgtccaagcttatttggatcatcatcaaggcaaaagcacggtatttgatcaactttttgcatggcagaccgccgaaacggcaaaattgtcggaacaggcgtaacgatacgttttcactgtaaatgaaagaaacttgacgctatctgtttacaaagtgaaattgaccatgtatactcattgctggaattcatttccagcgtagatatttgttttggtatttacgctcaaatgtagtacacttaaacgtaaaggattatcagggtacacaaggtatcctgtattcttacgaaaaatacaggaggttcgttttttcatggctgaaaaagaacactatgaacgcacaaagccccacgtaaacattggtacgatcgggcacgttgaccacggtaagactactttgaccgcggctatcactaaggtattgtcagagaagggccttgccaaagcgcaagactacgcttctatcgatgctgctccagaagaaaaggaacgtggcatcacaatcaacaccgcccacgttgaatatgaaaccgaaaagcgccactacgcacatattgatgcgccagggcatgctgactacgttaagaacatgatcaccggtgctgcacagatggatggtgcgatcttggttgttgcggcaactgatggcccaatgccacagacccgtgagcatatcttgttggctcgtcaggtcggcgttgattacatcgttgttttcctgaacaagacagacttggttgacgatccagaattgatcgacttggttgaaatggaagtccgggaactgctcagcgaatacgattatcctggtgatgatattcctgttatccgtggttctgctctgaaggcccttgaaggcgatccagaacaggaaaaggttatcatggaattgatggataccatcgatgaatatatcccaacacctgttcgtgaaacagacaagcctttcttgatgcctgttgaagatgtcttcaccatcactggtcgtggtacagttgcttctggccgtatcgatcgtgggacggttaagattggtgacgaagttgaaatcatcggcttgaagccagatgttatcaagtctaccgttactggtcttgaaatgttccgtaagaccttggatcttggtgaagccggcgataacgttggtgtcttgcttcgtggtgttaaccgcgaacaagttgaacgtggccaagttttggcaaagccaggttcaatccaattgcacaacaagttcaagggtgaagtttatatcttgacaaaagaagaaggtggccgtcatacgccattcttctcaaactatcgtccgcagttctacttccacactactgatgttaccggtgtgattgaattgccagatggcgttgaaatggttatgcctggcgataacgttactttcgaagttgacctgattgctccggttgctatcgaaaaaggtaccaagttcaccgtccgtgaaggcggccgtactgttggtgccggcgttgtttccgaaatccttgactaatttctgaatatacgcatgaacccgcaagcttgcttgcgggttttttcgtgcaggaacgcctgagcaggctcggtttctgggccttctcacgcgcttctccaatgtaaggtcatccgggcccatgactgagtaccgttagatccaaattcaaagctgcaccaagccacttggcgaaacgcgatcaaaaacacaaacatggtcatttatcctgactgattaagcctccagtcaaccgcggtcaacgccagcactggacctttactagcatacgatgagtgaccaagctttttcatcgccaaaacatgacgactgttatatgatagatgttcacgaaaagacagagcgtgagctggtgtgttcggaaatctgagcataagcggcctaggtcatgacactcaaggtgcttatgggcaggtatttgcaccagtgaacacgtttaaggaggagccacctatgaaacgatccaccacatagcgcatgttggcgtttttctggcgtcaacttgcggatatgaagcgtcaattgattcgaattatagtggcgctagtgggcgttgccggtgcacaatatgcgattccacgcctgtcacagtatgtcattgaccgcgtgattccgagccgggctgtctcaacactggtgctcacaatttttctggctttaggcctgactgctttggctggctttctgaatgcgctcagcacatattggattggacaggttagtttaagcgcgatcgcccgtatgcgtgacgctttatttcggcatacgttgggacttgacatgcattatttcgagacaagtaaaaccggggacttaatggttgttttaaccagtgatgtcaacaccttgcagcgtttaatctcaagcaataccttgggcctgttcggaagtatgctgagcttttttgtcgtgctggtgttgatgctgattcaaaactggcagctcacggcgctgattttgcttacgtttcctgttttgttcgttttgaataatatttttgtgcgccgaattcgcgctgcttatcggcgggtgcggaccagttcgggtgtgatgaataaccaaattcaacaagctttgacgagcattgggcttatcaagagtttcacaactgaaaaagcaaccgcgaatacctttgaaaacgttaatgagcagaaccgcgataatcaactgacagcaacacgtcttggagcaactttttcgccaatcactgatttcgttaactatcttggtacggcgatcattttaggatttggtgcatttcaggtaatgcatgggcaattcacagtcgggctaattgtcgcctatacagcttatctgggtattcttcaagcaccgattcgccaagtgaccggcttgattcaacaattacagcaagcaacggtttcttttgagcggattgaaacactgcaggcggcggtgccgcgggtggtatctccgccaaatgcgatcaagttagcgcgttttcatgatcgcattcaattcgatcacgtcggctttagctatgatccgtcagtacctgtgcttaagaatattgatttttcacttgctaaagaacaggtgattgcattggtcggatcttcaggtgcagggaagacgaccattacgaacttgctggatcgattttatgatccgacagaagggaaaattacgactgatggggttgatcttcgccaagctgacttagagagcttgcggcaacagattgcgattgtttcgcaagatgtgattctattagatggtacgatcaaggagaatcttgaatacggtacaccaaatgctagtgaagcggctatttggcaagccgccgaagccgccaacattgcaacgtttattcgcgaattgcctgatggtcttgccactcaagttggtgaacgggggattcgtttatcaggcggtcaaaagcagcgaattgccattgctagagtctttttgaaaaatgcgccaattgttattttggatgaagccacggctgccctagacaatgagtcagagcgatttgtgcaggctagttttgatcggttgatggcggatcgtacgtcattagtgattgcccaccgtctgtcaaccgtccggcatgcggacaatattctcgtactggaacatggcgagattgtcgaatctggtacgcatgaccaactgatggcgcaaaacggtcgttataaagaactttatgatttgcaatttacttgataattgcagttagctggaaagcttaaaaatcggaatctatcgcttcaaagctctcagggcgggggaatgtgaaaaaaagcgacgctgatgtcgccttttttggccacaacatttacattcaagtgggtttcgggtatcatacattaagtatgcaatgtgaaattgcgagactaattgtcggaggtacagcatgtctgcaaaatgggaaaaaaagggcaccaatgatggtgaactcacctttgaaatcgatttaccacaaattcaacaaggtttagaccaagcgtttcaacgtgttcgcaagaacttgacggttcctgggttccgtaaaggcaaagttagccgcaccgtgttcaaacggatgtatggcgacgctgcactttatgaagatgctttgaacatcttgctgccagacgcttatgaagcagccgttaaggaatccggtattgatccggttgaccaaccgcaaatcaacgttgattctatggacgaaggcaaaccttgggtcatcaaggcaaccgttacggttaagccagaagtcacacttggccagtataagggtcttgaagtgccaaagcaggacgttgaagtttctgcaaaggatattgatgctgaattggaaaagcgtcgcgaacagcaggctgaactcgttgttaaagacgacaaagcagctgaaaatggcgataccgttgtgatcgactatgtcgggacaattgacgggacggaatttgacggcggctcttccaagaactatagcttggaattagggtcaaactcattcattcctggctttgaagaacaacttgttggtcacaaatctggtgatgaagtgaccgttaatgtcaccttcccagaagactacaaggcagctgatttagctggtaaagcagccgaattcaagaccacgatccatgaagtcaaagttaaggaattgcctgcattggatgacgactttgcgaaggatcttgatgatgatgttgatacccttgatgaattgaaagcaaaaatcaagaaggaattgaccgatcagcgtgaggaagctgcaaagaatgccgttcaggaagctgccatcaaggaagctactgacaatgcgacgatcaaagaagtgccaaatgcgatgatcgagcaagaagtgcataatcagatggatcaatatcttggcaacatgcaacgccaagggatctcaccaaaaatgtactatcaattaactggtacatcagaggatgatttgcacaagcagtttgaggctgatgcagctacgcgtgttcggacaaacttagtccttgaagccatcgtgaaggccgaagatattcagccaaccgaagaccaagtgaacgaagaagtcaaaaacttggcttctgaatacaacatggacgaaaaggccgttcgtaaggctttgagtgaagatatgctcaaacatgatattggtgtcaaacaagccattgatatcatcacggacagtgcaaaagaagtcgaatcagctaaagatgatgctgacaaagaagcttctgacgccaaggctgacaaatagtttgccgtttccacgtaaaagagacgatccccgatcgtctcttttgttgtatgaacgcgtttttagcgtatacttgacgttattcttttagcagaaagaaaggcaagttatttgacaaaacggtgggtgtgcttccgctagtcggcacttgacgcttctgttagaatgaaggtatcaagaaagggttgaatcagatgtttgacaacgtcgaaacgacgggtccagttacttgttctttttgtggcaagtcacaggatcaagtgaagaaaatcgttgctggccctggggtttatatttgtaatgaatgcattgacctctgcaaagagatcattgatgaagaatttaaagaagaagcctatcagaatctgcttgaagtgcctaagccagtcgagatcatgaagacgctcaatgagtatgtcattggtcaagatgccgcgaagaaagctttgtcggttgcggtttataatcattataaacgagttaaccaaatgcagactgcaacgaaagatgacaccgaactgcagaaaagtaatattgcgttgatcgggccaactggttccggtaagactttccttgcccagacattggccaaaattttgaacgtgccatttgcaattgccgatgccaccacattgaccgaggctggttatgtgggggaagatgttgagaacatcttgcttaaattgcttcaaaatgcagactatgatgttgagcgtgctgaaaaagggatcgtctatattgacgaaatcgataagatcgctaagaaggcagaaaatgtttccattacccgtgatgtttcgggtgagggggttcagcaagccttattgaagattttagaaggcacgattgccaacgtaccgcctcagggtggccgaaagcatccgcagcaagagttcatccagatcgataccactaacattctctttattgttggcggtgcttttgatggtatcgaaaatatcgtcaagaaccggattggtgaaaagacgatcgggtttggaacggattcaaacgagcaagttgatccggataagtcactgatgcagcaaattattccagaagatttgatgcaattcgggattattccagaattcattggccgtattccgattttagccgcgcttgagaagttgaatgaagacgatctggtacggattttgaccgaaccgaagaacgccttggtcaagcagtatcaaaagctgctgagcttggatgacaccgacttggaattcactccgaatgctttaaaggcgattgcccatcaggcaattgtgcgcgacactggcgctcgtggtttgcggtccattatggaagccatcatgcaggataccatgtttgacttaccaagccgcagcgatgttgacaaagttgtcgtgaccaagtcagctgttgaaggtaaggctaagccacaactggtcttaaccaagggccgtgaagcttcttaaaacgcaactgtcatgaaagcatcaagcgaaaagcttggtgctttttttgactgacgaattgtcaactcaagtgcaactttttacccatgaagacttctgatggcgtcgacaccgtctgaagttttcttcggtaaaaagttacacttgatttgacaattcgtccaacaaaaaaaccaccacgagggtggaaaagtttgggggaacttttttgggagtgtaagttaatgtgtaagcttaaggctgaaatacatctgccttattgacctaagtatagcaattcactaactcttaggtggttccattttcaacaacaattctgttcattttataaatccacttatatattcataagttttaactacaaaaaaacagccctattggctgtttttggtttatttcttgtccaaaccatacttcttgttgaaacgatcaacccgaccatcggcctgagtgaatttctgcttaccggtgtagaagggatgggagtcggatgaaatttcaacccggactaatgggtattccttgccgtcttcccacttaacggtttcttttgaagttttggtggaacctgagataaatttgaaaccagttgctgaatccataaagacaactggatgataatctggatggatgccttgcttcataatgattactccttttgccctaaatcattgcctgatctagagatactcttacaacaactctaatagtctatcacggtcatggttcaaacgcaatctcaatcaatcaactcaacatctgcgccgaggccacgtaatttcatgacgacacgatcataaccacgcaagatattatcaactttggtaatcgttgtcgtgccttccgccattaaaccggcaatcattaagcaagcgcctgcgcgaatttcttcagctgcaacttcagtgccttgcaaatgatcgcaatgatgcaaaataatgacgtcattttcaatagtaatatccgcgcccattcgcaacaactcaggaatatgccgaacgcgtttaggataaatggtatcaatgatcaagccctcgccatgagctttcagcattagcggggtgatgggttgctgcaaatcagttgcaaatcctggataaggcatggttttaatctgaaccattttcaaatcaccagacgggtaaacgaagatactgtcctcaccgacatccatgacgacacccatttcctctaatttagctaaaaaggcatctaaatgttcagaaataatatttttgactttcacaccttcgccgatcgcagctgccatcgccaaataagtccccgcttcaattcgatcagggatgatggtatgtgagttgtgtgcttcaagggttggcacgccgtcaatccgaatcacatcggtaccagcgccacgaaccttagcccccatattattcagatacgtggctaagtcgataatttctggttccttggcagcattttcgatcacggtccggcctcttgctgttaccgcagccaaaatgacattgatcgtagcaccgacggacaccatatccaaaaagatgcgtgcaccgtgcaagccttcagctggtgccttgatggccatcgcgccgtgttcattgctgacggaagcccccagtgcctcgaacccttttatgtgctgatcaatcggtcgtggtccaatatcatcaccgccgggcaagccgacaattgctttaccaaaccgccctaataacgctcccatgaagtaataggaagcgcgcaaactttttattttgccatttggcagggggacatcgttaatttcagttggatcaatcgttaggacgttctcagtaaaatccgatttgacattcatgtcatccagaatcgccatcaaattatagacatcctgaatatgtggaactgaatcaagcgtgaccggggtgcgtgacaaaatcgccgccggaatcaaggcaacggtactgttcttcgcgccgccgatcacaacttcaccggataatttcttcccgccgtggatcagcattttttccattgagttaaatcctcacttaagggtcgttcatttcaaataggctgaagctggcctgcatctatgcttcaaaataaactgcgatttctggtaggcgaggcacaacaaactcatcatgcactcaacatacaagtttaatgaattctatgggaaaaaacaaggactaaaagaacagagcgcgaactggcgcgtttagaaaccggaatgtaagtggccttggtcgtgatggtcgctctttgaccattgcggccatggtccttacatgcaggtttctgcgccagcgagcgcgtttaagaacccgagctgccccccaagtgctttatctaccaaaaaagccgtcccaaagtaatgatacctcaggacggcctttataaatcaatgaaacctgctattaagctttaaaatcgcctgctgcctgaatgaaggctttgaataatccctccggcttgtttggccgcgattggaattctgggtgatattgtggggcaacgaagaacttgttcttcggatattcaataatttccatcaagcggttgtctgggctgacaccggaaaataccaagccgtggtcttccattgcctgacgatacttggtgttgaattcgtaacgatgacgatgacgcttttgaatttcatgggcattgtcataagccttcgctgcaacggaacctggcttcagaacacatggataaaggccaagtcgcaaggtaccgccaagatttttgacacccacttgatcacgcatcaggtcaatgatcgggtccttgatatcaggttgcgtctcagttgtaccagcatctttcaggcccagcacatcacgcgcaaattcgactgaggccatctgcatacctaagcaaatgccaaggaatggaatatcgttttcccgagcatagcgaatcgcggcaattttgccttccaaaccacggtcaccgaatccgcccggaacaagaatcccatcaaagccttgcaacaagctttcaacgttatcgtcattgacatcttcagcttggaacatttgcagatcaatatcagagtcccaatagtagcccgcatgcttcaacgcctcggcaacagaaatataagcatctttcaaagcgacgtatttaccaaccaaggcaatcttagtggtatgggtcaaatgctgaactttatgctcaagctgcgtccaagcacgcatgtcggcatcaggcacatcaaagccgaaatgatcgaccacaatctgatccatgccttgcgcttgtaatgccagcggaattgaataaagcgtctttgcatcgcgtgattcgatgaccgcattttccggaacatcagtgaaaagcgcaattttcttcttcatatcttccgtgatcggtttttcagtccggacaacgagcatattcggctgaattccaatactacgcaattccttaacactatgctgagttggtttcgtcttcatttcatcggccgcgcgcaagtatggtacaaggctggcatgaatatagaaaacattttccgaaccaacatcacgcttcatttggcgaatggcttcaaggaatggcaatgattcgatatcgccaaccgtaccgccgatttccgtgataatcacatcggagtcgctatgctttgcggcccgcatgatcttctctttgatcatgttggtaatgtgggggatcacttgaacggtcgcaccgaggtattcaccgcggcgttcacgttgcagaacttcagaataaattttcccggttgtgacgttgctgtacttattcaggttgatgtcaataaaccgttcataatggccaaggtcgaggtcggtctccgcgccatcgtcggtaacgaacacttcaccatgttgataagggttcatcgtcccaggatcgacattgatataagggtcgaatttttgaatggtgatcttcaaaccgcgattctttaacaaacgacctaaggatgccgcaacaatccctttacccaatgacgatacgaccccaccggtaacaaaaatatacttggtcatagccagtctccttttttaataatcgggaaaaaacaaaaacaagctccctattcatacgaacagggagcttgaaccgtattggctttacattttgtaaagcgcccaagctgtatattaactaattgtggcaaagacgtcaagacctaaaacttaagtatgaaatgtcccaaataatcataaataacatcacgtctcaaagacagccttaaagtcagctttcagcttccgctataaatcctttaatcatggacttttctcggtcgcccctgacgatagggtgcaccattttgatgtgtgttttttgcctgctgaaaagccgcaaaccaatgtccgagtgttgttggattaatgttaagctctgcttcagctgctttcgcgaagttttcccatgctgttcgactaatttcagtattacctcgagcattgcgcgactcgcgaatgaactcgccaaccaaacggcggaacttcacttgctggtcatggctcatgcgtaaataatcttgttgcccagttgtttccatttgctggataccggttagttcacgagcatcattgtcgatcgtaaagaaggaacggatgggaatcgcaatgtacaaaatatacgctgccttgggcacaaaaatagctaaaatcataatcgcagcgatcatgataacattttctaagttgtgctccccataaatactggtataaattttccgcatttcgtctttatcattggcttgttgatgcacgattgtccttgatatgagtcgaaatacgacaattaccaaaaagtagatcgcaccatagataatcacagagatggattcaacatctcctgacatcagtcgcgtcaatgctggcaccagtgacagtaggaaaaccaagatgaattcccaaagcacgattcgtcgtggaatctgatcaacggtgctgaacaaagttgcttgctggtaccaaatattcgccacgaaacagaaactgacagcatacaccccaactgccaaaaagaaattggtaatgttggcatgatgttcccaactttgcgcaggcaactccaagaccataatggtaataataatcgcaagaatagcgtcaatgaacgtatctaaccgggttttaagttcttttgaaatcatcgtagatccccctcttgttagaaagtatcgtgctttgtcaaaaattgtcaacggtcttaaagcgtaaaaaaacatttaggagcagtcaacttgtaacactcgcacttttaaagtttttaggataccacaaatagcggcaaaacacgatcatcttggtcagtatgccatttctaggttttgcctactgatggacctgaaatgagcttcataacaggctcacagtcgcaaaaacctattcagtcccaattcaaaaagtatatccacagacgcagcaagctatatacgagcctccaaaaataaattatcaaagccaatccatgttgacctgtatcggctagtacttcgggtgctaattgcgcctgctcgcgcacacaaaaaaagccgtccccacaagacatgggcacggctcgctaaacattattttggcgctacgatatttggagttgataggcagcttgcctaccagctcctttttctgacgaattgtcaaatcaagtgtaactttttaccgaagaaaacttcagacggtgtcttccagactaagaccttacggggtcgattatttaaatccctgacaaacttcgcgatatcttgatcggtcagttcatcaaggtcagttcctttgggaaaatactctcggatgagaccattggtattttcgttggtcccacgttgttgtggtgcgtgcgggtctggaaaatagactgagataccaagttctttaccgacttcacgataacccgcaaactctgtacctcggtctggtgtaagcgtacgaacgcgtttaggtgtgactgtatgcaggaggtcgatcatcgcttgggtcacattcttggcattcactttgggtacacgctcagacagaaggtatcgtgacttacggtcgaccagtgacactaaacccgaacgcccgatcttgccgcgaacggtatcgccttcccaatggccaaaacgagtccgattctcacatgagactggtcgttcatggactgatgggacattattaaaacggccacgtcgttcgttgacagttcctttaaccttacgagttttcccacgatgtcgtaactttcgagcgaatcctcgagccccatgacttttacgtttaacgcctaaattatttcgttcaattccgcgataaatcgtgttgtagctgatatgccaattactgttctctaaagataaacgaccggcgatttgctcgggtgaccattgccgttgaagaatgcagtgaaggacaaagtcgcgtagctttaaattctccagtaccctgaggcgacgactctttaatcggcgctgttgatagttctgctgggcttttacggcagaataggcaccccgaccgccgttgcgtttaatttctcgtgacacagtggctttggaacaaccgatttgatcggcaataacctggtaagtatggtgtaaagttacacctaacagtatgcattcgcggtcttttaaggtaagatgtgtatatggactcatagcctaagaactcctttagatgattgttatggtgacttcattctacaggactcaggctaggagtctatttttattttcttacttgttgcacttcaattgtaaattcgtcggcgacttcgagaccggtttttgggctcgaagcgccgtcacagcgttccagccccgtctggccggagattgcggagtttggcacggcatgagactctttggcctagcccttacccccccgattattcagaatctaataaatcacaaacccaatacgacaattatgccccattcttttatgccaaaatgctataacaaatcacagcattcataacaataacataagcgttaaatctgctgccaaatcacaccgcctgctggtaccatcgtgcctactggcaataaagcgcgcaaactttttggcactaattcagcatgcggatcctgtaacacttgcggtgatccagttggattggccagaactaccagcgtttgggtatcattttggcggacgaagccaaaactgtcttcaaacgtaaatgggaaaaaagcggcacctgcagccaaggctggctgatcaatgcgggtctgaagcgcgatttgataaatatccaaaacagcctgatcttcatggccccatggataaaaggcgcggttatccgggtctttaccgccagttaacccggcctcatccccgtagtaaaggcacggcaccccaggcagccagtaaaatagcgagacgataaactgcaacttacgccgatcaccatccaacatcgttaaaatccgtggtgtatcatgactgccaatgttgttgaaattgaacgcaaacgcatttgttggataattctccttcaacgtcatcaattgacgcacaaatcctgccgcgtttaactgcccatttgtcaggtcaatcaacatggatcgcagcggataattcatgactgcattcaattcgccgccttcaaaatattgccgccgcttgccataagcctgtttattggaggcatcctcccagacctcgccgatcagcacccgctccggaaattgatcaagcgtgctgcgaatctgccggataaaatcgtccatcaattcatcggcaacatctaagcgccagccatcaacgcctaagtcagtccaataactgatcaccgaaccttttttagccgcaatgaagtcatgaaaatcttgattatccttattaatggctggcagatccttcacgccccaccagctattgtagtcatcaggaaatcgcttgaatgaaaaccacgaggcatatggggaatccaagctattggccgcacccacgtctgaatattcattgacggcattgaagtagcggctatcagctccgacgtggttaaacacgccatcaagaatgacatgcatccccaactgatgcgctgccgctaaaaactgcttaaagtcatgtagcgaacctaaaacttcatcaattgcaaaataatcgccggtgtcataccgatgattgctccgcgcctgaaaaattggacttaaatataaggcgttgatgccacgggctgccaataatggcagcttttgttgaatgccagtcagattaccgccgtaaaaatcccagcgaatgatctcgccatcgttcccgcgaatatacatgggccgatcggtttttcgcccatacagaaaagagttttccttcggagcattcacgtgaccgtcagcattcccattattgaagcgatctacgaagatatgataaaaacgggcattttgataccacgccggaacgggatcaaatgcggtcacaacggtcatctgataattaaccacatccacattttccgggtaaagctgaccaagcccgccaaagccaccgccgactgcaccaaagcgttcccggccattgtcgctttgcaactcaaaatgataaaaccaaagaccggcattaggaggcgtaaacgtcactgtgtagccgttagggcttttcgtcatcggcaaggattgcgtttgatcgcaatgttcgtctggcatgatgacaagtgtggcttgtgtcaccgcaccatcagcctgtgccgtcaatgtcacagccgtgcctttttgcaccgcgccaaaaggtcggcgatcggtaaatgaatcaaattgaaacattgtgttcctccatgtgtcatgtacacgaaacgttctcaaaaccgataaatgaaccttcattaatcacgcaaccgatagctggattgataacaatgagcgccaaggcatgctgatcagatgctattctacgtcgagtgtttccgataagtccgagctggcgtcgcggcgattcaggctggtggctgctcgaccaactttctgcatgttatctaaaaaacaatcaccagaagtagcctctgtatgaccgctttaagcctcgtgatcatcttctggtgtctttgccaccacatgccaaatctcgcgaccataacgttgaaccgtaaaatcggccgagaatcggccactttcggcaatattagccaacgcctttttggcccaaatgcgcggttgttgataaagcttatccagtctttcgttcgcagccagataactttcaaaatcggccaacacgaagtattcatcgttgtaagtcaacaacgaattgaaaatgtcacgaccttctgtttcaatccccgggatctgcccattgaccagcatatccagtgcggcgtgcaagcgtggatcttgatcgtaaaagtcgcgagcatgataatcgccacgctggtaataaccggcaatttcttcctctgtcaacccaaaaatctcaacgttgtcatcacccacggcatccttaatctcgatatttgcgccatcaagcgttgccaaggtcaaggcaccagcactcatcagcttcatgttactggtgccgctggcttccttaccggctgtggaaatttgttcagaaatatcggccgcaggaataatcttttcagccatggtgacaccataattcggcaagaaaacaacttgcaagtacttgctgacatctggatcaccgttgaccaaatcggcaactgcattcataaccttaatgatttccttggcataaacgtaacttggcgcagctttagcgccaaaaatgtgcaaacactttggtcgtttttcgccacgtttgatcgccaagaaagcatcaagaatccctaagacatgcaataattgccgtttatacgcgtgcaagcgtttgatctgcacatcaaaaatggcatcaggatcaactttgacgtgcacaacttgatcaatatacttcgccaatgctcgtttattttcggccttagcagcattcaaatcgtcgagaaaccgggtatcatcggcgaagtcatgcaactgccgcaatgccaacgggttttcccgccaagttgtgccaatttttttatccaaaaggtgggaaagcggtcgatcgccaatttgaatccaacgccgcggcgtgatgccgtttgtcttgttattgaaccgttctggaaagatttgatacaagtcatgcaggacgtcttttttaagcaactcactatgaattggggccacgccattgatcgcatgggaaccaattgatgcgagataggccatccgcacctgtccgttaccaagcggtgcaatccgatcaatcattgcttgaccaaattgcggcacgaaaaccagccggaagcggcgatcgatttcctgaatgatttgatagattcgcggtaccatgccgctgaacatgtcgattggccaaacttccagcgcctctgacaacaacgtatgattcgtgtagctcatcaccttgagcgtaatgcgccaagcttcgtcccagctaacatgctcatcgtccattaacacccgcatcagttccggaattgccattgctggatgggtgtcattgatatgaatggcaacgcgatctgcaaacccggccatgctgttgtgggttcggcgataatggcggacgatgctttgaatcccagcactggtaaagaagtactcttgccgcaatcgcagctgcttgccggatgcatcggaatcgtcaggataaagaatctgtgtaatctgattgatccgttctttttgttccaacgtaaaatcggtgccggcattgatcggtgcttcagcagaccacagacgcaggttattcaccacctgattgtggtaccccaccatggccacatcgtatggtacagccaatacatcgtcagtattgtgatagatcacccgcagattgccgctacgacttgggcgtaactcaaccgagccgccgaatttaaccgtgactgcgcgattttctttacgagtctcccatgcaaagccattccgcatccaatcatctggcagctcaacttgatacccgttgacaaaggcctgcttaaacagcccgtactggtagcgaataccattgccgttaccagccatgccgacactagccatggcatccataaacgctgatgccaaccgacctaaaccaccattgcctaaacctggatctgcttcagcatcaaaaattttctgcggtcgcagtcccaactcattcaaccctgcttcaacttcactcagaatgccaagatttagcaaattcgactgcagaagtcggcctggcagaaactcaattgaaaagtagaagacctgtttcgtctcctcctgatcgtaacgtttcttggtttcggcccaaggttggccaatatatgaccgcgttaatagtgccaacgcctgataaagctgttgggtggacaggtcatcgagcggtgctgcatacagcttcaaagcaatatctttgaattctgtaatgaattgttcctttgttaatgacataaacacacctcaccaaattaaatacagcaacttttaaacgcaacgcaccccgggagtgacaccatgtcgtcgtacccacggcgactccaaaacgagccgaaactcattttgataaacaaaacgaggtcggatcgggtcaccttgccagccggtttaacgcatctacgcctcgcctgccttccgactgatcccgacacgacctcgctgttgtcacctcatgctttgcccagaatgcgttgataacctttcaaatactcagctgcggaatggtgccagtcaaagtccttcaccatcgcatgttgttgcaacttagcatagacttttggctgatccgcataaacactcttcgccatgcgcagaatgtttgtgagcacgcctgcgttgtaatcccagaaactaaacccatcaccggcgccagtttcagcgttataggctagaaccgagtcacgcaaaccaccagtttcatgcacaattggcagcgtgccatagcgcatcgccatcatttgtgccaagccgcttggttcaaaggcacttggcatcatgaagtaatcggcgccggcataaatccgctgcgctaagccttcatcaaaatcaatccgcaccgccaattggccagggaaccgatcctgcaatgatgacaaatcttcttccagatcttgatcgccagtaccaagaaccacgacctgtacattattttgaactaagaaattctccaaagcatcaactaagagatcagcccctttttgccgggtcaagcgactgaccatcgcaaacagcggatcagtcctctttggtaaatgcatctcgtcttgcaaagcctttttatctttggccttgccagccaaattcttggcgtcgtacttataagccagactctgatcagtggctggattatagacttcagaatcaaccccattcagaatcccgaccagtttaccactttgttttcgtaacgtgccatccaaatgctcgccaaaggctggtgtttgaatttctttggcgtaactcggactaaccgtcgacacaagatcggcgtaattaatcccgcccttgagccaattgattgacccgtcttgaccaaagccatcgtcgttgaaaccttcacggccaataccaaaaacggtcgctaacgttgacggcgggaaccagccttggaattgcagattgtgaatcgtcagttgtgtcttaatctgttgatacggcttgatccaaccatacttttcttttaatagcaccggaatgaaagctgtgtgccaatcgttggcatgaatgacatctggaatccattcaatcacctgaagcatttcaatcacggccatttggaaataaccaaaccggccgccgtcatcccagtaaccgtacaagccatcccgatcaaaatactgccgattatcaatgagatagtacgtgacatccccgagtttaattgttttaaggccaacgtaaactggacggccatccatctccaaggtgaaatgggtcaaatccttcactttaggcagatacttcgccgggaacttcttttcataaaatggaatggcaacccgaatgtccacaccttgcttcttaattgctttaggcaaggcataggttacatcccctaaaccgcctgttttataaaacggcgcactttccgcagctgtaaagagtactttaagcacgggccgtcaccccctggccatctggctgaaagactttctgattcttcgaaaagaccaatggctcctcaggggtcccttccaacgcaaggtttggcccaatgaccacacctttgtctaggatcgcatacttcacactggagcctgtgccaatcttactgccttgcatcacaatactgtgatcaaccactgcatcacgatgaatatgcacatttctgaagagaatcgaattatcgaccgtaccttcaatgaagtcaccagtacctaacaagctgttggtcaccttggattcggttgaatagaaggtcggaatttcattcttattcttcgtttcaatcgaattagcactataaagcaacgcttgatagttttggtcttccaacatgctcatgttcgcgtcaaaataccgctgagtcgtattcaactttgccagaaaaccagtatattcaaacgcgttagcattattttccagtacggcttcacgtagaatttgcggcaaccgtttgaatgttggcgcttcggaggcatccgtcagaagatcaatcaagtcaatcgtcccgatcagataaatatccatgaacgccgggatcttaccttccttgagatgcccacgattttccgatgctgggacaactgagctagccgtgccaagctccgtcatatccaacgttaagtcttccggcttcatcgcttcttccggcagattcttgtaaaccgccgtcaccggactctcgccagcttggtgataggcaacgatggcatcgacatcaacattggccacaatttgcgtacccatgataatcgtgtactgcgcgctgcttttgcgcagaaattggagatagtcgtcaaaataccgcgcgcgtaattttggatcttcatagtcgcggccagccatatacggatacgtgaaaataccaccagtaatctgatccacgttccaagtcgacccgctacgaatgtggtccgtgaaactacgaccggactttggcaggaaaatcgccacgctgcgcacattggcatgatccaatgatgacagtggaaaatcgatgagacggtagcggccagcaaacggcaaggtaccgatcgggcgggctgctgtcagcggctgaatttggttgtctggttcattcagatcaataattgctgctaaatcgccttttctcattctttttcagtccttcctaaaacttccccataaccaacaacgctaatttcattcggtttgccgacaactttaccattgtccccaataatcgcattttcaccgacaatggcatgatcgacagtcacgttcttaccaataacggcgtttggcatgatcatgctgtccttgatcacggagccttcaccgattttgacgttttgactcaaaatactgtgctgaattgaacctgcgacatagcagccgtcaacaatcatggagccagcaactttggcggtcttggtcaggaacattggcggcagcgcctcgttttgactgaagatccgccagttgcgattgccaatgttcaatggattgttaggattcaagaattccatgttagcttcccacagactctgaatcgtcccgacatccttccagtaaccgcggaaggcataagcatagctggcttcattatgcgtcacgtaagctggaatcacgtcatggccaaagtcttccatggcaccatctgttgcataactttcggtcaaatattgtttcaacgttggccagttgaaaatgtaaatccccatcgaggctaagttactctttggcttggctggtttctcttcaaattcaataatccggtccgtgtcatcggtgttcatgatgccgaagcgtttggcttcttctttttcaaccggcatgacagcaacagtcaatgaagccttcttggccttgtgataatccagcatcgcttgataatccattttataaatatgatcccctgaaaggattaacaaatattgcggattgtacgagtcaatataagcgatattttgataaatcgcatgcgccgtgccttcaaagaacttttcgccttcacttgaagcgtaaggctgcaggatggtcacaccggcaccgcgttcattaagcccccagctggcaccattttgaatatggcgattcagctcaagcggttgatactgggtaatgacccccgcggtgttgacccctgaattagctaaattactcagagtaaaatcaataatccgatatctacctccgaatggcaccgaaggcttagccgtcgttttggtcagtttccctaaacgggttccctgccctccggctaaaatcattcccaacatttcagtactcatgattgcggcgcattgtgcgccttcccccctaacttcttcgattgctgatggttaactttgctaatgtcacgtggttgcgaccgcgctggcgatgtgccccagtcgtcttgatgactaatcggttgccgttgatgaccggcgagtgacaacggtgtttcgtgtttcggtaatgccttggttggctgcttgcctttaagtgccaacggttttttcggcaacggcttcagctgttttggtttaattaacaaagcgcccattgctggtaaaatgacgtcaagccatgcaggaacgtcatggttttcgccaatctcagcagtcaaggtctgctgccacttggtccatgtaccgccaaaagccgcatcctcagtatttaaaataatctcgtacgttcccggactaggaactggcacgcggaaatgatctttttgaactggcaccagattcatggccactaccgtaaagtcatctttttgtttgccataacggatgtaactcagcacatccggctcatcggcaatcgtgattttgatgccgtcgggttcatgatcttgttgccacaaacttggccgagctttataaagatgattcagtgtgatggtgaaatgctgcatcttcttattcattgggtctttaagatcggtccactccagctcgctccagtcgcgccattcaagaaactgcccccactcgctgcccatgaataatagctgtttaccagggaatgttgcctgccacacatacatcgtccgaagattagcaaactggttataccgatctcccggcattttgtgcatcaggctctttttgccatggacaacttcatcgtgtgaaaacggtaagacgaattgctcgttatacatatacatgaatgaaaacgtcaataaattcatatcactgtggcgataaaccggatcctgctcgaagaacttcagcgtgtcattcatccagcccatgttccacttgtagttaaaccctaagccgccagtatcaatcggtgctgaaacttgcggataggcggagctttcttcagccatcatgagcacatctggatgtttggcaaaaatctttgtattcaattgcttgataaaggcaatgccttcaaggttgtcacgcccaccatccttgttgcgatcgttttccttgccagcgtcataatccatgtacaacatgttcgagacagcatcgacccgcaggccatcaaggtggcagtgatccaaccaatacatcgcactggaaattaagaaactctgcacttgtgccttgccaagatcgaagttccaagtcccccagcggacattttctgcgcggtgcggatcggtgtattcgaaggttggcgtgccatcaaattgggccaacatatcggtgtttttgatgaaatgccccggtacccagtccatgatgacgcctaatcctgctgtgtgagccgcatcgaccaaccgcaagaagtcttgcggatcgccgaaccggctcgtcggcgcgaagtaacccattaactgatagccccatgaagcgtcaagcggatgctccatcaacggtaaaaactcaatgtgggtgtagcccaactcctgcacataagggatcagcttgtcgatggcgtcttgatacgtcatataaccaccatctggaccggcattggtgtcgcgaatgaaggagcctaaatggacttcgtaaatgttaagcggttcatcataaggacgccattttgcccgcttggctagccaaccttcatcatgccaagtaatgcgcggcacatcgaccaacttagccgcactgcctggcttgcgttcaaacccaaacccgtatggatcaatcttttcatgggctatcccatcaggaccgataatccgatacttgtataactgattcttttcggcggcaagctcaccgtaccaacaaccggtggtgccttgcagtttcaacggactgccttgccagtcgttgaagtcgccttcgacgttgacttgttgggcatgcggtgcccaaacgaggaaggaccacttgcctggttcgacttcatgggcgccaaaccgattgtaactttgaaaatcttgcccggagttgaagaggtataaccaatcttttaatccctgaatcatgatcactcccccaatcaaacgataccgtcgtacatgtgaaggcttctcattcactgtacggccggacttttacctaccaattccagtgtaacagtaagactatcaaaaggctcaagaaacgctcaccaaaaaccttcacgcacgccaacataaattttttgataaggcatatactcccagtcctcgtctcaattgtaaccgcttattgttaatattaacagcgattacaatcttttctgttgagttctttgtgagaatactctaacatgataggtatattatttaatgaaaccgcaatgttcacgcaacgttactctgaaatcaacctcagccggctgttttcagtcagacgcacacaaatactggaggtactgccatgagtgtcaatattgattggaacaatctaggcttcgattatatgcaactgccataccgttatgttgcccactggaaagacggggcatgggatgaaggtaagctgtccaccgatcccaacctgacgatgaatgaaggctccccgattttgcattatggtcaaggcgcgtttgaaggtatgaaggcttaccggaccaaatcaggaaaaatccaacttttccggcctgaccaaaatgcccatcgactgcataattctgctgacaaactactgatgccgccatttcctgaagatcgctttattgatgcggtcaagcaagtggttgccgctaaccatgaatacgtaccgccatatggcaccggtgctaccttatacttacgcccgattttgattggtgtcggtcccaatatcggggttgctccggctaaggaatacattttcgatgtcttcgccatgccagtcggcccctacttcaaaggcggcatggtgccaaccaagttcatcgttgccgatcaattcgaccgagcggcgcattacggcactggccaatcgaaagtcggagggaactacgccgcatccttgcaagccggcaaattcgcccacgagcacggttatggcgatgcaatctatctggacccaattgaacataaatatattgaagaagttgggtcagctaacttcttcggcattagcaaagatggtaaaactttgaaaacaccgaagtcaccatccatcctgccaagtatcaccaagtattcgattttggcactggcgcatgatcggtttggcatgaccactgaagaaactaagattgcgattaccgatttggaccaatttggtgaagccggggcctgtggcactgcggcggtcatcaccccgattgccagcatcacctacgaagaccacgaacatgtcttttattcggaaaccaaagtcggtccatatacacagaaactgtatgatgaactgacgggtatccagtttggcgatgtaccggcacctgaaggctgggtcgttgacgtcccgtttaattaatttaaaaatcatttatcactcggaaactgtgagttcttgcacgcgctataacgcatctgtaatcgcctacgcccgctcacgcttccacaaaaaaagcagctgcccgttttaccggcggctgcttttttgtgaggaaagtcattttgcctaattcaacaatataacagtcaatcaattcaaaacttactaagcaactttacgaaaaagcctggaacctgacaacctgaaattgaaagccaaaaaacaatgatgatcactcaacatccttaacgtgcaaaggcaatcaagcgccagtagttacctacgcaagtttgtaaggtaatgcgctgaccgccgccagtacccgtgattgcgttccataaatcttgtccactggcagtgacggcatttggattcactgtcgccaattgataaacatggtacgtgcgcgggttaccagcagcgtcggtcactgtgatcggcgaaccaatgccaagtgatagcatcgcggcaaaagaaccaggattgtggccaataaaatgcgtgttttgaccactattgttactataatttgcttgaccgccccacgttgcagctccagtgcccggtgctgcagtcatactttcatttccaatgatataaggcactgtcacacctgcaaacattaggacgcggctcgcgtaagcaggtgcttgctgtgcttgcggttgtgctggttgttgagcaggttgagttgccggttgttgcgccggttgttgttgcgccggttgttgttgcgccggttgttgttgcgccggttgggcagcagtcgcggtttgtgctgcagacggtgctgccgatacagtcacttcggcagtagaagtcgaagcccctgtatttgaatcagatgaatcagaagtagcaacagcttgttgactagccggtgcgcttgaagcaacggatgtacttgccgccgtctgtgatgatgatgcagcagacgttggtttagtcactgaaacagtgcgaacgctccattgcggatgtgctgcagcctgtgatgcaggtgccttggcagcagtggcatcgagcaaatcgttagaactacttacagtattaactttctccctcatgcttgtgcgcgatccggccaagtcttgacgctgaatggtggtgcctgctgcagtggtgataagcagcccactcacgacaagagcgaaagtgatgagacttctgcgtaacatatagactcccccagtccatatcggcaaaatgacttaccacatattcttttcgagatggccatctcatgctttttattatggcgcattagttttgtaggtaaacatatatgcttaccgattgtaagtgcttaacgttatttttaagttaaataatccttatttcatgcatttatcagtgtttaacgccatatttgctaaacattcttttcaaaagttggttaaaaccgttagcattcaaaccgacttttgagatttaaccgtttgatttctaaccaaacgactcacgcttatcaaaaaactgcgacaacgtccgaattttttcgggaacgctgtcgcagtttaataccatgatgaagcttaaatactgccgccatgaacctcagttgctgccatggtcaagatgaaagcattgggatcaattgcgtggactaagtcaatcagatggcggaagttggcttgttcgaccacgaccatcaacatctccttagactcatctgagaaaccgccaacgacgcgttgcaccgttaagccatgcggcgtttcgtcgcggacttgctgtttaatcgtcgccaattgcggactcatgatgtaaactgcctttttccggtcaaaaccggtttcgacataattcatgaccagtccggtaatcgccaaagcgaacacggccaagatgaaggcctcaacgccggatacggggatgttaaaaagtgacacgatcacatcagtggctagtagcatgactgatggtttcaagccaaagtattttttgaaaatgagcggcggaaccgtggtcccaccgcttgaggcatccatttggtacaggaacccaacaccaaaggcaaacacaacactgccgacgatgatcgccagcaaccgatctgtgaccaggttgatttctggcgtcagccatagcagcaatggcaacatgaagctgccgaataaaatgcgttttaaggtgctgcgatccaagaagaaccaagctaaaagcagcataagcaagttgacgcccatggtggtgataccgacttgaatgccggcaacttcttgaaccaaaatggcaattccggttgcgccgccagctgcgacagcgtgaggtgcatagaacatgttaatactgattgcgatcagctccagcgctgccacgatccaaaaccatttgaatatcggatgacgcatcgttttctgcatcaagccaccctttctgttaatcatgtttaaaccgactcttatcgtactaataactatactggaaaagtggtggtgtgacaaacagacgttatttggcgtgtggtttggttttttatgttctatttctgttaggaaatttccgaaagcccgggctggctacgcggcgattcggggtggcgaccgcgaagctagcgcactgggcacgacttcaagcccgcaaagcccccgcggtcttgaagctcggccttggtctaggcggagaaaaccacgccaccaagaccaatttcagtgctgagcccatcgccgctccaccagccctcatcattctattctagaattcgagagaagttgacgctcgcactgttaatgaaatgatgcgaaataacacctgcttaagacagccaacccaagatataaccaccaatttaaaaattagggaaccacacctagacaatacccacgctttctagtcctcttcccgcaattcacccaagcgccgcttcaatacctcaacctcatcctgtagctcagtgccgatgtctgtttccgccactgttcggcgccgggcttcggtttcgacgacgcggcgggttgaaatgatatcggtgaggttggcgatagcatcggcttttgtggtgaatggttggtgcgttactagctgcatgccataggaattatccaaaagcgtgtaaccgccgatcccggtggttttttgatacggtttagaaaagccgccgtcgatgacgatcattttgttgtttgccataatgggatcggtgccctttttgactggcgtatgaccattaatgacatggccgacttcaggatcgaggacaaattccgccaagatttttttgataaattctggatccttacgcaggtgataatatggattacggccttcgacatgggctttcggatcgctaatgaaatagcgttcaaaggtcgtcatgtcgtgcttgccaaaaagcggtgaatttggaccggtccagagataccacatcagatcagttgctaagtccgcattctccgttggttgactgtatgccaaccgaagatttgcttccagcatgtcaaatagttgacggccagtataagtcgtccctttaatggtcaagccaataaaatggctgtcctcgtccaccggcacacacccgtgcagcaacaaattccggttgtaccgcaaatacatactgccgtgatcaagtagaaaatccatgtggcgatgcaacttttcggagtgcgtaaaggactcaaccagcgagtcaatgacctcttgctcctctggcaacaactcgtaaggatcagccggatcaaccgtcgcaaaacagccgttttcaatcgtataagtatcaccattcaacttgatggttgagaaatcaggcgccagtttctccagcactagccgatgattcatgtcaaattcaggccgacgtttaatcactggtccttccaacttaaattgaatcatcgcaatcgcctgatgaatctgggtaatttgaagtcgctccgcctcagtaattggtcgatctgatcgctccatttttggtgaaaaggcgggattatcttgatagtattgttccgctaatcgggccaaatgccgcaaattaatcccataaacatcttcgagaatacttaaattgttataccgcgcggaaatccgcaccaaattggcaatgcacaaagccgagcccgcggcgccgccgatccaaagaatatcatggttgccccattgaatatccactgaatgacgccgatcacgtctaatcaagctttcaaccacctgatccggcgccggtcctcgatcatagatatcgcctacaacgtgaaagtgatctaccgttaaacgttgaatcgtttgacatgttgccgcaatccactgatcggcctgttgaagaacgattaaattacgaataatttgccaataataagccagcttgtcggacgtatcggcatcattgtacagcaactcttcggtgataaagacaaactccggtgccatcgccttgcgaactttcgaacgcgtgtatttggtcgcggtgaacgccagcaagcgaatcaaccggcgaaacgtcgtcaaataccactgttgcaagtcatcctccgccatctcccgatgaatcgccgccattcgctcagacggatagtacaccaaaaaagcgaagcgctgcagggtcgcctccgtcatttcatcgcgaaaacaggaacgaattttgcttttcacattcccgctgccgttccgcaaaacatgctgaaaagcgttatactccccgtggatatcgctcataaacgcttccgtcggcttaggcaaattcaaaatggcttccagattaatgatttcagtcgcaatcgccggcaccgtttgatacttcgccgtcagttcactgtacaagtccatgaaacagcttcctttcacatataccaattttggttcatggcaataccatagcataatcctctagattgtatacggtttcagctaatttcaccatttccgcttgaaaaataacctctgattcagctctgtcgtcactatcatgtcctaacattcatacaaaaaagcccaaatgatccctcgctaatagtcaatgatgaatgtccaacagtaaacagcgaccagttctcggttcaccgtcatcttgcgattgtcaattgctcatcaaaaccaactcggtaacaccccaagcatacgcaccaaggtttcctcacccatgacgctggagccaccatacgctaatgaccaatcgcatcaaaaagcacaaaaaaaaccgtctaaccatagacggctttcattgaaacaactagcaaaactgacttaactgtgcgcgtttttaaacacttgaggtactgagcaacgccgcccacaacttctggcgccgaacttcgcgtggtaaaaatacccgcaccgagtcctgattaaacccaaataacagacgacgatcgtccacaatgatcggccggcgcaaaatcgctggatgctccgacaaaagggcgaccgcttccttcaacgacaacgcatcaaagtcaatatcaagggcctgaaacgcctttgaacgacgggaaactaaactatcaatgccatcttccgaacgagcgagcaattccaaaatctgcggcttgctaataccttgctttgaaagcgaaatctcttgaaacggtaatccattcgcttcaagccatgctctagcttcacgactcgattttgacgagcccgatgtatacaacttgatcatccaatcacctctcaacgaaacaacaattatttattattgtttctttgccaataccacccacacattagatgccaatcacattcacaagtcaaaaagatttactcacgacacgtttttattctctttataataacttaccatagtcagatgattttcacaataatggtactcataatttcgttcatagccatcagtgacagctaatcattgaaaagccatctaaatcttctttcaaaatgagaagtccctcctgaataaaagtagtaaagcccataaataacaattgcacgaacataaaaatcgtcataatttcttgtgaattactagtacaatccttgatacattatttttgcatcagcggttagtacacaacaaacttagcacaagcttatatcgctttcaataacattttttcaaaaatttaatttcaaatactaacaattaaataaaatcgatgacaggaaaacagcaaattccttagaggctcatggcatttcgaattgattcaaaatcatcgactgccaaaattcacaagaaaagctgtgcacaatttattttaaattttattatacgacttattgtagatcaaaaaaaaccgccaagtgcatgtgcacttgacggcagacgcgaacattacttcgcaccatcggctacttgctttgatttaccagctgtcggttgcttctcgctaatcacaattgcatcatcaaccagatcagcttgcaacttcttagcctttaaatgatccaaatagaagtcagtcaccttatcacgaatgttgcgttcaatcacacgccgtaatggccgtgcgcccattgcttcatcataaccttgttcaatcaaccaatctttagctgctgcggtgacagttaacgtaatccccttcttggtcaaggtggtgttaacgtcatcaagcatcaagtcaacaatcttacctaaatctttcttggtcagatgactaaactcaacgatcccgttaaaccggttcaggaattcaggacggaagtaaggtgccaaccgcttcatcagatctttgtcttgctccttcttgccagtcagcgtctcgttgccaaagccagcattggaagtcgcgatgatcactgtgttcttaaagtcaaccacgttaccttgaccatccgtcaaccgaccatcgtccagcacctgaagtaacagagtcaaaacttgcggatcagccttttcgatttcatcaagtaaaacaatcgaatatggattgcgacgtacttgttcggtcaaggtgttgttgttgtcgttatagccaacatacccagcactggtaccgatcaacttggacactgccgtacgatcactgtattcagacatatccaagcgaatgatcgcatccttgctgccaaaaagatctaacgctaattgcttggccaattcagtcttgccgacaccggtaggcccgacaaagaggaaactgccaattggccgattgccttcatcaaagccggctcgattgcggcgaatggcgcgagcgaccatctcaacggcttcgtcctgaccaatgaccttgcccttaagacgcttaccaatacccttcagacgttcaatatcggaaacgccaagtttggaaactggcacaccagtcaagcgttcaaccgcagccgctacatcattaggcgttgcaacgacaggcttctcgtctttcgtaccatcaagctgatgttgcttgtcggcaatcgtcttcttaaggttagcggctttttcgaagtcctccgccttggctgcagcatccttttgagcgttcagatccttaatctgtttctcgagttcaaccttatcaacaatcggatgcttgcttgccaaatgcgccgccgtcatgtcaatcaaatcaatggctttatccggcaatgaccgctgtggtatatattggatactgtaatcaaccgcagccttcaaaacattttctggcaattgaacgtgatgatgctgttcataaagcttcttgatgccttccaaaatcttaacggtatcagccgcggtcggttcattaatggtgacagcgttgaaccgccgtgccaacgcgctgtccttcatgatcgtgttgcgatactcatcctgggtcgttgcgccaatcacggtaatctcaccgcgagatagcgccggcttaatgatatcggccaaccctttgccgccagactcttcgccgccagtcgcaccggcaccgagaatttgatggatttcatcaaagaacagaatcacgttgcctgccgctttgacttctttgatcagattctgaatcttctcttcaaaactgccacgatactgcgtgccagcttcaaggttcgacaaatcaattgaccaaatctgcttgtccttgatcgactcgggcacattgcctttgacaatcgcctgcgccaaaccttcaacaaccgccgtcttgccgacaccggcatccccgaccaaaatcgcgttattcttcgtccgacgactcaaaatttctgctgtttcttgaatttcatgctcacgaccgatcacaggatcaagcaaaccgtctttagcttcctgcgttaaattacgcccaagcttttcaagaatgccaccttttttaaccgcctgttcaccagtcgtttcaactggaatttcgtcaccttgcttcggcaactgcccagttgcccgatactgtgcgaattcatctggcgtcatttcgtgaccatttaccacataacgggcagattcacctttgcccataccttgtaacatttgattaaaaacatcatccatatcatgattgaaaaacggatcgttaaagtttgccataacttcattcctccttgttgggaaagtgctcggaaaaggcgtggtacggaggcgtgctatgcagctttacaaaacgcgctcgcgggtcgcagcaacctccgtgtaaggacctaccaaaacccagtcagttaggttcaaggccgcttacactccggttgctaaacgctcccgctcccgctctgctccatagcaaaaagtaatcccaggcgcactggcagtacttttgtgtcgaacttattcacttgttggcacgtttgccgttgcgccttttccttgtttacataaagtagtatagcatgattttagcattcatgcaacgagagtgctaaaatttttcaaaactattttcgtaggcaaacacccaagtcgtctaataccgtgacaaaagccgcttttcaactttatgctcattaaaacgcaccaacggatccccgttaacaagtgctcgggcattctcttcaaaaatgtgtgctttcttctcaccacgcttgcgagttaaccgcttgaaggcatcactcatttcgtagctccggcccggcaaatgatgggcgtcagacgcaaaaacatgtgccaacccggcatcaatgatgtcttcagaaaattgctgcacctttttgccaaacgtgcctacataactgctggccgtcacttgggcaaacgcaccgcgctcaatcatctggtaaagcaaccccggatgcttcatcaaacgagtattgcgctcaggatggacaatcacaggaatcatcccacgctgcatcacctcaaacaacatgttctgggtatacagcggcacatcatcagacggaaattcgatcaatacataatgacctgacgcatcgcaagtcaaaatatccccatgatcaatcgcgtccaacaactggccattaatccgaacctcttggcatggataaatcgtcaacggaatgttgttgcgatccaactctccttgaaactcgtctgtcatacgaatcacatccgcagcgtgattcgtataccgtccattcatgtggtgcggggtcatcaacgcatgcgtgatcccgtccgcaaccgccgcttgtgctaaatctaatgaagtcatcaagtctttcgacccatcgtcaatgcccggtagcatatgacagtgtacatcaatcatctttcagttccccttccaatatgtactagtatctaatgaagcgctgacaaggtcaaatcgttttttgtaacagtttgttaacgatttgcaataaaaccccatcagccgcgcgagattcccaactttgcggtataatattggaatattcggacactatggaggaaatgaggtttagaaatgaaaaagatcctagtacgcgttttactcgtgctactcgttgccgctcttgggtttggcggtttcgtgtattacatggtacataattccacgtcccagatttattcttataataagaagacgaataaatcgtcggacgataagactgctagcaaaaagtccgttgcttacttgttactcggtacagatactggggaactcggaagatcatataagggccgtacagatactatgattgttgttgtagtcaatcctaaatcaaaaacaacgacgatggtctccgtacctcgtgacactaaagtcaattttgacgatgtcacgattaaaattaacgcagcctactcttatggttcttccgatacagccatggctgctgttgagaagctcctaaacattaaattagatggttatctgctagtgaacatgaaaggccttgagcagctcgttgatgccgttggcggcgtcacagtaacatctccacttagctttgactatgaaggcaagtcattcgttaagggccaatcctatgatctctcaggtagtgacgcgttgaagttctctcggatgcgttatgacgatccacaaggcgactacgggcggcagatgcgtcaacaacaaatcctcaccgcagttatcggcaaagttaagtcaaacccgacaaccgttctaagccaaaagttcctagacgccgttggtaaaaatattcgaaccgatgtgtctctgggctcggttaagaacttagcaatggagtaccgcgatgctggcaatacgattaaaagtgatcagttgcacggtacaggtcagaatattgatgggcaagattatgaagtgatgtctgattcggagattacacgcgtgcataatctgctgcagaatgcgcttgacgcaaagtaaaaaaaggggtctacactttctggtgttgagaaataatcaacactgaacgtgtaggccctttgtctcgaagtcgcctaacaacatcagcgacaaagcccggtcgctgtgttgtttgcgcaactgagccccatctggcctacgattgcgccgccttggcactgggatctttgacttcctacgagctatttatcaaaaaactaaagacgactgatttctccacgtagtagggaaaccagtcgtcttttagtgcctgtaaaacgatattccaacctcaattatttcgtgaatgccaaggtgatcacgtaccgctagtgagaagcaatcatttcctcatcgcgagcaacttctttcaacacattgctaaccgcagtaccacctaacgaagtccgtcgatctacggcggcctttgacgttaattcagcgtaaacatcctgctgaatttgcggtgcggctgcttgcaactcgcttaacggcatttcctgcaaggcagtgttggttttgatccccttgagtaccaactcaccaacaatggcatgtgcctgccggaatggcacaccctttgtcgcgaggtaatccgctaactccgttgcattgctgaagtcatgcgtggttgcctctgccatccgtttttcgtgaacggtcaggtagcttaacatgccagtgaaaatgtgcaaagagccaagaatagtgttataagcatcgaaaatgggttctttatcttcttgcatatctttgttgtaagccaacgggattgccttcatcgttgtcaacaagccaattaaggcgccataaacacggccagttttgccacgaataagttccgcaaaatcaggattctttttttgcggcataattgagctaccggttgaaaaatcatcgccgagttcaatgtaattaaactcgtaagtggaccaaagaatgagctcttctgccatgcgactcaagtgctgcatcaaaatggcactattgctgagaaactcaagcgcaaagtcgcggtctgaaacagcatcgaggctgttgtgataaatttggtcaaatcccagctcttgagcaaccagcgtccggtcaatcgggaaggtcgtaccagcgagggcggctgcccctaatggcaaaatgtcggtgtgcttttgggtaaagtcgaaacgttcccaatcgcgctggaacatttcgaaatacgccaacaaataatgaccataagtgaccggctgggcgtgttgcatatgggtataaccgggcatgattgttgctgcgtggaccttggcttgaccaaccaacacggtttgcaggttggtcaaagcttctttgattgttggtaggcgatgtttcagccagaggtgcagatcggttgcgacttgatcattgcgcgagcgggcagtgtgcagtttgccagcaacggggccgatttcagcggtcaacagggcttccatattaagatggatatcctcattttcaaccgtgaagtgcagtttgccagtagccaattccttctgcagatgctgcaaacccgccgtgatcgtgtcggcatcggcttgggggatgatgccggttttgcccagcatcttgacatgtgcaagcgacccctccaaatcttcttgggccatttgctgatcaaaaccgatggaggctccaaaagcatcaacccagtgtgccgctttttcggtaaaccgaccgccccataacttatcagtcatgttgtttttcctcggagtgcacatggttgacttgctcgaaaacggttgtcggcaaggtccagagtttgataaagccagctgctgcttcttgatcgaaggaatcagcgcttgtgtaagtcgcgagatcttcatcgtaaagcgagttgtgggcggatttgcgagcaacggctgtggcgttgcctttgtaaagcttcattttcactgtgccattaacgacagcctgagtcttgtcgatgaacgccatcaaggcatcaaacaacggtgagatccactgcgcttcatagatcatgttggtgattttatcttcgatggttggtttaaaatgctgaacgtcacgttcaagcgtcaggttttctagatcgtggtgggctgccataatgacagcagcggctggtgcttcatagacttcacgcgacttgatgccaactagccgattttcgattttatcaatccggccaatgccattgtcgccagccagcttgtttagctccttgatcatcgttgccagcgccatgggttcatcatttaacgccaccggaacgccttgcttgaaggtgagatcaatgaaagttgggtcatcaggagcggcttcaggcgaaacggtcattccccaagcatcatctggtgcctggttccaaggattttcaagaatgccggcttcatttgcacggccccagaggttggcatcaatggaataaggagattttttaccaattggtaccgggacgttatgctccttggcgtaatcaatttcttcctcacgggaccagtgaaaatcacggatcggggcttcgattttcatttccgggtccaaggcgtggatcgcggcttcaaagcgaacttggtcattgcctttaccggttgaaccatgggcaatcgctgtggcattttgcgcgtgggcaattttcaccagatgttcaatgatcaatggccgagataaggcggaaaccagcggatagtcgccttcgtacaaggcattagctttaatgaccggggcaacatagtgatcggcaaattcatcttgggcgtcaaccacaatcgaatcgagtgcaccgacgttcagtgctttttgctgaatggcgtcaaagtcggcttttggctggccgacatttaataccaccgcaatcacttcatagcctttgtcttttaaccacgggatggcaaccgaagtgtccaagccgcctgaatatgccagtacgattttttctgtcatgagttaaaaatcctccttagttttgaggtgctatttgagcgttactttgatcttaattaaagcgtttttcaatcagtcgcagcaggcgtgaaagggtgaaggtcatgatgaagtagagaattgccacaacgactagcggtaagaatggtttgaatgaagcaccttgaacgacggttccttcaaacatcaattcagtggcaccgatcacggacaagacggaactttccttgatatcggtgacgaattcattacccaacgctggccaaatattctttgttgcttgcggcaggatgacataacgcatggcctgaccttgatggagtccgagtgaacgggcggcctcggtttgaccgatcgggacggagttgatcccaccacgaatgatttcggcaacataggcacctgagttgatggccatggcgatggcaccggcaacgaatgcgctaagatcgagaccgagaatttgcgttccgaagaagacgatgaaagcctgcaccagtaatggggtaccgcgaatgaattcgatgtagacgttcgcgattgccttggcaaaccaactgtggcttagtttcatcaaggcgagcagcgtgccaatcacagtcccggagaaaacagtcaaaaccgcaaagatcagagtgtagagtgcgccgcgaaggaagtagttgccatatttagcccagaaactttggttttgatcctgtagtttataagcggcttgcagataggtcttgtatttggcgcctttgaccttactgattgtcttgttgacctgagcgagcagggctgaattttgtttgctaacggcaatggccgttggtgctttgggggtagcaaaatgcggattgagtaccattaagcttggtgtccgcgccacataagaatcagcgatggtgctggctaaaacggcaccatccagcttgttataggagacttgagcaatgacatcattggccttgtcgagacttgaaattttggcacctgggagttgcgttttagcaagctgctcctgcgtcgtttgcttttgagccccgacctttttgccggaaaaatcagcgatcgatttatacttggctttatcagccttccgaatcaccataacctgtgtctcatataggtaaggcgttgaaaaattgacttctttttcacgttcaggggtttttgacataccggagacgatcaaatcaattttgccggttttcaaggcaccaattaaggcggtgaagttcatttccttgatctgcagtttcacgcccatgtctttggcgatctgttttgacatggagatatctgcaccaacaatggtatcggccccattgagggtggcatggaactcaagtggtgcgtaatcggctgacagaccaacaaccaagtaaccacgtttttgaattgccgccagatcctcgcttgctgccgccgttggtaccggctgatttgcagcgaagccgacgagcatagccaccagcgcaatgaaggccatggcccaatgtttgattccccgcatatgtttcactcctcatttttgattatggattgaatatatactcatttatatgaatatgcaatgaaaatgttaaatatgcaaaaaaaatacagactaaactttagtctgttctgtttaaaccagcaagaaaaggccgaatcaattgccagagtttcgcgttgtctttgatgtacgaattgtgattttcaccgggaagaatatgcagctcggcgttttgaatattagtcgcaatggtgagcgtttcttttcgtgcaatcaagtcacgactgcctgcaaggaccaatgttggtatggctacccgatgcaacatggccggtgtgatttgcggttcatggagcatcatcgccattttaggtgatggatggtaaccagcagcaacccgaaaagcaactcgcgaataccagcgtaagccttgcggggtcagattcgccccagcaagaattaaagcgccggctaactggggttgacgaatcgccaactgcaatgccacaatcgcgccatcagaaaagccaagtaaaatcggctgctcaagctccaagccagtgatcagggccgctaaatctgccgtcatcgcatcataactcaagcgattcgtccgcgaactctgaccatgatcgcgactatccactgcaatcaccgtatacagcggtgccaattgctcaatcaggttagcaaaaatcgtatggtcctcaccattcccatgcaacaacacgatcactggtcccgaaccgcaccgttgatagtaaagcctgagctgatcatgataaaagaacatattagcaacctccaaagttcataattgggtgattaaatgacggcaagcaccggaatagcgatgcgcgtttagtgtgaagacgaggtgaatggcgaagtgtttattaactgaccctttcaagcttgcttatgaattaacagcactgatttgaaatgatgtgatattgagacattggatagaaaggcaagctggcggagcggcgatgggctcagcactgaaattttccttaagcgggtggttttcccgctttaggaaaaggccgagcttttagacagcgcgccgggcttgcgcgttggctaaaagtcgtgcccagtgcgttccagcccaatcgccgcggagccagcttgcagcagcatttaatgcaagccggaatctatcgaagtgcgacctaacgtgcttgtagaaaatgcgctcgcggtcccagaaacctgcatataagaacctcaagcttaaaggaactaagtcctgccatttaggcttaaggccgcttatgcttcggtttcaaactaggcccctcgcgctctttccctaaaaccgctatactacagtagtgtatcttaaaccaaggagggccaatgatggcgaaaaaaatcctggtcgttgacgatgagaagcctatctctgatatcgtcaagtttaatttggataaagaaggttacgatgtcgtaaccgcttatgatggcgaagaagccttgaaaaaagtcgaagcagagtcacccgacttaattttacttgatctgatgttaccaaaaattgatgggcttgaagtcgcccgacaaattcgtaaagaacatgacaccccaattattatgctgacagctaaggactcagaaattgataaagtgctcgggttggaactcggtgctgacgattacgtcaccaaaccattttccaatcgtgaactggtggcacgtgtcaaagctaacttgcgccgaaccgcatcatccaacgcagccagcaatgaagaagacgaagcaaacaaggaattagaagtcggagatctaacgattcaccccgatgcctatacagtctctaaacgcggtgaaaacatcgaattaacccaccgtgaatttgagctgctgcactaccttgctcgacaccttgggcaggtcatgacccgtgagcatctgctgcaaaccgtttggggctacgattactttggcgatgtccgcaccgtcgatgtgaccgtccgccgtctgcgtgaaaaaatcgaagacaacccgtctcaccctgaatggctggtgactcgacgcggtgtcggttactatctgcggaatcccgatgctgaataattaggagcaccactgttgaataaaaagattcgcttctttcagtcaatccacttcaaaattgcgatcgtctttattctcttgctagtcgtgacgttggagttaattggggcttactttgttaagacccttgagcagcaaaacattgagcagtttaagaccagtgtgaacgtggacagctatattcaagataagctggccgcggatttgttgcggactgatacagaaggcgccaatgatgatattaaaagcacgttgagccaggcagatattgccaactcggcggatttacaagtggttgatgcgaagggcactattcgcggcgacagtgatattaatgcgcaaactaatgtggggcaaaagtcagctaactccagcattaaaaacacattgtattctggccagcaatacgaaggttatgaataccgtgatcgaacgggatcaacttattataaagtgatcccgatcaaaaacccgaatgcgacaggcgacaacaattcagtgatcggcgccattgccatttcggcatctatggaacaggcctacgatagcatcaataaaatcgtgggcattttcctaatctcaagtttagtagctggcttactgggcactttactatcgattgtcatcagccgggctattactcgtccaattgatgaaatgaagaagcaagcgattcgcatggcgcgcggcgattattctggacaggttcggatttatggacaagacgagctgggtcagttggcagttgccgttaacaacctcagtgttcgcgttgaagaagcacaagaggcgtctgaagcggaacgtcggcggttggatagtgtgctggctcacatgacggacggtgttatcgcgactgatcggcgtgggaatgttatcatcatcaaccagacggcactgaatttcctgaacaccaagaatgaagatgtcatcggtgtttcaattctaaagctgttgaacatcgctaaggattacacgttgcgcgatctgctggaacatcaaacagaactgttgttggatttttcggagcaactggatcatgaattgattctacgtgtcgattttagtctgatccagcgggaaaccgggtttatttccggtttggtcgctgttttgcacgatgttaccgaacaacaaaagattgatcgtgatcgcaaggaatttgtttccaatgtgtcacatgaattgcggacgcccctcacatcagttcgcagttacattgaagctttgagtgatggtgcgtggaaagatccaaagctggcgccacgttttctcaacgtgacccaagaagaaacggatcggatgattcggatgattaatgatctcttgagcttgtcacggcttgattctggcaccagcaagttcaatttggaaaccgttaatctcaacgaattcttcaattatgtgcttgatcgttttgacatgatgttaaaaaccgataatgaacacacgggtgaagccaaaacggcccaaccgctgccacagccagatggtcaaaagaaacggtactcgattaagcgcgagattactgatcaggacttatgggtcgaaattgataccgataagtttatgcaagtgattgataatattatgaacaacgcaattaaatacagtccggatggcgggaccatcacggcgcggctgttccagacgcatgaccacgtgatcctatcgattagtgatcaaggacttggcattccacgtcaagatctgagcaaaatcttcgatcgcttctatcgggtcgacaaggcacgatcacgcaagcaaggcggtaccggtttaggattggcaatctcgaaggaagttgttgaagccttgcatggccgaatttgggtcgattcgcaagaaggccgcggcagcaccttctatatctcactgccgtatgaaccgatcacagacggaggtgatgattgggatgaagcttagtaattggatcttaagaatcagcctgatcgccatggtgatcttgagttttattttcacatccttaatttggcgtaatccatcgcgtcaggaacggcgcagcacttcaagcatgcaggtcacaactgaaaatgatcccaatgttaaaaagatggaagcaacggtttatcttcctagtcgcgtgtactacacgcatggcgaccagaagcaaatgctctttcaggcaaatgccagtatgggatcacgtgtccatcaagagatggcaagttggcatatgcaacagatcaaaaccattggaaaagtttcgcagaataactatgagaactttttgactcaaaatggcagtctgcaattagtttaccaagacgtgatgagttttaatcattttgagcgatggttctttaacaagcagcctaatctaaaatcagctgattttcattttaaccggatcctgtttgatttagatggatcaggcaataaactgatttttatcaatgacgcgacaagaacggtttacgaggccaaaatggctaacgttacaaccaacaagttacgcgatgcggtggctaaacaggctacaggggcctttccggtcgaggagagacgcttgggcaatagcgaagtcgctttcttcacccgtccaattaagttgcagccatatgcctatctgatggatcaacagagtgctaattactatgtttcgctgttaatgccatcgaaaaccgccagcaacgtggattcacgggaaattggcgatagtacgttatacaccgccggatcaactcggcggatgacagctgattcatccactggggcaatcgagtttgaaaattatgcggccaattttcctagtactgggttagctaatttcttccatgcgacgtttgaagggcttagtgatttgcagatgaccaatctggccagcatgcgttattttcaatatgacgcaagtcgcagtgctgttatctataagacctttgttcagggctttccgatttttaatggctatcaaaaaggggatgttacggtgcgctatacccagacatctgaagagattaatttctcaaacaccaatttgaccgtcccgatcccaaccgatcaagctgcccagaccttgccagcaactgcgacgatcctgagtcaattagaagccgctggctatcgcgctaatcaaattacggatattttgattggctatcaatggacgggcagcagcaatgatcaacaagtggtcgatttgcagccgacgtattatattgagatgaaaggcgaataccgcgattatcagagttggatcaatcaccaaacagatcagcaggctaatgctgctagtgaacaaacagctgccagcacggctacaccgagtaatgatgcagcaagcgcgagtgtcagcacatcaggttcaagtcagtcgcaataagtcatgttaacagcgtaacaacgcagcttcgggcacgctgagggaggcgatcttgtggattttcgacgcattgaatggatttttctagtcgtgtttgttggtctgaatattttcttaggcattagcttttttcaggcgcagcaggtcgatttggcaacaaccaaaagtggagatgccgccacgatcaccgacattacgcgtgaccagattaagctgccgcatttgagcaagcaaacaccagaaggcgattatcttgcaagtcaggcgaacacagcgttaagtgctgcgcacagcaagttggtgaagcaacaggtcagcatcagtgaaggcgattaccaagagttgcaggcaagcttagacacgccgatcactttgaaaaagaatcagcaaatacgccaactgacgacatttgtgaaagacagtatttaccatggcagcgaatacgaatatgcggcggcgctttccagtgatgaacgtgttgtctttgctcagcaccccaaggctggcttgatctatgatcggcgggctgcagtgaccttgcatgtagttgacgatcggttggtcagttatagccaaacttaccttgcaaagttaagtgttttgcgcgaccgcttaaatttaatgagtgaacaggatgcggtgattacgttgtatcgagataacgatattccgaacaattccgcgattgtatctactaagttggcctatagttacttgttagatgcaaaggggagcacggtttacgtgccagcgtggtatatcggtgttaaaaaccgtgcaaccggcaatgtgacggttaaacgcgtgaatgccattacccgaaccgttatgaagaatcgtaatgacaattagtgttagaatgtaatgaaataacaactggatgatcaatttgttcatcagttaaatggtagaagatgggagatgttgatcgtgggcgaagattttgggatgcgtgtcagtgtccttgctagcagcagttcaggcaacgcaacctatattgaaacgccgggtcataaggtgctggtcgacgccggcttgtccggcaaaaagatcgagacgctgatgcaaagcatcgggcgcgacctgacagatgtcgatagtgtcttcatcacccatgaacacagtgatcatgtccgtggtgtcggtgttttagcacgacgttatccgaaactgagtgtgtatgcgaatgcaaaaacctttgcggcactgcccaaaagtgttggcaaaattccagaagaccaattgcggctttttgacatgggcgcaacgttgacattaggtgatttggatgttgagagtttcggcgtttcacacgatgctgcggcgccgcagttctatcagttccatcatgacgggaaaaccttcacgattctaacggatacagggtatgtttctgaccgtgttgcaggtaccattcgtgatgcagatgcctatgtcatggaatgtaaccatgatcttgagatgttacgaacggggccttatccatggccactaaaacagcgtattttaggcgaccaaggccatctttccaatgaggacggcgctgatgccttgatggatgttatcgggctgcgaaccaagcgcatttatttaggacacctttctccgcacaacaataataaaccactcgcacacctaaccgtcgcttcactattagctcaacaaggcctagccgtcgatcacgactttcgtatctacgacaccgatcctgcagttgcagatccgctgtttgtggtataaagcaaagcgcgagcaggagcgcttagaaaccggaatgtaagtggcctcaggcgtgatggctgggctttggccattgcgcctgaggtccttacatggaggtttctgcgactgcgagcgcgtttccgcagcagcggtggcgtcttaagcattttccgtcatccaacgctaccacacgctacccaaggcagtgaatatcccgacccaaaaatccggtcgcatattcactgcctttcattttttattgatggtgcaaaaaataagcaaccccacgaactaatatcgcgataccgcgggtctgagactgtattaaaaaatcccgagattgttcataatttcgtcaaaatcgccccttacaattatatgcctcaatttttaagtcaagtgcaacgatgataacgaattcttgatagtggtctagggccatttactactgacgacgcctgatccgtataataaatttcgtggccataatcagcttgctgatattcttcagttggctcgagtggtggtgctcgtgttcgatttccatcagctagtcaagctaaagagtttttggacacctgctttattgaaaagagtgacgcgcgattacgcagtgacacattatcatctgaccgaacagatgcgggtaggcgatgcggcggtgaatgactggattgatcattttgttcgtggaaaagtgttgcctttgccacatccgcaacattttgattttcaagtcttttctgatggtcagccgatgtatgacctcattcagcggcgcaatgccgaaaccggcctttcgcgcatgatcgcgacagctgactatccattcacagtgctcgatggtaaaacctggtatgtccaagctggttctttgcggttaccttgggacaagatcaacttcaccgatcgcccgtgggcacaacgtcctgagacattgcatgaagttggttccatttatactattcaaggctttgacttgaattacgcaggtgtgattctagggccgagtctaggctatgatccctcaaaagaccggcttacggttgatctggcgcagtaccaagacaaggaagccttcaaaaagcgcccggatttggccgacaccaccgacgctaaagccgcgattatcatgaatgccattaatattctgctgaaaagggcgaagcatgggctttatctttacgcagctgatcctgctttgcgccaacggctattgcaattggccaaataatcttgcaacctcacttttgaaatgcaatagattgtgagtcgttccagctagcactatactgaaactgagtctaaatctaaaaggagtggtttgcgtggctgaaaagtatacagcagaaattgtgccattgaacgctgagaagattggcaccgcgccgcacggtgccgcgacgttcacgattgatggtgcgcaaatgaagattcatatcgatatgtttgatacacctgctaatgtgcagcattgggaacatttccacggattcccggatggtaagccagcagaaatcgccacagcggcacaagatgctaatggtgacggtttcgttgatctgccagaaacagaaccggtttccggtacaacgatggtgccatttgacgctgaaccggccaagatgcatgtgccaaatgacagttacccagtggctgatgcagaaggtcactatgcttatgacaaactcgttgatctgaaggaattgcagacagcgtttaaagccgcttttggcagtgacgatttgcagctcgataaaagggtcatttatattcatggtgtgccggataccttgaagctaccggctactgttcaaggaactgtcatgaactacgatgcccacgttactttaccaattgcagttgggaaaatcatcaaagcttaaactaattagtttagcgaccggacacagcttgcgatgaccccatctgacactgggagagcgagcaaatcgctgtggcggaataaggtagacgccaaccagtacatgcgcatagttagaggggctggcaatggcccatgtcgggtgcaaatcccgaccagcgatattggatcaagtctgggaagccctaggagtaggcaccagactatggcacttcgacatcaagtgaggtgccatttttatacatatttcgatggattgatattagcgccttagttttcaacgtggcagacaacttttaaaaagtaagactacctgcgttaaactttgattagaatatgtctactgaagacatatatatggtagaatgtgaaacattctaatggtaggtgtgaatctttgttaaattacaattcatttgggatcgttgacaataaaacatcggaaacaatgacaaaacaggagttttgtcatttttttatacagggcaatttaaacgttaaccttagaaaacaactttttcttcaactcaattctctttttgaaacatatcttctgccgcttatacatgacatacacagaatatggattgatgggtcgtttgtcagtaaaaagccttttccttcggacattgatgttttagtacttgttactccgacggctgactctgagcctcaagacacccaaattataagcacaattctagatgaacgagatgagataaagtgtcagacaaatgtacatttgtttgttattttcgattatccaaatatagacttttcaaatcaaggatatagagaaaagttttctttatcaaaaaatagtcataatgaactctaccaatattataagcaactttttagtcatacgcgtgctgacaagccaaaaaccataattgaacttcgagtaaaagatggtgagatacaatgaactacaaagaattgaaaaacgcaaggaatgtttatgcaaaatcaattgattctaatcagcctgatgatgacctgcaatcatattttaaaaagcaacttggaattatcaatgagctgatgactgataacgttgatctccatatttatacgggtttacggcctggggcaatcaagatatcgcagctgtcgtcagtactaccaaacattcaaaaaatggttattggagcagcaaataaattgtatggaaatggacgagacaggggcaaaatttccaattccattagcaaagagtattcgttagagattgattcggtgcaaccaggatctttcatgctaaggcttaatccatcatcttctggcgatgcaaatatttctctgtttgagaaggaaaaatcatgggccgacattttaagacaaatggttgagctgacagaagcaggaacaaacgaatcggttcaagaaattgcacatgattttggctatcgggcttatacagcatcaagggcctggataaatctaatggaaaaagaaaatctgacaataaagtatcgtgatgcgaagtcaacaatatttttatcaaagcaaaaaattgttagggccaaacagagctttgccactgtttcacttgatagtaaagaatcaagaatacgaatagagggcgtaataacgtcggttaacgttcccaaacacatgataaaaatatcaaatcaaggaaagacttacactatcaaagttgcagacgattcccttcgtggggccactattgatcttgaaagtaaaagctattcacttgatggttatatgatctcagttaaaaatttacgaacaaagatcgaaacaataacgtatttaattccaacatttccaaaatagaaacttaatgattctcattactagcactccgccaaccggtgaggtgctatttttgtgcaacaaaaaagccctcgctctgggaaaacgaaggccaatcacttttggagtgtgataatgaactcactaattcagtgtaacacaatacttataataggcacataaaaaagctctcggttgggggccgagagccttgctcgctctcccagtgtcagatggggtcatcgcaagctgtgtccggtcgctaagctggacaatgtggcatgcgggaatcgaacccgcctgactatctcagccagtcctcattgccacgccttgctacagctttatcatcaccatggctcgggagaacatgtggtgtctcaggcttctcacctttggcacaataccataatactgcctataaacggtcttttgggggctttttcggggcccaaaaggggctaattcggggctttttcggggcttttgaaaaccagcagattttctccttgataggcttctgcaaattctagcagtgctcggttcttaagcttcttgattgattctcttgagtagccttgcatgcggtaagcaatctggtcataagtcagtacctctttattacagtatgaataaaacagcgtccagaagcttgtggttgttagcgccatcaatgcatgctcaatcagttcaacgctaatacgagcactgacgacttttgccaatttgccatctaccgaattgtttactgaatgcgtctttggcataccatctataacgggtgatttaatgtcagacaaatagacgccgccgatacgtgatagcgttcggaagtctttcaatatctctcttgcctttgtgcgtgtcgcattttcgtctatttcttgaattaacgtcatcggtaggccaccccttatggtataatgaatttgcctaaaactcatcgggaaggcgtgccgtaatggtgcgcttttttgatgcttttaaatgtactttcaacatgtgcgtttgctatactacctgtggaggccaactcctaatctttgatttcatttactctcaatcgtacgtctggcctccagcgcgtccttcatcaggcgcgctttttgtgctacactttccttggagtgtccctataaaaaatctgatgctattggggcaatttgtctacactccagagcgtgctttcgtccagcacgctttttgtttacccaaatgcggccttccagagtacctttacaacccagctccctacaagaatgaaaactgctttcatgaatgcacagcccacgaaacagccaccaaacattgcaacacctgagattagcagcatgacggcaatcattgctttccctccagtagctctgcgttctcaaaaataatataggcaatcgcgtacttgattttcattttcattcctaaatctcatcgcccttctcgttgacctcaactacgtcccactcatatggcaattcatcaagcaaattgttgccaaagttgaactggccattttcagccgatagatcgtaaaatcgtgctgctttaccatacccgggtgtatcttccatcaaatatgcagggtagactttgtctttaaggtaaatgcgaccttctgccttgaaatttccagttgccttaaagtatctagtcttaggaaagttcatttctccgcctccgcatatgtcttccgaaaaatgtcatcagcaattggccagtgctcaccattgacaccagttgcgatccagtccccatcatgcaggataagatcgccttcaagggtcacaataataaagtgaccatgataacggtcaatgccgtacggactagccaatgtttcccactgatcagggttgtgacacgcacgatattttccttgccactcagcttcgttaaattgctccgcctcaatggttgccgttttccgatatttctttgctttcatagtttgactacctcgcctgtctcctcaacgaacgtgacaacgtggccaccataatgttttgcaactttttcacgatcatctttgtctggtgttgcccatgctcctggcccgaaaagatggtcttgatctaaccattcatcttcatcgttcttaaccgcgtacagtttttcttcgctcatttttcgtcctccaacttgtgtaagatgttcatgctgtgaatgtgtgccagcgtatcgtaaagttcctcttgcgtatggattaatggaatactgtatttcccgtcctctcccttgtattcttctggaagatgtcggtagccaatgtcatatgctgtgtgacaacaaccatctggggtgccatctaacacgatgagcatgatgtcatttgacggcttccattcaatgatcatcagattaggaatcttaaaaagttctcgtgcgtaattgcaaagcatgacattgtacttccggaagttttcatgatcattgttagctaagcagttacgcgtaaccatcgccaactgatacagtccctgattccaatcgtagtggtcatgcggcaatgcaaatgctgacgttactttcatttttcgtcctctactttcgtaagcttgtacaaagttcctttgatatccacgtaaatcggctcaccggtcacttggctgatgtaaacatcgtctacttctgactccattggttggcctcctatagttgttcttccgtgaataatcctgtgtgatagtcatatctagcaatcgtgaccggtatcttgtacctgatcatgaacagcagcattttctgcttagaatcacgagtcagtgtggcattcccacctttgacgtccaccactttcgttagcttgccattttcgtaaaagcagaaatctggagtgtatcttcgtgctgaatatcgcttgccatttatcacgaaagccgaaataatctcgaaatgttcctgcatcgtgatcttctgtgtcttgtttcgtatcagcatgtagtaagcaccctctgctttgcttgcgaatcgaatgccatcaatcacaactggctgtgcgttgtacttgcctctgcgtctcttgtggataaccatggctaacgactcacgatctcttcatggccgttgttgcggcggggcaacttgatctcaaactcgcttgcaactcgcttcacgaacgttgttgacttcccgatccgttttgcaacgtcagtcagtgtgtcgcattgtaaggccgcttctgcaattccgcgcgcgtatttggcacgggcttcttttcgcttttttgaaatctttttaaggccgttgttgactgaggtcttcaaaatgtcactgtcatcaataccagataccgcgcgtttctcgacaatcgctttctttgatacaacgatccggttgttgaactcttgcttctctatttttgagaatgcttcgctttcagagatgtctatcattgctgaattttcgtagcgcttaagcaattcagccttgaaatcgcgccacactttgtcgccctgtttgtataaacgcactgttacttgtgtcatgattttcctcctgcttatcaggcctcagttcgtcaaggctaacgcctagagcgtctgcaattcgtatcatcgttgaaaatgacggatctttgctttgtccggttttgatcgaataaatagttgttggatttttatacccagcaactctggatagtttcctgatactgtagccttttgcacgcataaatctttcaatgatgtgccacatgttgatcctccatatttttctggaatgacatcactttgttaggactgtaaataattcatatccgtctacctctgtatccccacggttaattgcgtctccaatgtactcaggacagcgatcaagaaaacggcaggcgtcagaccgactataaaaatatctaatttttccagttgagggatcgcgcaatacgacaggaactgctgccttgttgagcttatgctcatatgcatgcatcaagttcccacgtggagtgacccattccagattatcggcattattatttgacgggtttccatcaatgtgattcacatccggtaaattttcatagttcgcatgaaaagccgcgcatactagccgatgaaccaaaaactgcttactagcacgagatttccacaacgtaacgcgcttgtatcctcgcttatcagtcttctgcttgagtgttcgtcctttccaatgccgaacattttcgcgcccgttaaacatgcgtactgtcgttttccccgggatcgttcgcacttggcctttgtcagatacttgatagattccctcgtaattctcaatgtctttccaattttccatttttaattacctcttttaagtcagaacggaagatcatcagaaatatcgagcggctggccattattagcaaacggatccgtggtattcgctcgcgaagcatttggagtcgtttgactcgcgtttgtggtcgctgttgctgatgcattggccgtttgctgtgatttagggctgttctgagacgcctgtcgtgactcaagcaaagcaaaattctcaacgattacctcggtcacgaatactttctgcccttgcgcgttatcgtacgtgcgcgtttggatatggccttccacaccaaccaaggatccttttttggtgaagtttgcaaagttctcagccgacttgcgccagatctggcaatttacgaaatctgtttctcgttctccgtttttgctcttgaatttgcgatcaacagcaagcgtgaatgatcctaccgccgtgccactttgcgtgtaacgcaagtcaacatctcttgtcagtctgcctgttagtgagacactgtttagcaatatgcttccctcctaattcttttcgccgagtttattgagctgttcaagttgttcagccagcttggcacgctgttcggacgtcacttcatgctttggttcctgatatccaggctttaaccaatcaggttctttatcaacgcgctctggtttgccataacgccgctgaggttgattcgttttgcgttcgctatcgtttgcatcgacagcagcaaccgtgagaagacgcttgctttcccagtttttcaagataccgttgacgtacttgtagtttctgacattgctttcaaccgcagtccgcagcgcatttagaactagcttctcaggttcaggtgatcctgcttttcgcatgtcatcaacccaatcaacaaggctttctctggtgaacggtgacagttgtccaaacccattgaattaagatggattcctgcttatattttacaaaaatcaaaattggtccattaaaaagccttaatagcatctttagattggctagattgatcgcaatatcaatcgtcactgcgatgctggctaccgttttagtccgcaccaatgaaaggcccaaagggcctttcatgaaggcaaaaccgcgttcaattttcccgcgccgcttctctgcgtcacgatcaacttgccgctgcttagcatccatctttttaggcttacgtcctaaacgtggtcccgacaacctaatgcctagtcgttgacagagctgacgattctcgcgggtacgataaagtgtgtcagctaagatttcatcgggataataaccatgcacgtcgaaataatgatcgatggttgttgctaaatcttggctttcattgaacgccttaaaatcaaatcgttcgatatcgatcatgccatcggcaattgaagcatcaatcttgggaccaaattcggttcgttgtttggctttaccacggttaatcgggcgaatccacggttgtgccaagctaacaatccgtcctgggacccgatgggtccgattttcatacatgaacatttgctggtcaaaaagttcacgaatcacagccaatcgtttggtttgcctttcgttaagagaggcaccgtgggccaacagcacatcgatataacgtagatcacgtcggacatactggagctgtcctttgatctgcttgcgtgtttccttagcccaacgccgcggttttctagcaaaagcggtccacttagcttttgcttcacgtttgtaggttcgtggaggcttgatttgcaactgatgagccatgtctaataacatttcttctagattgagccgagcttgatttagcagcgaagtatcttgtggaaaacgaatttcaattggcaccgcagtagcgtctgtgatcaagacacggagctcatcatctggcaataagctttggatttgttcgcgcaaggtatcactgatgatatttcgcactagttccgttatttgacccatgcgtcgtctaaaataaaccaaggttgagtggttgaacggcaggtcggttgtgtaggtgtctagcccgataaagtactggtaagccggggtatcacgaatagcggtaacgaccgaacggtcggttagatgttctgcttgcttgatcaaactggcaccgtaaagcagacgaaagggtttagcagcgcgcccacccatctcagtaaaaagaagttgataggcttcatcgagctgttgccacgggagcatgtcggctaattgaacccactcattgtcggaagaaagtggcacaccaaggccgttgttaaaggattgaaatgacaattgggtagcacgatgtcgataagccatgatggtttcctccaggaaaaataaaaagtgcaaggaaaacaggcgttagcccatgtttactttgcactaattacaaaacggtatcgccttgatcggcatgggcgtcgacgacttgaccgtttttaaaggtaaaatgcatcccctcaaggatattcccggagtaacttagcggtttagtggaggcaaccgtaccatcaatgcggcggaaatccggcgccgtgaagacttcctcagtcggcatgttggccatgaattcctcaccgcgcggattataggcgccagcaccttcccaaatatggtgcttgggcagaccgacaaccaaatcagtacccggcgcgacataatgaagccgatcgaactgctcagtattcagccagtccgcttttgttcgcaattgttgatcatgggctttccaagcggcttcaggatcaggctgatcaattctggtggttttgaaaatggccgcccacagtttatcagtcgcttcttccggggtcttggcatcaggaaaaactttttcggcccattttggacttgcggcgccgatgatggtccagctaatcttcattgaactgattgcgtccattaggcgggcgtaagcttgattgaaggcattttgatagttggcgatgcgttgtggatccagtcctgcaaggttgtcaggatcggcagagatcacagtaatccgtttggcattgtgatcgacccagtagtcaaactgacccttaatgaaatcggggatgttgtacaggcgggatgttgccatgtgggccatgtccaaccgcttgatcagatcatcgtgccactgaacttgcacttcagcggcaccacggtcataagccgcagccacaatcaattgcgcaagtttggcctgatccacggcaatctgcaaataaaccgtgtcaccgggtttcacggcgacgccaatatcaaccgcgagctctgcatattgtttgaggcttttgtcaaagttaggtaatgtcatctttcgttccctccaaatccgttgttggcaatagtctaccatagcagtcatcatcacgtgctcaacagttctaaaaaacgtccgggctttatgttcaaataaatgacaccacaaagcatggcgttctctttaaaaaatacttcgaaaaaaattaagaaaaccgtcaatttgtttgcaaatagtgtttctttctggtatgaggtctggtaaaataacagcataacatctagattgccttttggagtggaggcgtatccaaagatgtttgtaaatgagttgtgtgcaagctagttttaaataactaaagaaagcaaggggaacattatggcacgaaagaaaacaattacgcatgatcagattctcaatgcggcgtatgaccttgttgtggaacaaggcttcaagagtttcacagcgcggaatatcgccaaaaagatgaactgctcaacacagccaatttatttagaattcaaaaacatggctgagctgaaacaggctgttatggatcgaattaaagaactactttcactgaaaatggcaaagcattttaccaacgatccagtcgttgatttggggcttgcttatatcaattttgcacttgaaaatcggccattgtatcgcgccgtttttgtggaagatcacttcggtgttgatgaaatgcgcgaatatgcgatgagcaccgcaatgcgcgtattcgattcttacgaaccagcgcagcacttgaacgaagcacagttgcgcaacacgatctgcggggtatggatcgttgcaacggggatcgccaatttaatggcaccaggcttcattgatattacacgagatcaaatggttgatattctaacggctgtgacgcaagacttcattgttaacggccgcttctcagacgacccgcgcatctcttgggttcaagacgccaagatcgctcagggatactaacgatcattaatagcaaattggggataaccgttccgatgtggagcggttttttttagagcgtgagcaggagcggttagaaaccgaagtgtaagcggccttgggcgtgatggccgggctttgtccattgcgtccaaggtccttacacggaggtttctgggccagcgaacgcgtttaaaggcgaatgcttttttaacgacaatgagtcccaccggttaacaaagacggcaacagtgcaaatcctgaccttgggccaaacactgctgccgccttttacatagtcgccacttcaccgaatcactggaaaaccatctcacaatgcgctactttaaaactaacgatgttgtctaccgtctcacaagacaacacagaaaaccacaagggagcttattatgggaagttcatcagacctaaaagacctattacgcgaacgaatcgccgctaaatataccattgacgatttaaaagatactgggaaaaagattcgtaaaaccgcaccaattgaaagtctggctgccgtcagtaagattgatcgggaccccgtccagttcattaatagtgtcgaacaaaacttaaccaaatcactgctgcctatgcgtcatagtcgcatgggcgcttcacaggcagctttttttcgcggcactgctgagttgatggcctatgacttgcagcaaggggagaagtctggcatcaatctgttaattgatggtgacgcccacttacagaatttcggtttctacgcatcgccagaacgcaacctgctttttgacctcaacgacttcgatgaagcgcagatcaacagctttgagtttgacatcaagcgtttgctgacgagtgtttatttgttaggcgaccaacaaggctttgatgcagataaattagatgaattggtacagactgatgcatcgatttatcgtaaaaccttacgggatcttttcaaggttggtgcattggatcgtttttatcagtccaccgaagtcaaccatcttgtgcagtcgatccccggcgctgaagattcggcgttgctgtcgaaatttgtgaaaaaggcgacgaagcgcaataatgactcggtgatcaaaaaatacaccacgactatcgacggcaacatgcggtttaaagacgatccgccaagctccgtcaggttggataaagcgacttatcaggcgatctttgacggctttactcagtaccgcaagtccacgcggccggatattttggtgctactgagcgaatatcggattacggacatcattcatcacagcgtgggtattggcagctttggcacgaattgctatctcgttttgctaagcggattaggtggcagccatcttgtgctgcaagtcaaagaagccttgccgccgcgacctgaattaattccaaatacggaacgcatcacgctgcaacaagaagtcagtcagggacagcggatcatcgcatcccagatgattttgcagaaagcctctgatccattcctcggctggttcaacgtaggcgataaaagctattatgtccgccagttccgtgatatgaaggggtctgtggaccttgaggaactgactttccccgagtttcagtactacacccagatcaccacatatttattggcaatggcacacgctcaaacccctcaggctgcagtggtgactggctatcttgataaaagttttgacagcgccgttcagcgttggagcaaatggtatctgaatcaggtaaaagcggattattcagcctttatgcgggcagttcagacgcacatgctggcctgagccatcttggaactgattgacagatcagatttttcttgtcctgatgacgctcactctggcaaaataaagttaagacgctaatcacctaacttaatgacatgcctgaagagcagggcgtcacagaaaggaggcaagtgattatggctcgcaaacaacatcaaaaaaagccgccgctgctttccgccgaacaagaagtcgcgattcaatccgggcgtgcagcattggcagatctggcgttgccacgccgcaccaaaatgcgggtgtttgttaaacttgccatcaatcggatcaccgaatcgaacatcggtcaaagtgctgctgccttggcgtactataccttgctgtccttattcccattgattctgtttgtcgccaatgcgttgccttattttggcttaacatacaaaggccttgctgcctatttgacacaggcaatcccatccaatgtcatgaattggttggacccagtgatcgccaatctgttggattccagcagtggcggtttgctgggaattggggcggttgcgactttgtgggcagccagtttaggcgtgaatggtttgaaaatgggcttcaatcaaatttacggcgtagagtcatcgcaaaattttattattcaacgcttattatcgatgctcatgaccttcacactcatcattgtgatgggcgccattctgattgttttcgcatttggccgccagtttctggaatggctgatcccactgcttcgtctcaacgatgactggctgcgaacatttaataccctacgttggccagtgacgattacggcgctttttgtcattattatgtttttaaattattttctgccgaacgtcaaaatccggatgtggacagtcttaccaggcaccgcctttacggtcgccggttggctgttaattgcccaggcgttttccttatacatgaaatattttgggacacgctatctgtcctatggcacgattggcaccttcatcgcgatcatgttatggcttaacttctccgcactggtgctgttgtggggcgccgtcatcaatgcactcaccgctgagtatttcattggtcgactacacggcagtaaggggaaagtacacgacttcgtcaaacgccgcgtgcggacgccacacgaagaaaaagaagtgaaaagctagtcattgagtgagcaaccatggctgagagcagcaaaaaaggacttgcgttcatctgagagcgcaagtccttttgctttaaacggttttattgcaatgcctgatacttttcaacaagttgtttggtaaaggcctctaggtgcttaatatcgtcttcttcaggggcgagatcgatcttaacgtcttctgcacccttcgtggctccggtcttggcaaaagccttgtcaaagtcgtctaccgaagtggcaaagtcatcatagaagcgatcaccgctgccgcagcaaccgtagaccttacctttaagatcgagttcttgcaactcttcatagaagtcaacggcttcatcaggcaactcgccatcaccgacatctgaataggtgtaagtcgcggtgacacaaatatcgacatcttcaaaatcgctggccagcgcttgagaaacttccgttgtcgtcacgtccacccctaagtcctcaaaagcctcttcaataataccagcgatatcctcgttgttgccggtcaaactggcatatacaatccttgcgcttgccatttttctcttattcctcctaaaacacagcgctcgggggcttacacgtcggcgaggctgccttttcttcttcatttgcctgattatagcataggggacacgactctggggttgtgaatcaaaaaggccaaagatccctgatgtcataaccgacaccgacactgtttaaccaaccattctcagacttctgttgtttatccctgattaatgctacactaattgcgagctaaacttgtattggaggcagaaaagcttgatcacgatcaaatcagcacgagaaattaaaggcatggcaaagtccggtgccattttggcaggtatgcaccttggcctgcgcgatattatcaaaccaggtatctcaagctgggaaattgaaaagttcgccaaagaattctttgaatcccatggcgccaaggccgaacaagtcggttttgaaggttataagtatgtgacttgtgtcagcatcaacgatgaagttgcgcatgcggttccgcgtaagggcctgaaactcaaagatggcgatgttgtcagtgttgacacggttgtcagctggaatggctacttcagcgattcttgctggacgtacggcgttggcaaggtgtcagaagctgaccagaagctgatggacgttaccaaaaagtccctgtacttaggtattgatgaagcacttgttggcaatcggatcggtgacattggcgctgctattcagacttacaccgaagatgataacggctacggcgatgtccgtgagcttattggccacggcattcagccaaccatgcacgaaagtcctaatgtgccgcattatggcgtgccaggtcatggtttacgactaaaagccggcatgaccattacgatcgagccgatgatcactgaaggtacttggaagatcaagggtaaacaagtcccaggcgacacttgggaatactacgtcaccgctgatggcagcaagtgtgcccagtacgagcacacgctggtcatcacagataacggcccgaagattttgacttctcaaggcgatgccattgacgagaagtacaagttaaccgaggccgatcttaaaacacttcctgaataacagcggccaacgcgatcattcagaaacaatagggcacgaaaaaacggggtggcgatgatgattgctcaccccgttttgtatgtgagcgcgaatcagcccggttagcaaccgacgtgtaagccgccttgggcgtgatgatcgggcattgaccattgcgaccaaggtccttacacgcaggcttctgggctgattcgcgcgttatcgcaagttacaaacgaatggtacttaatcaaaccagttcacgttatactaaaggaaaggacgaaaagagggagtatatggcagatcctgaagcgctgatctcggttatcatgccagtctacaatgcagagaagtatctcgcagaggccttggacagtttattggcacaggattatccgaattatgagattatttgtgtagacgatggttccatggataccagtaaagttatcttggcggcttatatgcgagaaaatccccgaattcacgttgtgcgggttcaaaatggcggtcaagcacgggctcggcaaattgggattgatcatgccaacggggacttgatcacgtttatggatagcgacgatcttgtgcatccgcagtggctatccaccatggcagacgggatgaaggcaccacgggttgatatggtggtcgtcaattattacaactacattggcagtacgaagatgaaggcacgcgcgtttcgtgaatcgacatttaaaatcgaaggcgatgacaagtatcgctattggttagaggatcgtgatttgcgcggttatttgtggaataaattattccgtgccgagttatttgaacagcctgtgcctgtcgcgactttcaatttgttagaggatgcttactttatcggccatcttttgccgcgaattgatcaaatcggcttcattgacgaacctcggtattattaccggttcaatgcgaccagcagtgtgcatgccaagtttcaaaaacgcgacctagaggcgatccatcaactaggcgctgttttcttgacccttgcccgcgaaaaaccggaattgacctcgctggcagtgcgccgttatgcagccctgagtctatttgtgttatcaaaaatgtcaccacgtcagcttgttaaaaattggggttatgtccgccagcttgggatggtactggggcaatatacgcgcgagtttcaagatgtcatctcggcaggcgatgtcaacgatttagcgacagaaaatccagacaagcccaacaaaacgagcctgacaggcaggttgcgcgcatggtcgcagttgctgggcttgccgaccttcgatgacttgaataagcttgccaaggcggacgatgatccagaagatgtgaaaagagaatcttagtgagggacaaccgcactcacagccgcaacaatattttgcgtgagtggcctcagcgttcaatgactgagacacagtcactagacgctgaggccactcacgctcttgtttctaagggactcgcacaaaaaagccgccactcacgtgtttcgcgagcggcggcttcctagcgatcatcgaaaaggggctgatgggggtttcagcaagtggcggtgcttcggttatgcctgtggttctgcaggttgtggttccttcttctcatcaatatggtagatttcagtaacctgtgtctcggtcatcttggcgcctgtcggagtcgcgtacaggttgacgccatccttgacgaaggccttggcatcagcgacaatctgcgcgaactgtttggcttggtccgccgttgcgtcagcttcgtacttgtttaaacgaatactggtggtcttaccaagtgaagatttgaaactgaaagaaagtgttttcataagttagccctccgtttaggcgttcagttcggtttgctgttgcaagaccgtgctgtgcagttgagtacccgggtacaaactagcgaaggcactgccgatcgcgagtaattgaccatcgtcagcttcaagcgcgacgttgttcatgcgccggacttgtttgtaatcctccttctctgggtcgatcatcgtatagacaatggcttgtgctttgattgttcgtggcatgttgcttcctccttgttttcagcgcttgcgtgcgcttttcatcgtcaattgcaactgtgtgactagacttggccgaagtcaggtcacgcggtctttaaaatacaactaggtggatcaaaaggtgccatggcatcgtaagacatttttttgccttacacttatacaaatcggtgaacccttggatttgacaaccctaaatgatcgaaaattcggaaaccattgcacaaagttgaatctctgctaaaataattaaggtgattctttagaaatagtaaggtttttgttggtttacgtcactgtgacgtaaggtcagctatacttacagtcggattccctctggggtcctatataaatgaaaaattgaagggttctgattgtgtgataacagcgcaggcgccaggcaagctttatgttgccggtgaatacgcggtggttgaaactggcttccccgcaatcattgtggcgttagatcaattcgtcaccgtcacggttgaggcaacgaagcatttcggcagtatcgtgtccgagcagtatcaggaaaactcgctgtattggcagcgtcaaggcgacgagatggtctttgataatcgggataatccgtttcattacattctctcggcaatcaaattgactgaacaatacgctcgagagttagacaaaccgctcgcgttatataagctctatattgattcgcagctggacgccaaggatgggaagaagtatggcctaggcagttcagcagcggtgactgttgccacgattaaggcattagccaagttttacgacttgaaaatgtcgaaggatcagatctacaagctggctgccattgcccatctagacgtacagggcaatggctctttaggtgacattgcagcatctgtctatgggggatggattgcctaccgttcgtttgataaagcgtggttggcggcagcacgaaaccagatgtcactagccgacctgatcaacactgattggccagagttgtcgattgaattgctgacagctccggctgacatgcaattgctggttggctggacaggttcaccagcttcaacttctcagttggtcgacaaaattacgctggccaaagcgaagaagccacaactttaccatgacttcttaactgctagccgcgaaaccttagaaaaattaattgatgggttccgcaaccgttcgttgagcagtattcaagctggtattcgccgcaaccgtgagttgttggatgaattagctcatttctcgggggttgcgatccaaacaccagcattacgtcaacttgttgaactagctgaacaagcaggcggcgcggcaaaatcttcaggtgccggtggcggcgattgtgggatcgtcttgattgattctcatcaagccatcaaaccgctacttgcggcttggcgcgaccatcatatcgagcctctgaaatttaatgtgcatgaaattaatgattcctagattgcaataataaagttaccacctagaaagaggcttgctcactgcttgtgatggccgcacttgggccattgcgcttgaggtccttacacataggtttctgggtccgcgatcgcgtttaaaaagagcgtgagctggcgcgggtagcaaccggagcataagcggcttggtcgttgcggccaaggttcttatgtggaggatgatgcgccagtgaaggcgtttatacgaggaggggacactgtgcgcagtcgggtcatttatgctgatacctatcgcaaacgtcatcaaagacggttatttttgctggccgttttaatcatcgctttgggcgcactgtttgtttggtggcatcagcgcaatccccgtcctgatccgcagacctatcccgtgttgggcgtgcgccttgaccaaaccgatggggtgcaggattttgacagtttgcgcagcagcaaagtcagttttgtctatctcaaagcgactgaaggcagcagctatttcgatgataattttaatacgaattttaatcaggcagctggcagtcgactgagcatcggcatttaccatgtgttcagctttgaaacgacaccccaagcccaagctgcccaattcacgcgccaagtcggccaaaatatcggtgatttaccgattggcatttacttaagctattacactgaaaagaagccaagcacacaatggctgacaactcagttacaaacttttgtcacattggtgcagcaacattatcatcgccaagtgttgctgatgggtagcccaagtattttaaaagctgtccaaaaagtcgacccgcaagcaccacgctgggttgtaagcgacaagaagccgacaacgagcagcggtttctggcaatacacgtctggcgcccggttgccgaatggaccgcacgcagattaccgcgctgccgtatttatgggggatcgggcggcctttttaaaactgtctcagcagatagtcaattaacgccaaacacgggaattgtcagctaatcataatttttgtggctgtatatgacaaaagtgttcgttgattgttcgcgaaaagccatgtcaaccttgacaccaatgcggcataatagttgcgaggtgaaactggatgaagaaagttttgatcggccttgttgtgctgattgtgctggtatttggcggcttgaaaatttttgaaatcacaaattatggtggcacgacttattacacgaagatcacaaacgctggtcaacaggccactgaccatgatcaagatggtaataaatacaccatctacgcctacgacttgcccggctatgatgaaaaaggcagtttgcagcagctgaagttcaatgctaatcaagaccgaccacttaaaatgaatgcttatttgaaagtgatatacaatgataaaaaaggcgtcactgattggcagcgtgtcccgcgagcagaggtgccaaaagcggcgctggcaaagttggactagtcaataagatgccaaaacacttcataggcgagagggttaattcaactaaataaaaacggctgattttccgtattggaaaatcagccgttttttgatcgctcatagataacccagcagaatttacagaatacagtgccaagattgagccacatctagccaaagattacagcgtttgacacggcaaaaatctgttgatcaacttctgatgactttaaacactcggaacaataatcgcataagtggcatcttcagcctcgtcgtagatcgtttgcggaccattatcgtcggccgtgatgaccaacttatagccgtaatggtcgagaaaagtcagctcatggatggtgatgccgacgacttgaccgggaagcactttgttgtcgattgcgatctgcagttgtggcgagatcgccagcgagtgggtcttgttggtttgctcatcgagaaatgcaaaattccccgtaaaattcttcgccaatgccaatgcaggattggctgccttggtttgcgactcctgatgatgaccccgatgcgcgagtgcatatttcagcccgcgtaaaaaacccgccatgttattcgacctcccattttttcattacattaagtctaccatgactttttcctttagtggttacagtgatgctgtttttctgttactgggctgttacaataatggtaagcggttcagagacttgtcaaaaatactttgtttttaaaaggatgacggcaactgaatcgggataagcgtgcgtgatgacgcttgaggattgaccgtgtgagttgaagaccgccagtttatgaaggccacggcttaggcggtttcgcggtgtctggcatgtgcatcagcacgttaaaaaacagagcacgattcagccagtttctgagctgaatggcgtgtctgaaaagggggatttgccatgttaaaactcggtgtgattggaacaggttggatcaccaagcaattcgtggcggcagcgatggcgacgaaagcttatcagctcaccgctgtttattcgcgacatcaggaaagcgcgcaatcatttattgacagcacggcaccagctactgcttatacgacgatggatgcttttcttggcagtgatatcgatgttgtttacattgccagtccaaatagtttgcatgcgtctcaagcgttggcagcgttagacgccgataagcatgtgatcgtggagaaaccattggttgccacgaccatggagtttgaaaagttggacgaagcgttgcggaagaaaccttctttatatctgtttgaggcagcgcgtcacgtgtatgaacacaactttgaagtcgtcaatgatttcacccacagtcaaccggttgatggggccaccttaacgtatatgaagtattcgtcaaaatacgatgcctttttagctggcaagttgccgaatgtgtttaatcctgaatttgccggcggcgctttaatggacctcggtatttaccttgtatatgatgcgattgcgtggtttggtgtaccggagaatgccgtttatttgccgcattttctcaaaagcgggattgacggcgatggcgttgctcggctcgactatggtaagtttgcggtgacattgatcacgggtaaaacgactaatagcgagttgccgtcagaaatttattctggcaagcaaacattgatgatggacaacgctgctgagctggagaccgttaagctcggtgatcaagtgctgagcaaagaaaagttggctaatccgatggaagcagaggcagcctattttgcaaaagcaattgtcggcaaggaccgcaacgcttttgacaaggcatggcagctcgccaaagaggttcatcaagtcatgtcaattctgcggacctccgcaaatctggatttttagtgaggacaatattgtgacaattgcaaccccgttccaaaaacgctggcaagcagccggctatactgaacagacgccgattcaaaccgccgtgtatcaaccactgaaagccgatgaagatgttgttgggcttgctccaacaggctcagggaaaacattagcttttggcttaccactacttgaaaagatggtgccaggcgatggcttacaactcttaattttggcaccatcacaagagttggcgattcaaacccgtgatgtgctcaccccttacgccaaagatattggtatcaccgtgcaaggggttattggctcggcgaatgtcaaacgtcagcttgataggctaaaagaaaagccagaagtcgttgttgcaacggcgggtcgcttattggaactgattcagtcgcgtaagttgaaacttgatgggttgcaaacgctggtcgttgatgaagccgatgaaatgttgcgtgatccaggatttgatcaggttcgagagattgcggcagcagcacccgcggaagcacaattggcctttttctcggccacgccaagcccttattttaaggagctgcataagtggtttggtaaaacaccagacatcattgatgttcgggcaattgatcgaacccgtggcgaagtcaggcatctgtttttgcagacggatcgggcgcatcaggttgattggttacgcaccttagcccataccgatggcttcaaagccttggtcttctttaatcaaaattcgtccttggaacgcgtggcggggatcttgcgtcatcaggcggttcgctttgcagtcttgtcacgcgaaggccggcaaacggttcgacagaaggcattgactgattttcggcgcggacgaatcacgctcttgctggtgaccgatatggcagggcgcggattggatattcctaagttgccggctgtggtaaactttgaaccaccgaagcgcgcggaagtttacattcatcgggctgggcggactggccggatgggtgaagcaggtctggttgtgaccttgggggatgatcatgatcgccgcgacctcagcaagttggtaccgcagtatcatattcatcgcggctatatgtcagagggcaagcttgtggacacgccgccagctaaaaaagtgtccgaggcgtcggcaccaacgacggttgaaaagcctgcatcgccagtcgccaagcagcagccagttaagccagaggtggcacaagaaccggctgttcgtccgcgtcgcaagcataagaaacatcgcctgcgagatcagcggaataaaggcaagcacaaggataacgcataatgcagcatcggatgtatgatgaagataagggggcagtcatggtgagtatgaaagcagaacaaatggctgccatgatgacattgatgagcgctgccggtgatgcggaaaatgcaaccatgacggcgattgacgaagccaaggccggccatgctgagcgcagccgtaagctgttgaagcaggcagatgccaagttgaagcaagctcatcaagctcagacccagatgctgacgtatgaagcacgaggcgaaaaagttgacgtgacattattgatggtgcacagtcaggatcatctaatgagtgcgatgaccattcgccggcttgccgatgagattattgatctttatcagcaagtgcaggcgcgtaagtaacggctggtacagcgcggttgacgtgcctgcaaccgcggcaataacgcgctcgcaatcaagagaggtaatccccatgaaaatcgaaaagacattacagacaccagcagcttttttatatagcaagattattgcgcccgtacaagctgatattgcggcggctaacaatcaacaggttgcggcggcagaactcggtggttatgcttatcgcaagcaatttccagatggcgagtgggccaaagttaaggttactaagaatgtgattgatcgtgaatttgcgatgttgactgtcacccgtttctcgcggttcaaggtccggtacctgatcacgccgttaaatgccaatgccagccaagtccgcgtcagtgaaaccgtgcagccggttaactgggcggcgcaattgaagcaaatggtgaccgaattattggtcggcaacaaacgccgccgtaattacggccgaatgttggattcaattgagcggtcgtatatgacggcttaggcgttgttcgctgcatgctgaacactttatagtcaatatttgcaaatgaatttgaattgccctgtggcttttggcataattgactttgtctggtgcccttagctcagcaggatagagcgactgcctcctaagcagtaggtcatcggttcgattccgatagggcacagtacgaagcacagtcttgatggctgtgcttttttggaaatcacattgcacattctaaaaagtcttaaagattaaaaatgagtacaatcgcatttttgtggtagctggatttgtctaaaaggagattacgcgatgcaagccttcacagccgtttatttgccaggctggttgattttcattggcggtatgctgatcattagcagcgtgaatgcagcgacggtgcaagccatggtgaatcgggccgggcgttcgaatacgcagctctggtatatgaaaccgggtatttttgtgcatgagctgttgcacgcggttgttgcgcggcttttcggattacaagtgactaacttttccatgcgagctgatgtggttagcggcagcgcagcgcatgtcagtctgcggtacaatcgacgctcgccttgggcacaactaggattatttctgtccagcagtgcacctgtctggggcatcagtaccgtgttgctgatcatgggacgatgggccttttttccgacagatggccggctttggccagtcttaactgccgccacgagtctgaatgaaaaatggctcgcgatgcgcggcttgattcagatcaactgggtttggtttgcggcttttatcgtcacggccttggtgctgacgccaggcattgcgctttcagctcaggatctgcgcaacatgtggcgcagtgccccgatcgtgttcttgctgacaatcgtgattttttatgtttttttgacgttttggccagctggatttgcttggtggtcgctgttgaacttgaatgtgttattgttagatgcgattatgctgcttttcagtatcttgatttggttactggcaagcattttgtgaatgaatgttgacaagtgagagggcaaatgtgcccgatgtcataatctataagtgaagccttttgttctttagtagggggaagacgatgattgcgccgcaagcggagacaattttaaaggaaaaatttggctatgatcattttcgtgctggtcaaaatcaggccatcagtcgcgttttggctggtgaaagcacgctggttgtgatgccaacaggcggcgggaaatcgttgtgttatcagattccagcgatgttgttgtcgggattgacgctcgtggtgtcgccgctcatcgcgttgatgaaggatcaagtggatgcgctgaacgataacgggattccggcggctttcattaatagtacccttgattatcaagagattgctgatcgccttgaccaagcaagaagtggtcggattaaattgttatatgttgccccagaacggtttgacacggattggtttgtgcaacggcttggcagcaccgatatttcgttatttgcaattgatgaagcccattgtatttctcagtggggtcacgattttcgtccgagttatttgaatctggcgaatgtggcggctcaattgccttcgcagccaccggttattgccttgaccgcaacggccacaccgcgagttgcgcaggatatttgccagcgactggcgattccagctgatgggatgattaatactggttttgagcgaagtaatctgagcttcaaggtcgtgcgtgatcaggatgaagatcggtatctattagattacctgaaactgaatgtcgatcaggcaggcatcatctatgccagcacccgtaaagaagttgaccgtttgtatacctttttggcacataagaagttgcctgtggccaaatatcacgcgggcatgagtgaagcgcagcgtgctgctaatcaggaagactttttgtttgatcgcaaaccaattatgattgcaacgaatgcgttcggcatgggtattgataaaagcaacgtgcggtttgtcattcacgcccagattcccaaagatgtcgaatcgtattatcaagaagccggtcgggctggtcgtgatggcttgccgagtgaggcaattttgctgtttaagccgcaagatctccaggttcagcggttcttcatcgatcaatccgaaggcgatgacgagcacaaacagcggcaatatgagaagttgaaaatgatggaacggtatgcgaacacagatcagtgtttgcaacagtttattttgaactatttcggtcaaaacgggacaaacccatgtggtcggtgttcgaattgtttggatgaccgggaatcagtggatgttacggttgatgcgcagaaggtcttatcttgtgtggttcgcttgcatgaacgttttggcaaaggcgttgtggcgcaagtgctggcgggggcccacaatcagcgggtattgtcgtttcatctagatcaattgtcaacttatgggttgatgagcagtcgtcgtcaacgcgacattacaacgttcatagattttctggcggctggcggttatttagaaacccgcggtggtcagtacccaactctgggcttaacggccaaaggcgctgaggttcttcgcggacaagcgcaagtattccagaagacggcgcaaaaagccgagcagcatctcgaagtcgacgacactgtctttcaggaactgcgcagtactcggcgacaactggcggagcagcagcatttaccgccttatatgattttctctgataagacgttgaaggcaattggcagcgccatgccgcaaagtcttgatgagttgatggcagtcaaaggcgtcgggcaggcgaagttggataagtatggccaaatctttttggatgtcctgcaggcgattaaggccaaggcttgaatggctagtgtcgatcaaaaaaggtcgtgatcgcgtctttcccgttttgaagcggggggatgcggtcacggcctttttagctttttaccaggttttctccgccactttgctttatttggcggagaaaagacaatttacggcggaaaaaaatacctaaacccagtcaccattgcggaaaatcggaacgacggtgccatcggccttgatgccgtcaatattcatgtcagctgagcccatcatgaaatcaacgtgcgtgttactttggttgaggccagccgcggtgcgttggtcggtggtcatggcaacgccgtctttgacggagaatggataagcttgtccgagcgccatgtgatcagaggcgttctcgtcatataacgtgttgaagaaaatcaagccggattgggaaatcggggatggatcagggaccagcgacacttcaccaagtgagcgggcgccggggatctttagcaggttttgcaaaacggtatctaggccctttttggataacgcaaaaagacacctactcagtgtccatgctatgcttgttagcgtcgaaaccaaaagcaagcgaggttatgagtaaatgtcccaatacgatcctacactgtccgtccttggaataccagaccataatatcaaagttgcctttgttcgtcatgaatatcgcggcaacggggtacgtcgccgccagtatcatgttattgatgccgagctgacttaccggttaacccggtgcccactgtgcggctttgaggccttgcaccctaacgggttttacacggcccatgtgcgcgtcctcaacggggttgaaatgccgacagtcattgacttgcacaagcaacgatggcgctgtcataactgttaccacacagtcagtgccaagacgccactcgtgcaacccaaccacacgatcgccactcacatgacagagcgaatcatgaagttagcgcatgaacggttgccagtcaaaaccatcgcccgtattatcggaatctcagcttcctcggttcaacggatcattgaccaaaatctcaaactccgaccggctcgccggctacccacgcgactttgctttgatgagttccgttccactcatggcatgatgtcgtttatctgtcttgatgccgattcacatcatctgattgccttgcttggtgaccgattcaaccgcacgattaaaaacttcttcatcgctcattattcactcgctgaacgcactcgggtccagacggtcaccatggacatgaatgcagcttatcagacgattattcatgaggttttccccaaggcccaagttgtcattgatcggttccatatcattcaacttgcggctcgtgcccttgatcaggtacgcgtccaagcgctcaaacagcttgatgacaaacacagccgtccttataagatcatgaagacaaactggcggctttttcatcaaactgcgcctgacgctaaacacaaacagttcctgtttggtttgaatgaatacgtcacgcaacaggaggccatcgatatcgcacttgatactgagcccaagctcaagcaaacctacgagacctacttagcgcttcatgatgctttgatggtgaagaaacatcccgcggaattggcaaacctgttagctacttacgagccaaactgtacggcaatggaagaaaaattgtgttttcgtttttataagtgtcaacttgacaggggatagtaccatcctccctttcagtacttatatactaactaaatgtaaggccaataacaacctttgacgttgatatattcgcgaatactttttattcaattagcaggtgaccgcatgccccctcagtcagcttagaaaacgctggcacatggccacagaatgcaaaaagccccgatgtcagtgtgccactggcatcagggcttttttacaagatcatcttcttttttgatttgtcgaaatgacgattttaagcgcgtggctgactgcttgaattcgtcttcttacttacgagtgcgcgactgccgccggttcaccaaataccgtctcgcgaatataatcaactggcatttgtaggcctgtccacagatggaaagcggcggcgccttgattgatcagcatgttaatgccgttatacacgtggttcacaccggcttctttagcgagctgcataagcttggtttcgcgcggtgcatagaccgtatcaaacacgatcgtctctggcgtaaaccaatcgccatcaggcacattactaacagtttctagcggcttcatccccgcgggtgtcgcatcaacatagataactgaatccaaaatgctagcctttaacgccggttgatcatcgagtgcaaacaatgtcgcatggccttgtgtttggtcattaatgatggccacattacgttcggcattttgccacgaagcatcacgacgattaaaaatgttgatttcccgaacaccgtccaaagctgcttgaatcgcaatcgctgtccccgcaccgccagctcctgccagtgtcattttatcgccgcgaatatccaagccatcgttgctcagtgcttgcatgaagcctgtgccatcggtgatatggccggtcagcaccccgtggtcattgacaatggtattcacggcaccgatcaattttgcggccggcgatagtttgtccaacaacggtatggccttttgcttattcggcatcgacaaattaccacccaaaaaatgcaggctgcgcatggcttgcaaggcgtgtgccaattcaggtgcatcaacatcgaaggacaggtaggcatcatttaacccaagtttttcaaatgttgcgttgtacatcgctggcgacatcgagtggccagcaggatgcgccagtaagccagctaaaacggtgtgaccgtcaatttcatcttttaatgacatgtttcgaactcctttttgctaatggacttgtgaaactgctaggacgtgcttttcctgcgtcttcacgaccagtgctaaaccgatgccgacaatcgtgatgacaatattcaaaagaatgatcatccgtggtgccgcatcgccaaaggccttggtcaacccggcagcggcggataacaccgcatagttggcaatacttgaagcaatcatgaccagcgaagtcgctgtgcctttatgactggggaagaaactgatagttgttgaggtggcaagttgcaacacgccgccagccgcggcataaccaatcacaaaactaccaatgtaaagaatgaccggcgtctgcacaaagtagcacaaggctaacatgaccaccgcaatcgtcggatacaggatcaaaacggtgctttcttttaacccggctttgatcagacgagccgtcagcaacaccgcaatcccagcaccaacggcgtataacgattgcagcgttgctggatttttaaccccgtaagccgcccctagttcctggttgcaattcaaccaaaccatgaaggtggtcgaactggtgaagccaattaaaatggccgccacagacccaattgaaaaatgcattttttcaggcgtgccagctgcattcagctgtggtttttcccgcttaggaaataggaaaacgataatggcaatggcatcggcagccagcgccacgccgcagatgatgaagatcgtccgaaatgacaggccagccgccgcaacgccgccaatgaagaacggcaagataaactgcgcggtgaccacagcgaattttgtcagaagattggcaattgacgccgattccggaaacatttccatgaggctcggggaaacacaggtgtccaaaaatgagttcgccatcccattaagaataccgatgagataagccgcccagaaactattgaccgtgatgatgccgatgaagaagatcacatacaacccgatcccaatcgtcccagaaaccttccggccaaaatgatccgacaccggcccggcaaacggataggcaatcaagcgccctaacccgaacgccgcaatcactgacacgaccatgctgacgtcaacggtgccattgctcagttgttgcgcaccccaattcgaagcaaactgcgccttatactgacttagaatggaagatgcaatccccagcatcgcataggaaaaatacagtgccagtgcacccggcaaaaaatgattacgtttggttttcatcgttcaagttgcctccgtttttaaacgtgttccctacaccagagaccggtctggttcacgctcttcttaaacgcgttctccagaccagaaacctgcgtgtaaggaccctgaacgcaatgcccaaaacccggccatcgcgttcaggcccgcttacactccggtttctaaccggtctggttcacgctcttcttcaaatgcctgatatgccttcactggcatgtcctgaccagtccacaattgatatccggctgcgccttgccaaagtagcatgcctttacccggtgctgtttttgcgccaactttttcagcatcttcaatcaactttgtcttcaaaggattgtataccgtgtcagccaccaccaaatctgcgcgtaggaaactcggatcaacaagggaaatcccatcgtctggtttcatgccgacagtagttgcgttgacaagaatatcggcgtccgcaattgctgctttgagcctgtcagtattttccaactgaaccacatctactttgacagcaggcgctgcctcggccaattttttggcggtcgattcagcacgtgaatagaattcatcctgccgattaaagatggtaatctgttttgcaccatctagcgccgcttggacttgaatggcagtcgcggcgccaccagcacctaataccaccaaatgcttgcctttgatatcaatcccgtgttcctgcaaattccgaacaaatccgatgccatccgtgatgtgaccgatcaatttgccatcatcgttcacaacgacattcaccgcaccaatgatcttggcagctggcgataactcgtccatcaaagttgctgctacatttttacacggcatcgtgacgttgcctccgcgcattttgaaaaggcgcatggcattcagtgcttctggcatctgctccttggtcacgtcaaacgccacataagctgcatcaattttttgtttttgaaaactgaagttatacattgctggcgagccagaatggccaaccggactgcccagcaaacacaacaaaccagtcgttccagaaatccacgtctccatgttcagtgcctccattaagtccatattttcacgagcattttgaaaagaagaacctgacccaaggtgcgatcaagttgcttctatcaatattgcaaattacttggcagcttggtgcgctttaattgcgtattcacgccgaccacccggcttcggaatcatatcttgcatcatgatgcccagcccgccatcaactcgcagttcatcaccgtttgtgtaatcggaacggtcactgctcaagtaaaggacagcattggcgatgtcatccaagttgccaatccgacgactggcaactaagtgctcacggccgtccaacacgttaggatccttgtaaaaatcagcagacatcagggtcttcaccagacatggcatgacacagttgctgcgaatcccgaactggccccattcagcggccatttgtttcgataacatattgaccgcggctttggttgtgctgtaagccccgctgtatgtctctggaaaatcagccgcaaccgttgaaatatgcaccatcgtaccgtgatgttgggcaatcatttgccgaccaaatcgttgtgacatcaagaaataaccagtcaaattaacattcacagccgtcttccactcatccaaacgcaagtcctcaaacggtgaaaagcgcaagatagcggccgtgttcacgagaatatccactttgccaaactcagccacaaccgcttgcaccgcagcatcgacttcatcttcatctgtggtgtcagttgccactgctaatgtttgaacgccatattgatcagctaattttttagctgctgtctgaatcgcatctttcttaatatcaaccaagacaagcttcgccccatgctctgcaaaggcttcgcaaaaatgagtgcccataccgccaacagcaccagtgacaacgacaactttgtctttcaaacctaaccaatcagccataaaaattacgctccttttagtgtgccgcaacagtttccttcaaaatttccggccatgccgcctgcaaggttttcaccgtggtgtcgtaagtatatttggcaacccagtcaatccctttggccatgtagtgatcagaaatgacttcaacaccaatcacttttggatccacgccagcctctttaatcatcttgataaacttttcagtccgatcttcaaacccagttcctggtgctaagcgatcgtgcatcgactcgtcgcgcaaaatggactttgcatatggccgcttgtaagcatcatcaagttgaattgagataacgcgcttagcttgttccttcgtcagcaagtcgaacggctggtctgctcgaacccagtgccacatgtctaacaacatcatcacattcggagcaccggcgccttggagaatcgcccaagtcttcttcaaatctggcatgccgctatatggcatcggttcgagggcaatgatgagattaccagccaaagctgcgcgatgtgccagttcctgcaacttcttggccgtgaagtcaactggatagctttccatcaaaccggtgttgatatgttcaacgccaaacaagtgacacatatggaaacaggtttgctccttatatttttgttcgtatgtacgcggttcttcacaccattgcacgatgtattcaacctcggtgcacttgatatgatactgatcaagaatggcgagaatcccttgatcagttaagccttcattcagcgcatcgacgtaggtttcggcgcgtaagccgatgccatcgtacccagcttttgcggctgctttaacgcgatcttcgaatttgcattggtcgcctaatgtccatgaactaacagtaattggatgagtaagtgtcatgatagtgcctcccaaaatgatttgtgattaatttttcaatcttgtttacaaattgaattgtatacggttgcacaagcgacttctaattcattataatgagggtgcttatagctggaggctatcgttccggttaagccttcataggaggaccaaaatgaacctttttcatctgcgatattttgttacattagccaaatcacagaactatacccgtgctgcccggcagttaaacatcacccagcccagcctgagcaatgccattcatggtcttgaagccgaactggaccttgccttgtttgttcgacaaggacgcaacgttgttttaacttcggaaggccgcgagttcagtcgcattgtggatcactcgctaaccatcctcgatagcggcattgaacagttgcaacaccaaaacaacgagcaaacggtgattaaactggccgccttacgtaccctcagcacacgctgggtccctggcatggtacgcgaattcttacaaaacagccaacaagatgtccgttttgaattcacgaacgaaaacgggctatcaccacaaattattcaaggtttacgcgctaaacattatgatatttgcttttgctcaaaagttgacgagcaagaagatattgcctattttccaattgcttctcaggcactcgtcgtgatcactccgactgatcatcccttggctactcgcaaccagattgaacttagtgaaaccttggctttcgatcaagtcaccttctccaaaagaagcggcctcgcgcccatcatccgccagctttttgccgaatgcggcggccaaccacacagtgtgtacgccattgaagaggatgaagccgtcgcgggtctcgttgcaaacggcttcggcatcgccgttgtccccaatatgccacttcttaaaacgctacccgttaaaatcattccgcttagttttccaacttggcagcgtattttttatatggcaactttaaaagatcactaccaatccccagccgccaaagacttcattgactttgttcatgcccatcatgcggacattcgccagtaatgtgcgcctgatgcaccaggtcaatagtctggcgctattaatcgttaaaggctgcggtgcactaatcaagttcgcgccattttagcggaaagccaaaactaacaatatcagaccatgctaaatgcctgtcgctgttctaaaatggaagtgttcaagacattttcaaggaggtcattgcatgcgtacacaaacaaaaacatctgtcatgaagcttgccgcggttggcgccgttgccggtttagtatcaggacttgtcaaattaggctgggaaaatattttgccgccgcggacacctgaacgtgacgcgaccaatccgccgcaaacattcctgcagcaacacggtctcaccgcagcacaaacccatgcaacttatacttattcagaccatcagattccctgggtcagactcctcatacacttcggcttctcatcaagcctcggtgcgctttatgctgttgccggccattacgtaccgctttttaaacttggctacggcagtatgtggggcctgggcgtttgggcaggtgcccatttgtgggcaatgccggcactgaaaattgtgcccgccgctaaagatcaaccggttgaggaacacttatccgaagcagtcggtcacatggtttggaacacggtcaatcagatcgtcatcagtgacatgctgcgcgaaaaaagcggcaattaagtgatgcattcaacttcaatgtaaaaaccgctaactaaaaagtctgtgctgacaaccgaatcttcggcatgccaacacagactttttttactatgatcaatttttatctactaaagtaaccgagcttcatcccatcgcgcaatgaacggcaaaataagtcccaatgccaggaaaataactggcgtaatgatgtttaagcccatctggaaccaccaagtccctggatcgttgagataattgattttcggcaacattcccaacaagcaggccaatgcggtaaaaagaaaacaccaaccgccaataatcatgcccacatgtttgtttttaacaaacatgtactctgcttggaatttttccaaatgcttattaagcaaataataggcaaggaaaacccacaagtagcgtaacggcatcacgactgagttcagatttaacaaccacttatacagctcgttcatattgccgataccaagcgctggcacaatgatcagcaaactgactaaaatcccggtcagccagtaaccattgatcggcgtgctttttttattcagatgactcagcttctttggaataaaatgcggatcagcatcacttagcagcattttcaacggtgcatcaatcgaaaaggctaaggccgaaatggaagcgagtgcgttggcgatggcatagagaatgacgaaaatattgccaacatgataataactgcccagcattgcgaaggcggtatacggtccattggccatcaaatcagtgggaatctggttactgttaaacaacatgcccatgccaaatgacccgagcaaggcacaaaaggcaaccatcccggcaagcaccagcatccccgttggaaattcctttgccgcatgtttcgtgttattgacgtacggagaaattttttccgcaccgccaaccgcaaaaaccagcatcgaaatagtggtgaagtaattcagattaaacttcggcaagtaggtatgaatgtcgcccatatccggtgtggccacatgcacgcctttgaccatgagcggtgcagtgacagccaaaatgataaacaaaatcgacatcaagaacatcgccgtacctgccatactgccgatgcgattcaaagtggttaacccacgtgacgacagccataaaaatagcaagaagagtgctaaacaaattaaggatacggtcattgaagagacggtattcacgaaattgccgttgcctttaaacaaccagctcaacgcaatcagaatggcttgcggcttttgagctaagtagtggctggtgaattaggcaacattccggctacctgaaacgtgaatttgacttgcacagattgcccggacttgcgacgaccatggtaaataatcctgcagcgctttagaatcgccaggaacggaaaggttgggtaattcagtaaataagtattcgaggtatttgcggcagtcgagaccgttggcctcagccgaacgcatgacactcaagataatcccgcttgaccgggcccctttgaaactcgtggagaatagccagtttttgcgaccgataacgagttccttgacggcgcgctcaacgcggttatttgaaagctccaaacggccatccaacaacacattttccatggcttcgcgttgactgagtgcatagtcgatggcgcggccgaatttggattgcggtaaggcgtggacactttcacaccaagtgaagaaatcggacatagttgatttcagttgactttggcgtttttgatagcgctgatcaggggttaataaccgccatggccgctccatcttgaacatgcgatcacaatatgtcacacctttcttggcaccgctttgcgtgttgccctgtttacccatggcctcgaagaacttacgtcggatgtgggaaagacaggcgactcgggtgacctgatcaagtttgtcgtacacttgatagccatcggtttggagataatgtgtatacccgttgaggaagttcttcgggacttccgtggcgcgggaatcggcgtgctcatagagaataatctgctcgtcttccgcgcgtccagaggcgaaaacccagaaataggtgtttactttctcgctttccaacacgcgatagctggtttcatcggcgtggacgacggtttgtttgagcagtgtttgatgcatcagttcgtagagattgcctaacccatagtcacaagcccgaatgtgccagttggtgatttgttggcgggttagttcgagccccaagtctccccaatcctttatctggcgataggctgggacctttttacgatacttttcgatcatcgtttgggttaggatgcttggtgaggcaaagctgttaggaatgaacggcttcggcactatcgcctttttgatgacgctgtgatctaactgattggaacactggcgacattcataggcgtgctgatagtggacgtggacttcaacgtgttccggaatccgaaccggttcgcggctggtcgccgtggccccaatttcacgcatctcagcggcacaatgtgggcactggcgttccgctccggttagttcgtggtgcacagccacttcaggaaaaggagccagttgcgctgctttcctgcctttttgttttttacgttttgcaggtttgtcatcttgctcttctggttcaggaactgttggcgccacaaaggttttggtttgatcaaagagatcaacctgaccgtcagtgagactttcacgcttagtgccgtacaggcgccgcattaagaactcgacttgttcgcgaagcagtgcgttctcttgtttgagatattcgaattgttctgtcgtcacgactgcttccgctgacatctcgcgccctccgttaaaatggttgaaaaaagtatatcaagcggccacacgaaaagaaagccttttcgtcagcttcaagaaaagactttctttcagacaatcagtacacataccccggggttacaggctgaatggtacggcgttcttcaatggctaaaccattgaccagacgtgacatttgacgataattcaaacggcgaatttcactgcgatcgcgcggccattgcatatagccgttttcaaagcgcttgtataaaagcagaaaaccacttttggtccaatacagtgctttgaaacgatccttacgggtaccacagaagatgaataacgcattgtcgaacacatccatcttgtactcctccgtgaccaaggccgccaagccatcaatgccttttcgcagatcggtgcgaccgcaaatgatgtaaatgttagctttggacaggtcgggtatcatgggccatcaactcctgcaaaataatccgggccatcaccttatcgatgccattgtagaaaaggacttcggcttcgtttagtttaattttggctcctagtttgggtttcaccacgacggcggcaccgtcgcgattgaccatttggattggaaccagatcattggtttgagtcataaagaaatcctccaatcttcttgatagaccaagtatagagggaggattttgacaattataggtactgcactatgtgacgcactcaatcataaattgatctggtacaacccggccatcttgtaattgccgctgcttctgtttggtaacataaagcaccatgacatcttgtaattggccatctttgccgcgaacgtgcgcaactcgccctaatggccgatccggaatgactaaatcatcagggactagccaatagtatttggtcggccgaatgcgctttggcgtcatgaaatagcctgccatcatggtgactttgccaagcaccttgacgtgacgattgcgatgctgtgtaaaggcttttaactcagtatcagtctctgtttgttcctgggtcaaacgctttttaatggcggcatagctgtgttttttagtttcttccgcacgctgattagcagttttctgtgcctctgccagaatatcctcacgttcatacggatcactggtttgaatcataagcaagtgcaggccagctcgttcagcctctgttagttctttgaggtttttgagtgctaattcttctggaaatgcttcccgtttccgttgatcaaactctttagagctcattaggatcacctccgttagcagttgtcagtgtcttattccagtatgccaccaatgtttctttcatagcaccaaacaagtaattttcaacgttgttaatttttttactgtcagagcgaagaacattgaaaaaacggcgcatggtcttgtttatcatttcttggcatagcggatcgtctagtacaatcgccgttccttcatgttccctttctacagcctttttggcatttaggataatgccgaggaaccgatgcaattgtttaggtgagcggcaccaaaggcctagcagttcaacgccttctttgttgagaaagaggccacctgttgttgattcaggcagatagtttctggcattttttacgagatcttgattttgctttttaatgatctcaggtgaatatcgatttgtggaaaagtccagtttttctgtctctttattgtctctagtatttgtatctaaagtcttatatagatcgtgaccgattttcggtttcccgctattttcaaggggtccggcttcacctgagttcttatgtcgcgggcgaccgattttcggtttcccgctgttttcggtggcttgaacggtctcttgcgggcgaccgattttcggtttcccgtactgtgtatgggtttttacgtcttcattaggttcaaaagccttgagataaacatcagttgcactaacatccagttcggataaatatagccgatttggctcattttttcccgttttaggattaaacccgactacttcttgatacagtaaatttgcatttatgagatctgatttaaccttacgaagtttatcgtttgaccaatgcattagcgatttcagctcttggtttgtaaaaatgaaatacacatgatttgattcatcaatccaattgttttttaacgagtagtcgagcctgctttgaagaaccatataggcaattttggcactatcgctaagggacttatatttttctccgtatagcaaaacttgtggaaattggaagtattttttttgatacgcagaagatttttcaataaaagtgaatttgtgctttgaatgtgtcatcatggattctccttatacaaaaaaagaacgtggctacacgccaaattctaagtgtttttttcgtcgaagtaaacaataaaattatgctgatgccttaatgtgggcaattgatagcgacgtcaaagtgtcttagtcctttagtactttgaagtcatagtatctagatagcaaagtggcaaagtactttgacgcctgcggtacttaaatactttgacactgtgcgtgcgtgtgtaacgtgtgattaaagtattaaagtaccttagtgtctttttctgatggagaccggctgattaactgagtttaaatctaaaggcgagacaaaagcattaaagtactttgcagtccttagtaccttgacgtcatagtactaaagtgtcataataccaatagtacttaggtacttagaacgcaaaggaggaaatgcaatgccttgcttaacaattgcaattgcaaatcaaaagggtggtgtagcgaaaactacaaccgttagtgagttaggagaactgctatcgcagcaatatcataaaaaggtattgatgattgacattgatcctcaggcaagtttgacttccattaaaggtgatatgaatgacataattatcaacaatcgaaaaactatgtcgaacgttatgctcaggcaatcttcgattgacgaaattgttattcccatcaagacaaacttgtacttagctcctgcaactttagttctatcggatgtagagcttaacatcattaatgcaacacttcgggaattaattttaaaggctgcgttgaattcgatgttgggaagttatgattttgttctgattgattgtccaccgagtcggggactacttacagttaatgcacttagcgctagtgattatgttttaattccgatacaagccgaataccaagcattacttggacttcaattattgaaaaatactgtggccaatgttcaatcgcaaatcaataaggaattgaaggtatggggatacgtggttaccatgacaacgcgaaccaatcaatcatcagatacattgaacgaaattaaaaaggatcactacccaattttaagtacgattccacgatccaccaaggtttcagatgcaggagtagctaacatgtctacctatgaatttgacacgaataatccagctggatcagcgtatttaaaactttctgaaaagttactcggtttagaaatgtaggtgtagttaaatggcaaatcgcaaacgagtatcaatatctgaaaagaatatcccgaaccctgctacttacgattctttattcaaaaatgagggcagtacgcaaagaatagaaaatgctgataagaaagaagaacgcgagagcagtaaagacgttcaaaaaaagttgcacagatttgaggatataaaagcttattatttaaatttcgacagaaaaaagcagatttcaacatatatgcctagagcattacaaataaaattgaagtcaaaggccgctgctgaaaatatgaccttgtcgcaattcttgctgaatttaatcttgagccaaggtttaactgaccaagaaattaaagaagcttatcaatatgaaattgaccatccagaaattaataagtaaagggtgagttatcaaaataaacgcttaatttctcaggatgcctaagcaattaaaaaagccaacaaattgaactgttagtgtatcttgggaaaagcctttagattgctatgtccatgtattaagtcttgttgcacctctgtgtctggaagaatcaaatgattggtatcacggtattcaatgcttaggttagaatgctgcttcaaagaagaaagaaaatgctcatactggtctttattacgtttgaagcaggcgatctcatagcttttggtcaactttgctttgaaccgttgcatgtagatgaagaatgagtagcagtcttcaaagtggttatcgacgactactaaccaataacgggtgtggggcgcacgggtgaagtaatgattgtactgtgacagcatggatttaatatcaagtcgcagttgagttgcttcatccatgatgaccacctaccaatccggcacggccaattgcggtcgcgcctttttctttggagtaaccccgcacaatcgctttgtagccatatagttgacgaatcttgtcaattgtttgatctaacaaaacgtttgcttcctccttctctgctgattcaaatagactaagctgcatcgagcttgcttgacttatgcgattaacacgaacggaaacatttctgacggcatggccgttccatttactatactcaatcataaattgatctggtacaacccggccatcttgtaattgccgctgcttttgtttggtaacataaagcaccatcacatcatgtagctggccatctttgccacgaacatgcgcaactcgccctaatggccgatccggaatgaccaaatcatcagggactagccagtagtatttagtcggtcgaatgcgctttggcgtcatgaagtaacctgccatcatagtaacttttccaagtaccttgacgtgacgattacgatgctgcgtaaaggcttttaactccgtatcagtctctgttttctcctggatcaagcgttctttgacagcggcatagctgtgctttttagcttcttcggctcgttgattagcggttttttgtgcctctgccagaatatcctctcgttcatcaggatcactcgtctgaatcatgagtaaatgcagaccggcacgttctgcctcagttagctctttgaggtttttgagcgccacctcttctggaaaggcttcacgtttccgttgattaaactctttagagctcattagggtcgcctccattagctgtcatgagtgatttattccagtatgccaccaaggtctctttcatagcaccaaacaagtaattttcgacgttgttaatttttttactgtcagaacgtaggatgttgaaaaagcggcgcatggtcttgttgatcatttcttggcactgcggatcatcaagtacgattgtcgttccttcatgttccctttctacagcctttttggcatttagaataataccgaggaacctgtgcatttgtttaggtgagcgacaccaaagccctagtagttcaacaccttctttgttgagaaagaggccgccgtttgctgattcaggtaaataatctttggcccttctcactaggtcttgattttgtttacgaataatttccggggaatattgatcggtagaaaagtcgagcttttctgtctctttattgtctctagcttgtgtctctaagtctttatattgatatactaaagaatttttagttccgcttgtagcaagggattgagggactttatcgcgggctaaagaatttttagttccgcttgtagcaaggaattgaggcatttcatgtcgggctaaagaatttttagttccgcttgtagcaggggatatagtgctttgacttgcttcattctcgcgtttatacacgtcggttgcagatacattgagatcgcccaaatataagcgattgggattattccgtttcattttcggatcaaagcccatttttttctggaagaggaggtttgcttgttctaactcttttttggttttgattaccttgggttcggagcagttcaaaatctgttgaagctcagtatttgaaaaaatgaagtaaatatttccgttttcgtccacccagtcattgtgaagcgaatattccagtcgatctttcaaaatgacgtacgccaactttgcttctgcagaaaggtttttgtatgtaggactgtacaaaagaacttttggaaactgaaagaaaagagtcccgtaaacttttgtcgcttggtaaaatttaaaactcgaatttattgggttcattttaaaaactccttgtggttcatctatttatggtagagcaaacaaatatttgataattccatataacaacacgactgtatactagtgataacgtcctgtaaaggactatcgttgaaataataattttggtataccagtatacctgtatactgagtagatgtgtataccagtatgccagtatactggcatacacacttttttttgcttaaactatttttgatcaaaaaagcttaaaacaatagtgcttaaggcgatatataaaaagaattcaaggtatacaggtatacctgtataccttgaattctcccttatatcgtcaaaaagtataccggtatacttttacaaaggtattcataggtgctataatgtttgcagaaaggcggtatttatatggctaaaacttacgttgttgggaacttcaagggcggtgttggtaaaacaaaaaccgttacgatgctagcttatgagagtgcagtaaaaaagagaagaaagactttggtaattgacctagatcctcaaggtaatgcaacaagcgttcttggacgaacaggcggcttgagtgccattactaagaatgtaacagatgggtttatcagcggaaacttgaggaaccaaataacaaaagtgataccccgcttggatattattggtgcaagtacgagctttagaacgttaccaaagttgttaatgtcaaaatttccggaggacgaagatcagcaaatgctgtatttgaagacactgctggaacccttaaaggatcaatatgacagtatttaccttgatgttccgccgactatctcggatttttcagacaatgcaatgatggctgctgattactgcattattgttcttcaaacacaagaactctctcttgatggcgcaaagacttatatttcctacatgcaatatttagcaaataactataattctgatttagatgttcttggaataattccatgtatgttgcgacctggtggtagggtagatgaagatgttctacatgcagctcgggatctttatgggaacaacgttttacacaccgttgtaaaatatcaggaacgactaaaggcatatgatgctgaaggaatccatatcaacaaaaccacactaggctacgaagatagttgggatattagagcacataaagtttttgaaagtgttctagacgaactagatgaaaatcaaaagaaacttgataaataccgagaaggtgagctaaatgagtgacgagagcattcaaccgattattgaccatcataaaagaaagcaaacaagcggattagagcggaagcaagtctcaattgcagggacaaatgatttttcggctactattgataagaaggttgtgaataataactcgccagcggatgatcctcgatacaaagcgactacaacaatgaaaatatcaccagtaacaaacttgaagttgcagactttaaagccatttataaatgagcaaaagtctagtgatcgttcagatacaatgaatgacttaataaatgttttgattgaaagttatattggaaaaaatctgactgcacggcaggcaaatgcgtacaaccaaatgtttgggttacagctcagtatgttgaaacctaaacaaaaataagcaccatacgtgtttgagcacagtacattaagtgcaattaaaagttacagacgattatgtccgtgaattaaatcttcaagaatatcagaatcagggtgaattaaatgccgtgtgttacgatattcaatgtttaggttagaatgctgcttcaaagaagagagaaaatgctcatactggcctttatcacgtttaaagcaggcaatctcatagcttttgatcaactttgctttgaaccgctgcatgtagatgaagaatgagtagcagtcttcaaagtggttatcgaccaccaccaaccaataacgagtgtgcggcgcacgggtgaagtaatgatcgtactgtgacagcatggattggatgccaagccgcagttcggtttccttatccatgatgcccaccaaccaatccggcacgatcaattgcggtcgcgcctttttctttggagtaaccccgcacaattgctttgtagccatatagctgacggatcttgtcaattgtttgatctaacaaaacgtttgcttcctccttctctgctggttcaaatagactaagctgcatcgagcttgcttgactgatgcgattaacacgaacggaaacatttctgacggcatggccgttccatttactatcttggcacccagtatactaaaatcaagtcagcgaggaaaatttgcaccagaaccccaaataccgatctgtcacaatgcgatcgattttgtcgctcatcgacatcacaaagtcatctttgtcaaccacacacatcgcaatgacgcgcgcaatgaagtcatagcgggcattcacaataatgctatcggttgtatcatcaaacacatgctccgccgtccgtaaaatttcattcatctgatgttgctcgtctgaagaaaaggccaattgcttgaccacttgcggatctttttcaaaaaccttaatggcataccaccgcaaccgatcggcaggcaccttctggtcaatcacatcctcaagcatcgtcagcgccgattcgagtcgcgcatcatactcaggaaaggcataaggctttggtagcggcgcctgaatggtttgcaccaactcctgtaaggcagccggtttagttgctgtcgtggcaatgacaggtacctgtaatgcgtaactcagcttttttaaattaatcgttcgatggcccgttttgaccagcacatccatcatgtttaaagcgacaattaacggccgcccggtttccataacttgcaacgtcaaataaagattgcgctcaaggttggttgcatccaccacattcaagaccgagtctggttgatcatttagtaaaaagtcgcgcgtcacgatttcttcactgctataaggtgacaatgaataggtgcctggaagatcttgaatgactaaggcattatccgctttcagccggccagatttacgctcaactgtcaccccaggccagttaccaatatgctgcttagcgccggttaaggcattgaacaacgtggttttcccgctgttaggattgcctaccaatgctaacgtttcacgtatcgccatcgcttgtcacctccgtcaccagcacatgtgccgcatcctgcttgcgaatgctcaatttgtaaccacggaccgctagctcaatcggatcacccaaaggcgcaatctgatgaattttgaccaacgtgcctttggtgagacccatatccatgaggcggtgacgcaacggtggatcccctttaatcgtgcggatcaaacctgcctgccgcagcggcagatcagccaaggcaatggcaggggtatcagcatccatggcaaacggtcgaaccacgagtaacgaggcaatttcatcgctaattgctaatcgctgaccttgaaaaaaaatcaccatgcctgacaacttgcttgcaggctgaaccacggtcacttttttgccaacgactaagcccatttcggcaagatgccgccgcaaagcgccactgccaccaacgctcatcagtaagtaggcgcccgattcccgtacatctatcaaggcctgcatcgcactcatcccgctttcgtcaccaattttgtgctgctggtagcatagcatgttttcgcacgagcaaggaaaaaaatcaaacaaatgctaatctgagaggccacttttgcatacatggtcttgctcataggatttgaaaaagcgtctgtgatcagtctcaagtactgcgcacagacgctaatcatgacttcaattgactttatttaactttcgccaaaaccgcttttgcaacggttgcgacataatgcagctggccctctgtggtcgggtgcgttttgtccgctacaaaccaatcatcatggccttctgacgccttgtgccaatcaacaatgtgcagatttcgataacgatgactcattgaaacaagatcgcgattaacttcatctgtccaagtcgtatctgcatggacattaatccaatatacctgccgcttgctgccgagagtattcataattgacgtgaactcagcatcggtaaatgtgccattgcttcccaagccgataatcaccgtgtcagcaagcttgcctgaagccgctaatgatttgaacaaatccggtgcttcataaatttgtcgactcacaccagcatcaaaataaatcttcgggaaaagttccttgtataaatattcgctacccagcatgaccgaatcacccactgctgtcacatccagttgcttggccgcttgcacttgattaaaactgaggccgtcagccgcaaagtctttatagactggatctttggccttctcagaagcttgtgttgcctcccgcatctttttagccgaagctcgcgagcgaaccgctgctttagagcttgaagcagaggcggccgccccttttgcttgcgcctgttgatgaacaccaaaccaaataccgccgcccaataacacaacggccaagatggcaataccccagatgagtccctttttcgagtttgtttcctgtctatgcatgccgcaccccttcaaacaattaagttaccgtatgatgatatcatagaaagtagcatgagtgcgcgagcgatatatgtaaagcgtggtggttagttcagtgcttaaccgaagaaatgttgatgacaaacgtctgtcacgaatcagttttgacctcttcacgctgagttaatggcggcatgtcgctcgaatgaagctacacattgaacaaaaaaatccttccagttaataactggaaggactaacgtgttcaacgagtgacgttccacgaagaatcactcatgaaaagatgccggctgcaggagtcgaacctgtgaccctcggtttacgataccgatgctctaccaactgagctaagccggcatactgacccgtacgggatttgaacccatgttaccgccgtgaaagggcggtgtcttaacatataagaggtgatcatatgttcaatttggttcttcaaacaaaagacatcaaggaggctaaacggcacgatggtcttcttgaaatcagatttccacatccaaaagagaaggctctgttgttgaaactacgtcatgcggtgctaagcatcgaaaccggttggcctattctgcctgatacaacgtgtattggcgagatcgtgcgggtgttaccaagcaaagaccgcgtgatcgtggcttatgttcgtccgcaaaacgagtttaaacagtttgttgagtcgcattaaagcgaaaataaggaggtgtcgtcatggcaattagtaaggcacaaatgaacaatcaaaagcaaatgctaacggagattttgaaacaacaaaatctcgcatatgaagactggctttaccaaagaatgactgatgagattgagagccatcgaaaactgattctacaggcactcaagaatctcaatatgaaagaaggacattaatatgcaaggaaaagtcatcgctttattgagcgctattttaggttttattattgccattgccggcggctatgcggcagtcaagtttggcttaatgggtattgctcacatgaccaaggatcaacagaaaatccgcgaggcgcgtgatggtatgaccaatgttgctattgggctgattgtagttattttcgcttctgccgcagttgcttggttacaaggcttggcaggttaattcggtctgaataagcctcactctaaaagaaaggagaaggccgtgtacgctaaatttgaatgttcaagaaagttgcgtcaatttctaaagaaaaagagacaactgtctttatccgaagccgaaaagatgattagtgcggctgacgattttgcgattcaacatcacttcaaggaagatgtgaacttcaaaattattagtcaggacggcattgagtatgaagataatcttccaattggcacaggacaaggctggctgcataaccttctcttgattctagatcatgcctaccaaaccgtcttgagtgatcaatcgcctgaagcatttaaagcattttccgaccgagttagacaggaactaacgattgaggaacagccaaaagcagtccaagaaaccttgccagtagttgctcgtcaagaaaaggctcatcatctcaaaccaattgtctccaaagaggaagaagcagtacgtaaagcggaaagctcagcgccagctgctgcaaagcaaaaacagcaaaaatcaaagccagtcccgttacggcggcaggcaagaaagaaaccaatgtggcaatttccacaattgaagcggccaaaaataaggttatctgcacaaattataaagcgctttgtgctagcagcagcaacgattctagtcgttgctatttttatgctctttttgatgaggccaaagcctgtgccgagttatcaaacgcttattcagaatgcttcttacgttcaagctgcaaagctttatcccagtaagcatcgcgatattgaagccaggttagtcaaggacaatgatgaaaaatcgctagctgcgtttgtccaaaagtacccatcaaataatggacgcttcgatttggcttatatgcaaaagaagttttcaacggtcatttcggtaagccaagatgcggatctaacggcagttagaaaggtaaaactagctatcagttatatttaccagaatcaaccagagaatgctttaaccatcaattcagaaataaagagtccacaactgcaacagctgatctttctcgcgttgattcatgagggaaagttggatcaagcggcgacacttgcgaaatccatgaaaaataaagatgccgacaaagtgcttgaagttggtaagacctatcaggctgcctatgagaaggctaaagcggacgcaaataattcaaaactctctgaaacagatcggaaacaagcactcaaagatcagcacaactggttagcactcagaaaatcattaggagggaagagtccctatgaagaatcaacaaacgaataataagaaacgtcatatcatcatcacaacaacagccgttgcgctactaggagctggtggcctttgggctgccacacaagcacatagtgatcaacaggccactcacacctcgtcttaccagaaaaagatgcagaagcctaaagcatccaaaggtagccaagctaagaaggagaagggcaagaatacagtcaacgatattattgaccaggccctaggaaagagtagtacctcaacttcaaatgaagatcatgctttcaaatcggcaaccaacaatatcttggatagtgatccaattgcgactattgcgaaagccttagatacgccagcagcaaaagcatcactggcagcggctacggcggcagttgaaccaccaaaggctttaaatgacaatagcgatgatataactagcgtaaagccgctgactaatgacacaacggatgcatcacaggctgatcaaggaaaaactaacgatgatggcaaaacgccgacaccagttaatcccgtagagccgattgacccagacaaacctgtcaatccaattacaccagttaacccggacaacccagataatcctgttaacccagtcaatccagtcaatccggttaaccctgttcaaccggatcaaaatactgcccctgttttaaatgttccggaggatcaaacggtttcgctgtcacataatggtacttttgatgtgctaaatggcgtgacggcttcggataaagaggatggcgatcttactaaggccattaaggtgacgggcaatgttgatctaagcaaagaggggacgtacaccctgacctattcggtaaccgacagtgccggtcaaacgaccagtgcgaagcgcgtgatcacggtagccaatgatttgccagttatcagtgcagacgatcaaacaatcgaagtgggaacttcatttgatcccgtggtaaatgtcacggcaagtgatgtgcaagatggtgatttaacgaaggatattaaggttacaggcaacgttgacacaactaagttaggaacgtctcaactgacctatagcgtgtcagatcatgatggtggacaaacaaccaagaccattaacatcacggtttatgctaaagacgccagtttttcaggacttgatgcactgacggttcaacaaggatcaacgccagatttgcgcaaaggggtctccgttagtgatccatatagtgcgactcctagtgattttacggtgacagcatgtgataccaaaacactaggacaaaagtcggtaacgtactcgtacgttgacaagtggggccatgtaactaccaaggatcgtgtcattaatgtggttgctgaaaagccagttttcaaagggttacaagatcagaccattaaacagggggatcattttgatcccatgaccggtgtgagtgcaatgtcaactaacggcccagtaacaatttcctatgtgggtgaggttaatacgcaaaaggcaggtcgttatacgctgacttacacagcaactgatcagaacggacaacaggctgaacagaccattgtggtcacagtggaataggaggacatcatggaagacatcaatagtgttcaattgtcaggaaccgtcataaccgatgtgaaacaccgccaaaatcaggattttctaaccgcttctacctatttggaatgtattcgagatcatcaagatcgtactaagaaggtcaatgttcccgttaaactttataacgaaactgccgcagatttcgttaagaacgttaagctgggtgatcgtgttttgatcactggacgctttgacgccagtgtattcagtgaagcaccaggacaatcaacgaccagatacttcattatggccgccagtttcgtcaaaatcgttaaagaagccgtaccggcagttgatgatcagctgaacaatccacctaaagcgacacacgacacacccacagagtcatcgaactacagcaatgtattaccaggaggcttcaactaggaggaaaaatgcgagcgataaaaacaatttccagttttaccagcgatggcctcgatgaacgtgttaatgaaaccacccgatacctgatctcggccggttatcaggtgattggtatatcggttgcaggagagtggtgtaaaacagcaacgattatctatgagacgggggtttcagccgatcaaatgaagccaaccacgttgcggcaacatagtgagcgtgcgattgggctaattgtaagcctgttggcactggtgttactgtatcatgcactgcccgctgctttattgacgcaatcccagttatatcaatttgttcttacagcagctgcgctagtatgtgcggtcttttttgtgcaaagcttgcgcgtcatattccctcgatggggcatcatgattggactgctcgttttggcggcctacgcacatgttctcgaacaagacatatatgggattaaagagcatccactgatgttaattgtcataacgatcatcgtggcattagcactctatgtgctcaaaatcgcttatcaaagacttagaagggtgtattggcgattagtggaatggatggcgagtcgtcatgaataacaggtcgtagcagaaaggaggtcagcatgaaccacgaaaaaaggcagtggcgtgaagcgcttggtaataaacgatttctaatcgtgattgcaggactttggttgataggtggcctgctgatccttaattggttgacacatattccgtcaatgttcttaaaactgataaaccaggcacctagtttacaaacaattgtctcaacggtgctacatccggctaattttttatggcctgatttcacctatctgctggtagcactgttgtacttggttggcctagttgcactggtcatttatgtactcatacgcacctatcgttggcgcaaagcttttcagtccattaatactggacaaaaaggcaccggacgctttgcacgggtagcagaggtggcggccgcaagtatcgccattccattaaatgactatccatatgtcggtaagtcaggggtacctcagctccatattaaaaaggatcaaatggacaaatatgaattgaagactgttgtgcagcagtatcgcggtgccgaccagcatcatggcgttgatctagtggatactagtggcaccaatacagttgctgtggctgggccaggtggtgggaagaccacactattttccttgccagtgttggattttattatgcgagcatccgtccatgactctgttattatcaccgatgttaaaggcgaaatgcttcgtagcaccaaagcagaatttgaggcacgtggttatcgagttgcggctttaaacctagttgatccgacttactcgattgcctataacccacttgagttagtgaaacaagcgtacgctgctggagactttgataacgcgcagatgttgtgcaataccttttcttacagtattttccacaatccgaatgcaaaggaaccgatgtgggaacagtcgtctatttcactgctaaacgccttgattctagcggtatgtaaggtctgctttgatcaacacacacctgagaaaatcacgatgtatactgttacaaccatgttaagcgaattgggggcgaatccggacgagaatggcatgaccaaactggacaagttcttctccaagttgccctctggtgatccagccaaattgcagtatggcacgattcagttttctcaaggcattacccgtagcggtatctttactggcacaatggcaggcattaagaactacgcctttagtaacattggccgcttaacggccacaaatgactttaacattgccgatttagccactggtgacaaaccagtggctttctttattatctatccagattacgacaactcgaactactcactagtggcgacctttctatcgcaggtaggttatgtgctggctaaaatggcaacgctcgcggcggattctaagctcaaccgacgggtgattaacctgtatgaagagctgggtaacttgccacgtattgaaggactaccacattacctcaacgttggtcgtggacgtggtctggtctattacctgattttgcagtcaattgcacagttggaggccaattatggcaaggaaggggctgccgaaatcatgggtgcctgtggcaacaagtatgacattttggctgataactacgatgatgcagaatacttctccaagcaaattggacaaacaacggtgattgcaccatcgcgtcacggggcaccaatggacacggacaagtcgtttggtgagtcgcaagaaactagaagactcatgatgcctgatgagttgcttcgactcaggaaaggcgaagtggtgctaattcgcagcaagcaacggtctgatcttgagaatcgttcaattacagcttggccgattcatgccaacccggatgagggcactgagttaccattttcatttgaatatctgacacggtttaatcaccaggcaacctttgccgagttgtatggcgataagaagccagcacataacgacattgatctcaaaaaactgttgctggatattaccgtgacaacgattgaaccgcagaatgaaaatgatgatcctgaaatcacagttaaagtgaatggtcattcactcaatgccgaaaacgatgagccgcatgtagaacaatatgcgtctgaaccagcagcagctgacgaaaactcagatcaacacacgccagcagtgggttcagaacaatcgccgcaggattcaaaaccagatcaagacaatattgagcctgagcctaacgaccctaagaaacaaatcactacagagattgatcaacaagcgacgccgctatcgactttgtttagtaaatcgcaacttcaaatgattgaaaagggcgttcaggagctgctcacacaagatgactacgctgaatatcagtcgctggattccgttgaagcgatgactcattggctaaatgcacggcgagccatgaagagctttgctgcgcaactggattttgcctatcaaaagttagacgcattcaagaagaaagaaggtgacaatacttgaacacaatcgaagttttagagaagtttcagccagttttacacactgcgagttgggtaagtgatggcctacgctggataggctggcaaatcattaaaatgatggcaaacgcggcagatggtctaaccagcatgtacagtcaagcgtttaaactcatcgacttttggaactcaaaggacgtcactggctttgtggctacctatcaaccagttttttgggttttaggaacactgggaattgcctgggctggattaatgatgattcatcgagccaaaagcgacttacagcaaaagtttaacaatcttcttgtggctcttctcatttttattggaattggtacgctaacttcaacattatcgggtcttgtcgttgcgggagtcggatcatcgttaaaaaattcccctccagcagtttccattgtttctaacaacatgacagacttagtgctggttgataaagctggttggaaaactctgcagccgaatcccagcaccagcatgaaaacaatcaatgacatcaactatttagatataaatgaaaccatggattctggcggatggtggcacattggctccaaactctcgaaaaccggaaatgatgttatggataaccagttggtcatgaccaaggatggtatgtacgacttgcgtaacatgcatggtttttttcatgacaccacgtactatcgctactcgttccacccattcttgatagcctttgaattaggggcgttcctaattgccattgtgctagtcatcatcaaagtcttcctatcttgtatggagataggctttacaacgatgttagcgcaaggtatggctttatcggatattgactccggaaaacgtaacttagctttaatccaaaagttacgtgataccttcattgtgctgtttttaacctccgtgatgttgcagctatttacgctttggacgaacgcactttctaatccagcatatcaccaaagcccatttgcacagtgtttagggattatcgccggtgctatgtttttgattaatgggccaaacattgttatgagtctttttggtatggatgccggagctcgtggtattggggcaacccttgttggtggtgcgatgggtctccgtgctattggtggcctagggcgtggcatggcacgcggtgtcaacaatgcggcgcacgcaacggcgcatggcgctgctcgtgcggcgggatatggtgctggttttgcaaatgcgtttaggagcaataggagtaatcgttctagcggtagtaaaccatccattgatggcattggcgcggaagccgcaaaacaagacgcagcgacacctgatctggaaacaccagcgacaacagatccagcgcttggcaaacaaagtggcacagacactaatccaacttcatcgagcgttgctgggccagatatggcttcgttgagcggtacagagccagtcagtgaggcaccggcagccacggggccagatatggcttcactgagtggcactgaaccagcaagcgagatgccggcagccgctgggccagatatggcttcgttgagtggcacagagccagccagtgatacgccagcagcagctgggccagacatggcttcactgagtggtagtgaaccaatgcaaggagatcaaggcgaactttcaaaacctaaaacagcacaacgtacgatgggacaagcggctcctaaaggatcaaactttgcgactgggactaacacccggggtcaatcagcgaccagcaacgttggtagtcaggcgggaaaccgagcatcaatcgggaatactagtccagatagtggtacgcaagtagaatctggaacgcaagccgttgatactggttcaacgccacagcagattccggctgagacacgtacgttaggtcaaatgttgggtggcagagtcgtcccggcacttgccaagcattcgcaaactgttcggctggcacagcgttcctataatcgcggggccgccattccaagcaatacacggaaaatcattcagggtgctaaaaattcgattcaaaaatacaatcaaaagtaaattattaggaggtgacttaaatggctcataaggtgatttattcgcgccgtctcattgtcaaaggacaatacaacaaacttctgaccattcgcgatgtcttcattgcgggtgctgtttctggggtcactttcattgtattaattgtgacaacacccatggctgtcgcgctgtttggattgattttaatgtttgtgctaactgcagcgttacgaatccaatccggtgtaccacaaaagaacaacttgcaggtcatgaaacagttgttactgcgcaagcgggtcatttaccatgcgattgacgatccaattagacaactattattcaagcgaggtgagcatcgtggcaacaaagtttgacgctgttgaagcacgtaaacgccaaaaagaggcagcaaagaaaaaggaacgcaaggatggtgttggtcgtatttatccggtggttggtatcactaattctggctacattaagctgactcacaatggtctcatgttttatgcggacgtattcaagcccaaaagctttgacttgtttgaactgtccgttcaagacgctgatcaaattgagagtgagctttgggggttacatcaacaataccctggttcgatcaaggaactatacatgaattttccagagaccaaccaacgtcaacagacttatttccggcggaaaattgagcagactcgtaatcccatttatcttgaactgttgcagcacgatttagccgttcttaagcaactcgagaaaacctatcggaaactaagcagttggatctggttctttggcgacagtgtgccggagctagaaagaaatctcgaattagccagacatgcttcaacgctttatacctttgagcgtgcaggacttgccgaaaaggagaagatgttacaaatgatgaataatccggaggtgagtgttagtgaaactgaagaagcttgatttagatcagcactttgtttttaaaacgcaacccgcaggtggtattgatacgcgcaacgaactttatctgaatatgggtgatcactatatgacgactatccatatttttgatattccggaggagttcagtgacttttggctcacaggtattactgaaatcccaggagtaacaacaacggtggatacggtcaacaatactaaagccgattttgtcgacaatattgctgaggctattacggaactgaccgtgcaattagatcatgcgaaaaatattgccgattctgatgagattcaaaatgaaattgacccgctgcgatcattgagcttagcactacgtaaagacggtgaggtcatcaggcagacctacattcgagtgtattgttatgcagcaacacgggatcaattggaacgtaaagtaaacgaagttgtgaagcagattcgcaaaatgagcttcaaagcctcagtcttcctcggtgaaggtatggaagagtaccaggcgatgtttctacctgctggtgaacagcggtacttgaagaatgcacgcgaaggaattccgctgagcggagaagttttaggtttaagttttgcgcataatcagacttctttaaatgacccgtttgggtcttattttggctacacacagactggcggcaccgtctattgggatcagtttttagtcgacaaacagcgaacttactacaatttgtttttgagtggtgacctgggatcaggtaaatcaacacagctcaaaaagattatttgggagcgtgcgattaggagtgatctagtacgtatctttgatcgatccggtgagtttagagacacggtgcacgctctaggcgggaaggtcgttagtttagatggtcgtgacggcacaattaatctgttgcaggtttatccaagtgtgaccgtgggtgatagcaacgaagttgacccagttggcagctacaaagctcatctcaaggacttgagtgtgaaatatcgcttgtttaatcacgatgccagcggtcaggaagcacaatacttcgcaacccaatgcgacggcttgtatcgtcaactagggcttctgggggacagtaaaggcttaactcagaagccttttattacggagcgagatgccaatgattatcccacgctcagtcaactcattgacttcgttgatcaaaaacgccaaaaccgcacagacgatatggagaagaaactgctagatcatatctatgtcacgcttaacaatctgcggaagacttatggcgaattatttgatgttcattctaccttgcctgattatgacggtgagttggtggtctcttatgacctctcagcgcttgcggattcttacccggaagaagtacaggatttgcagatttataatgcgttgatttcaagctacaacgtttgcatgaagcaagggcggattgaaaagaaggcatttgatgacggtgagcggtcgctcgaggatattcaccacttcttattggtcgttgatgaatgtcacactttactgaataccaacaaagcttatgtggctgatttgtttgtccgaatcatgtcagaagatcgtaaagcctttggtgccatctgtttagcaacacagcggttggagcggatgtttcctagcggtgataatgcgcaagaccgtgatacggtcagtgccattaatgctcttcgacagatttataccttatgccaatataagattgtcttgaagcacgatgcgacaaccattggaacagaaaagaatccacgtatcttgcgtcagttgctaggtgatattctgtcacctagcgaatttatacaggttcctaagtttgataaaggtgaagccatgttcctcctaggatctgaaaaactgcatatgcacttccaggtgacgaagcaagaacttgccatcttcaagggtggtgcctgatgtgaagaggctaagcaaacgatggtttgttcattttgttctaggcggtataggatgttcgacgatgttttttatttttcttatcgttctagccgcggccatgtttgctgggttgaacgataagaaaggcggcggtagcgactgcgatattaccgggagcatttcagccacgggtaatttcaacaaagacacctatcagcaagcatgggccaaatattttacgagtggtgtgctcaaagatgaagctgactacactatcaaagcagcaaacaaggcaggcgtttcgcctgctctttttgcgtccatcatgggacacgaaagtgggtggggaaaaagttcggccgtgcgtaatcaaaacaatccgtcaggccagatgtcaggtagcaccgtcatttcatatccgactattgaagcaggcatcgacgcaaccgcggccaccttgcataacctggttgtcgagcgacagctatcaacggttgagaagcttggatcggtctactgtcctgtgggtgcgtctaacgatcccacaggactgaatgccaactgggtaccttcggtcaaaaaaacaatgcttgaattcggtgccgatgcaggtgcctccttaacaacaacgtgcaactcgggtgcaggaagtgtcggtaatgggagtgccatcattaccgaagcgaagaaatatcttggcgttccctatgtctggggtggcaagtctccagccactggcatggactgttctggctttgttggttacgtcttaatgcaagtcacgcataaatcttacccacaatacacggtgtcactggaaagcaaagggacaatgctattcaacggcggcaaacctgtcatgagtgaactacaaccaggtgacatgatcttttatggtgatcatggcgcgtcacatcacattgctttttacgctggtgatggtcaagtgatcgaggaacctgaacccaatgacgtctgtcacattcgtccctataaagactatgaaccagactttgcagtcagaccatagaacaaggaggtaaacatgaatcgtaaaacaatgctggttagtgtcatgatgatcctcgcacttggtgccggtgtctatggctggacgtcagccaatacagccaacaaaaatatcagtcagcagaaacaagaactccgtaccatggcatctaaaaatggatcattagagacgcaattagaggcgctcaaactttctaaccaggccgatcgtgcgtcaaatcaagctgacaacgctagtaaaaagtcgactacgacatcatctcaatcagacaacctaacagacacaacacagaagattacagcaatgatgaacggtctcttgcaaggcatgtactcgcctaaaacggccaccacaatgggtcagtatgaagccatgaaaccttacctaacgggtgaggcgatccagactttcatgcctgatcgtgacacacccattagcgcgaatgggttccaagaatcgactattaacgacctgcgcatttttgtcacgccacagggtgatgactacttgttaatggcacgttacgaacttggtaacaacaagacgaacgcaaataagaaaaccacgatggtttttcaagggacggtcaggaaggtcagcaacgactacaagttagctgcctttgattctaaccgcgcactatcgggggtgacaccgtgaaacatccgtttagacatttcctcatcaatgctgttatcggtattgtcatcgctacggcttctttatcagcgctctatgtttacgcaccgaaggcaatgatcaatgtggcaacaccaatcaccatcaatgcacaaaagaaggatcagtatattctttactacagtcctacgtgttcagtgtgccagcaagtttatcgcacttacttctggcgttcagtaaccggacaactcaagtttgccagcgttgctaatgagcaaaacaaggaagcggcagctgcgttaggcatcacgaaggtaccgaccctagttcattataaaaagggcaaagtggtgacacagtatacgggtcatcaagagcagcagattgacaaagtgctggctggtggtaaggcaggtgaacattaaaatgatgaatcaaggtattcactttcaagacaaaaacaagtacagcctccgctacgtcaagctgcttggtattctcctagcggctttttctttgctcatttttgcgatcgttttatggcctcgtcaaaccgacaacaaacaaatcagccttggtcagaccttcgatcaaggcaacaaccagtttcaatttgctggggtcgatacggacaagcaaaacgccgccatgtacttctatgtaaccaagaacaccatcgacccactggcacctctaacaactgtcgtcgtgactaaaaagacacatagcggcagtgacttccatacccaattgaaacagatcgctgatgattattacgtggtcaatcttaagaaaagtgcgatcagcaatggccgcttgtttgtcaaactaggttccaaaaaagacttgtcaggggtcacgagtgccattgattttgttctcctataccttcgccatcctaccaaggtgacgtccctaacagaaggcgtttatcttaaaaactacctcaagattttgcgcagcaacacgaccaaccgagtcgcttccttggaaaagaagcttgtccaatacaatcatgatctgcaaattttgaaaactagtttagcccgtcaaaaagacaccgccgatttgcaagtcggcaaacaaaagcgggcaactgaacaacgcatgacgcaaaccgagacgaatatacaagacaagaaacaggacatcagcgacacgcaaagtgccattaaggtggcgcaaagcaacctccaaagttacgagaagcgctatcagcattacgctcatcattgagtgcgcatgtgcgtttgcaacgattgcatctccaagagtgcacttggtgttacagtcaatgcgttattgaggtgcgaatgatgtaacaccaaaaatgagtccgcactcaccgtcaacctcaatttttgctaaatgttgaatattgcaaaaaaatacaacactgatctctataagccaactggccgtaaggcctatggcctgtcgtcaaatgttgaattttcttctaaaatccaacatcgcctattttgctaatgttggattattataaaatattcaactctgcggcatctaactgctagcactataaaacaaaccgcactgcggtttctatcaattttgatagcagttttaccttatgctctttctttatttagggacgtgtcagatcaccctcaaaatacgcttgtttcgatcaagccgtttttgaggtcggttggttcgcaactcagatttttctgctcgtttgcctagtgaaaaacgttcacgttttgaccaaagtagtcgcaactgtttaccaaaaatcgtccggtaacgtgatgcgattttgacgttgtaacggatttccagatgacaattcatcatcactatgaaggaggttttgagatggttaaacaaaacgaaacacgtcgagtcatgattaccttgagcgatcaagcaatcacaaagttggatcagttggtagctgaaaagcaacgggaactaaatcaaaatccggagcttgctaagtacaacctccggatcaacaaatcaaatattttggaagccatgctgtctaaaagtagaacattaaaaagaaaggattgatttttttggctcatacaaccatcattagaaatctttctgagcaagacttagctgccttggatgatgcagcaaaacgtagtcgtttgtcacgtgaggagtatcttagaatgctcattcatcatgacgcaactgaccacttactcagcggtgatgtatcagatttgcgcgagctaacgaaacaaatggcagtcatcattgagcaaaacacaaaagcttatcttgattttgtatatgcggttaggaggttgaggttacctaatgaggattagaaaaacagtgactttggattccagccttcaaggcttcgctaatccagaggacgttcaaaaatatatggatcagaatgatcttaagactttaagtgctgccctcaagtctttaatggatgaacaccatcaactgggccaacaagttactcagcaacaacaactagtccatgaaattgtccagggaattatggaacaactcaaacccactgcaaagaaagtcacgatgactgaccgtaacttgctggtcttgctgaaactgtttgacggtgttgtcgtccaaaatggctgggataacttacccattcccgatgacacaatgaagccaactacggtcgctcgtaagattgtcagtgaccagattaagaccgagtacattcatcgccaaacgaaccaagtacaccatcgaggtggtggtgctgatgcctaatcgtgtatcacctggcattgtcaatgtgactgactttgtggcagcccatgccaaaaagtttggtagctacatcaactacattgatcgggacgaggcgattcggattgatcactttgaccaacaaaacattctgtcagttgacggttacaaccactacatggagaatccgaaaaagtcttccggcatcttcactgatcaatatgatcgtctgacaccaacacaacgcgtccagttaaagaaacaattcaccgtggcacaaaagcatcagtcagtcatgtggcagtccgtattcagtttccgtaacgacttcctagctgaaaacaatgtctacaatccgaagaccaaacaattagatgaagccaagttgcgggacgctacccgggtcgccatgcatgacttcaccagcaagatgggtatggcacattcagctatttggtctgccgcgattcaccgcaacacagacaacattcatattcatgttgccattgtggagccacaacctacccgtgaatggaagcgagttacggtcgaaggtaagcacggtgagacctatcaagaatggcagcgcaagggttatgtccctaagaagatcttgaaccatttcaaggcggcctttgctaacgaaatggttgatcgcgatcgttcacttgcacggatcagtgacctcattcgtcaacgactacaacccgatcagcgttctgcttggcgtcatcagagcagcctagactttgccgttaggtatcaagacctagtcaaaagcttgccgcgtgatcgccgcctttggaagtacaacaacaatgccatgaagccctatcgcgatcagttagatgccatgtcacgaaactatttgatgcgttgtaagccagaagagttgggcgaatttaaacaactactcacacaagaaacacgtttccgtgaagccttgtatggtagtggcacaaaagaagctaaccgtgcgcaagactacaccgataacaaattacatgaactgtatgcccggatgggtaacagtattttaaaagatatttccgcttaccgttccgaacaagaagctgtttctcaaacacatcatcaaccatcagtagccaatcacttgaatggcctacaaaagattttcaacgccgatataaaggggcaacgattagccaagcgtgagtaccaaagacgccaggctgatcaggatcgagaacgtgaacaagacaagaagaaacaggaacagcagacgcgcttttactagaacattttttgtttgtcttctatatagaaaggaaaataatgatgccagctatttatgcagatgaaatgcaagtgctcggtagtgagctgcctgtcattgatagattagatgagtatccaactattagcttgcaaccaacgtccaccaaaatgagacgggttgcttggcagcaggttgccgacaatcagtatcaaccactgtatgctttggaaccgattatcaagccggttcctggtgcggaagagaacgtcacatgggaggaggatggtgaagatggcgaggactaaagctgagatcaaagcctgggaacatgagatggcgcagcgagccacagaacaattgagcgcgcttgctgatacccaaaagtttaaacaataccttcggcaaaacgctgccttccatggctactccgtccgcaacgtgctcttgattaatatgcagcatcctaatgcaacgcgggttgccggttttaagcagtgggacaaattaggtcgtcacattcgcaagggtgaacacgccatcaagatcaccatgccaatcgttaagaagctcacgccagaagaacagatcaaatacaaaacgaccgctgaacgagcaattgttggttatcgttacggctcagtattcgatgtcagtcaaactaagggcaaagctttactatccgcaaacgattttattaaggagcggttaggtgatcaccaaaacgtggatcgcttatatcacgctgtcgttgatgtcatcaacaccgaaggtcacgttaaagtcagtgaagcgcccattgatgaactgggggttcgcggtttctttcggccgtctacccaagaaattgtgattagtccacaagaaacagatgcggctatgaaactcaagacgctgtttcatgagtacggccacagtcagctacatggcattggtcagacatttgctgatcgaccacgcgcttggaaagaagcgcaagccgaatccgttgcttacattgccatgcaaaacattggcatcgacactggcgactactcactaggttatgtcgctacttgggcgaaagatcctaaagtgatggcacaagccctcaaagagattaatgaggccagtgtgcatacgatcgagctatctgatcaagcggcgcaagcattaggttttgatcaagcacagaccgcagaagcaacgcttaacgatgctccggaacaaacaacaaacctcaatagcggtaagcgtgagcgtttgacgcaatctgaaatcaatcgcgcgcgtaaattgtccttagttgatattgcgcgtagtgctggcattgatctcaaggaggattcccgcgattactaccgcggtgtcgatcacgactccttagttattgatgcaaaaaagaatctatggaaatggaactcccagaatttaggtggtggtgcgattgaattcgccaccacctttttagaccagaaaggcttttatcaagctgtcaagtttcttaatgctggtcactacggtgaaacaaagattcagaccgcgcctaaagcagcctatcataactacttgaaacgagctgatagctttgatcgtgcgcgggattacctcaccatcgccagagggattaatcctcatctagttgaccgcctgtaccaaaagggactcatttttcaggactcacaaaacaatctgatctttcaatgggcacgcaacggtaaggcagttggcgctagtattcaaggcaccgaaattgattttaaaaactacggtaaacgtggcacgcaaaaaaagattgctgctaattcgcaatcagattttggcttcaattttagtttggggcaacctcaagacttgtatgtctttgagtcaccgattgatgcgttaagttactggacgcaacacccagagctaactaattgcatgattgcctcagttgatggtaccaaagttgagagtgtggtgaacatggcggtcaatatgtataaaacaaaagggcaactgccagccactatttatgttggctccgacaatgaccctgccggtcatcagctttatgacaagctgcaggattccatcttagcgaataccgaagccgaggtaactacctttaagccgcttttcccacaggataatgcgatcacccaggcgacttaccaagacttaaaacaagtagcgaatcaggcgggtattgattggcgtgagttggcagcagcagttaaagcaacaaccaacctttcaacgaacttccagcagtcttttccgctgccacaagcgattgccaaaagcagcgtgctcatcgatcccaacccaggaaaaactaactttaattcagatgaggctttactaaccgctgcaaagttcatcaaagctaaccgcaccagtgaccagcagcctgattgggataccattacaaagaaattaaaccccggtattgaggatcatgaccgagaacacttagcggctaaatcctcttactacaacacgagctatcaagctgataatggcattcttccggtgaccaaaattgctaaagactggaatgagttagccaagttggcccaacatccagcaacaatggatcagcagttagaacaaacctatcgtcgtcaggatggaaaaacggcccaactagttgataagggtcaggatgaatttgcgctagtggatactaaacagcctgataaagttgtgggctactttgaagccaacgatcctcaacagtgcgcctatctcattaagcagtatgggtacaacgctgtagacaaagaagatgagcagaagtatcaacaaactcagccggttaagccccaacatcagcagaaaaaacaacgtgcatcaggactagagcaaagtatttaatgccctacctgttgggtttcagtcgagctggcgacgagaacggctgggttttgccgttccgttgcatcatgttgccgagatcggattgaatcctcgcggcaggcagatgcccgaagcgcgtgggcggggcaggcgccccacgcttctcggccttggccgaagaggcttttttttgcggtagcaaatagctgtatgccttgcgcctctaggaacgaagccaattatatgctatactagacgtggcagaaaagttaaagacggtggcgacttccgtagattggaggtggtgcttatggtgtaaaaaccaacgtaccacgataccaacgaaaggagaagccttgtgtccatttcggacgctttacagcttatgctagggttcggcacgtttgtcgtagccctgatagcattagttgttgagctgattaaaaatcagcaaaaaaaataaccgtcttcgctttggctagctgacggttatttaacctaatagttgccgccgtcttaaacggctctgctaggggagcactcttgtgggggtgctccctgtttgtattctcattataacagaaaaagcacaatctgactagattgtgcttgctctcgatagcgtcaacttttagtgggttaacatgtgtgactctgctagacgataagattttaacctgcatcacgttttcagttgattgccattcatcttttcatttgacactggggtagccccacggatctccatgaccgcgcattaatgcccgttgccacatccttccttggccgcgttttagcgctacgaacgctccgtttactgccgaagcatatttttcttggtcagctttgaacagtacactaatacgatcatcaactcgaattttccgcttggtcttttgaattttttgatttaccatgtttaatttctcaagcacatgaccattttgcatcacaaagacccgagtttgcgataagctatcagttccagcctgagaccaacccattgggcgcgaactgaagcgttcagaaagcacgtgactgatgtggccttcggccgaacacccgtgaaaagacgagtctgtattcgccttaattgatgaccaatttgagcgaatgcgtgtgcgcgcttgctgaatagtctttcgttccttcatgcgcaactgtgggtcgctcagccgtacttgaaagtaatcttcaaggtatttccgctctccttgcaaacaccattgcattaatatgagaccgatattacctggaattccgactgccgcttgttgacaggtcttctttaaatgaaacttgtcataaaccaaggtacagttcggcaagaaatctgccccagccttaatccagttagccccatcacctgcgagaaagaactggtttggttcaccttgatatttagcgtcaattaaatctttaactgtccgccaaagctcttctgtccctattggtcctggatactctcctgtcacataaactggttctttaatactaaacctaccaggacaacgttgatcatagccctcgtgaacatagaccattttgagaaagtggcttgtgccatcttgatgagcaacgtgatcttcatcagcttcaacgaaaagtaccattggtgcctggcgtttttcgtgatttaattgatcgagagcggtaatgagttttcctttttcatgcacaacgtgcatgacggtgcttgagctttgtctagcaggaccgccgtgttgcgctgagcgatgataagacatgtgagtcgcgttttctaataacttggccttgaggtcgagactgagccgactacttttttcaaggccgatctgctcatcaagcaaaaagatgcgttcattggtacgaacatcttcatagtaccgacggcgaaaagatacagtgccaatgctggtatcgacatggcgttcacgcatatctttgattttaaaaaactgcttccggtaggaagaatccgccaaaacctgatcttgttgttccagcatgacaccaagtaattgacaaagagtctttccaaaacttttttgagtttcgatgactagattggcaaagtctaactttcctgtcagtaaatcaaaggcagagtttccaaatgatgtcatcatttctgtgatgatttgttgtaagatagagttcaagagtgattcctcctaattgctagctggttgatttgtcattaacattctagcatgagtagggatcgctccctttttgtttctgataatttacccacttaaactttacgctaagttgctctctttaagccttgatagcaccttcaaaggcattcttgatgtttggattgagtagcggtgcttggttaccagtaatgttgctagcaatcatctgcagggcgcttaattcctgcgcactggccttgtcaggcttaactcctaattcaatgcacaagatagcaagtacgaaccactctcgattacctttgttgaattcagcaagtgttttgtagtaggcattgaccatattcacagccacgctgtcagccacgacctcttcaagttgcttcgtcagaagtttcttgtagtgtttcttaggtaccaccgtctcgttatagcaataggtcatgtcctgcatggtctgggcgagtttgtcacagggctgtttcacaatttcatcgtaggtagttttcacagttaaagacctctttcgatttcttttccttgccgaataaaggcatcaacgagttctaacgcgtgacgcaagcgattaaaggtatcgccgtccagttcctcaataacttcactcaatgcgacttgtgcttgttgttggtcaatcatggtcgtcaccttcttccagtggaacaacttcacagttcgggttgagccatttagcaaattcttttgcggcggcctcggtttcaaatcgtttcgcctgtgtttcgtcccgaacgtaagccacctcatcaaactcatcatcatcgtaggtagcatggtgaaccgcctgtgcatacagcaagcccattttgacaccccacgcgggcgttgggacgtgcagtccctcggccacaacgtctggtttctcgttcgggtcacctgattcaacaatgacactatcgactaaatcactctcgcgcaagtcaggattttggctcaaaatgaaatctgttgcgagccgctgtaggtcttcgtccttcgcgtcttcactggcgtaaaccataatgaagtgtggttgatattcgatttcgtcaatgctgacctgatacatttttccttttttcattagttatgcctcctatttgatgagttgaacgctgatgtgttcgtccataaattgttgtgctggttgattgatgagctgatatttagcaaatgcgcgggtcttcggagaaagttgacttagtaactggtctgatacaaccgccgtcagcttgctatcgcctagcatgagcgctgtcactaacagcttcttttcatcgtgagcttgattagacgtaagtaagaagtcttcggtaacgtagtaaggcgtttcgcacccgttggcataaaaggctaggcgttggttgccgtaatggtctcgctcaatttgactggtcgtttgacttttaaccgcaatttcttgaatgtacgagtgtaacccttcactcaacttgtcgtgcgttcgctgtccgttcggccaggtttcaaaaacactcgcttcctcgtcctcaatcattggcaggtaaaatggtaatttttgcatgattgtcaccctttctattggcggttttttgaagccgcctttgatgtaacaggcacaccagccacagcagaaaatacaagggtgagcgcagcgaaagtggcaaaaatttgtggagcggtttttgcggaacaaaattttgtccggcccttgttttttctgctagagccgcttaggaacttgtttcttagcggctttgttgctggttaaatgcggaatcaaagcaaggcaaaaaccggcagtagaaatccactaagcttaaaggcgtacatgatacccgacggggtccatgtacgcctctattactttatagtggtattgaagcagaagccgcgggttgccttttggctctgtgaagccgtagtagaaagtggctacttcatttgtcttagcaaattcgctcaaagtagattggtccgagagaccgcgttttgaaaacttgattactaagattttagtgagggtgcttcagaaaggtagtgtaacaatgcgaaaaattatcggtatagatgtttcaaagtcaacagctaaactgtcagtggccattgatgctaagactgtttacgagggagatatcacgctagatatgattggattcacgagtctcaaggctatcattgactcatacggcggtgcagaagtggtgttcgaggctactggtgtgtactcacgtcgattagagcgatacctactggacgaaagcattacatatcatattcttaatccactcgtcgctaagaaacggttagacgatggctcaagaacaaggaagaacgatgtacgtgatgcccgcgggctagcaataactgagtttgccaaacaccccaagccgttcaaaccacgcttctatgaccctgtatatcgcgaattgatggatattagtcgatactacgatcagcaaacagaggatttaaaacggaccaagaatcggatacatcgactcatacagctctcatttccaggaattgaggaagaacttgatttgagaaagccatcagctttacacacgctaactcttttttctcacccggcagaactgactggattaagtttcgagaatatcaagacgcagattctggatatgcacttaaagggggtgggagcggtcagatccagcaatttagcacgcgcactatggagatctcgagccaggtcatatccagctgttagcggcaactcgtttgttgtccaagctgtaaagcatgagactcaaaaggcgttaaagttgcttagcgaacgtgaagaaaccgtacaagccatgatcagcctagcagaaaaaacaccggagtacgttatcctcctgagcattccaaacatcgcggaaaacaccgctgtacgtttgattgcagaacttggggatattcgccggtttgaaaccagagcgaaactcaatagctttattggtcttgatttgcgagagatacaatcaggggactatacggcacaaaggaagatcaccaagcatggcgatgctcatactagaaagctactgtattggacggttataaatatggttagctcaggagcacagccgagtcatatccgtgacttttatgcaaaacgacaagcaacagcttcccggaggaagccgctgcttgtcgcctgcatggatcgcctactaaaaacgattcactaccttgtaaacacgaatcagttatactcatacgaactcgcttgttcaagataaactgactcaatacacttactgtacatacctgcacaaattttggaaagcctgcaggtttatttggggtgtcggactaaatgttttaaggttattttagatcagaatttaagattggattcagcatcctgtggctaagaaatttcgatattcaaaatcgaattcattgacatatcgggatttaaacttgacagggcgtagaaaaggcacctgcgggcttgcccgcgtggcggcacgccacatgctttatgcacaagttttgcatgatctgcacgatcgccgacaactggcaaccaatggggtttaggtacagactggacttgccagttacctatgctgaaacgacaagacgttgccggggcgtgcgggtcggcctagggcccgccgccccctacgcaaactatgccttactgagcgttagttgctcagcaaggcctccactatgtatgagaaaggacttccatataaaatcaagaacacgcttggttttgtctttgagtatcttgtttggactatgctgtataggcttttgcgtatacacgtctcagtatcatccatcaatatacaagtacggggttacaattaactgcaataatggtttattacaatagaaggagtctgatttaatggatcgtgattctgttcgtaaaatggttcagaactacatcgacaagaacaatctgagcaatccagaatttgccaaacaagctaaaataaatgatcgtactgtgcgacgtttgctaaactctgaggaaagcatttcggattctaaccttaaaaaattggcggctgcttgtgtacagcctaaattcgccgtcgttggctttaattctggtaaagtctactttcgtggtgagcatcacgcggactgtactcgctggatcaatacacaggtacgcactggtgacaccttacacacaagtcgaaaaacttatttagatatagatgaacctatgttgattcagcgattacctgtggcttcataacaagggtaaaaggaaaggaagatcaaattaatgaaaacacatgctgttttgtacaccaaaccaaactgtcctgcttgtaaaatgacaactaagtggtttgatcgcctgggttacccgtatcagaatacgtactatggcaatgctgataaaagcaataccatagatgtaagcgcagaagataaacgtaaacgtgagtggagtcagcataaggtcgagcgtttgaaagccaaatatcacattcagcaattacctcttgtcaagatcgttgatgacgaagggaatctgattgagtattggtctggttttcgaccaaacaagatcaatcagtatgccaattaaaaaccgtcattgaaaatcaatgacggtcaagtaagctgtggtatgctagacaagcaagaggttttaagggcggtggctgtcttttcccgatgaggtgatgtctatgggaacatggaagaatctccagaaaggtttcacagccaatgagtgtctttcaggcactgtcgctgatgattgcgttcggcttactagtcgcaaccattctcaacggcaaaaagaagtaataaaaaagccgccctgtgtaactttggaaggtcacaggacagcattcgtgttgtttaggtaatcttgccaccgcctttgaagcggcttgcagggagcgttgcgtcgatggatgcaacgctcttttgctatgttcattatagcatgagttgtcaggtgcaaacaattggagtgttatctgtttggggcaagtcccagcattttgtctatccatttaccggaaaacttaactaacgcaatgcaaaaacggattgccaaataaataattagaaccttaaatccaaaatggaatatatgcccgaggagtgacaaaagagctggtatggcaaaggctcctatagcaacaaacgcaagagccgggaaaatataaaatatcgcgtatgcgcatataagagctatgattactactaatgccatttctccggtcgtaaatatttgtggtccaaataaccatttacaaaaatctgcaagcggatgttggaagaaccaaacaaacggtgataatacgattgaaataagctgatccagcgcgactaggacttgatctgtaaattgatcaagctgccaattcatcgttttaaatgcctcgctcatgtcctgacctccattctcatttttaacgcatttcatgtcttccatcgggtcacctatatgttactagtgtttgtggaacttataggtggtaacaatagggtacacccttacgttatcattcagattgaatgatcaatttgttttgctaaaaacggacagtaagatcaacaagggttaaaagagccgtttttgcacacaaccactgtggatcttatatatctctaaaggccctttttttgaatcgccgattagcagctcacttctttcatcaagtgatattcctactggcgttcctaccggttggttatagcttggccaaagatcttgctctccttatgacgcttcctgtgatcaaatatagttaaggcaattcgcttatggtaaatgtaatgatagcttgtgtgtggagaataacgaacattatgatcgatcatttcgggggaacgcccctgtctaatggttcgatgactgaatcttttaacctcggtatcaaaccttagtgacgaccacaacgattaaggtcgcgtcgaatggataacggagagcgatctgaaattgtcaacgtggtttgaacaaaaactcgttggttcttcctcaattatactctagatcgctcagctaaggatataatggcaataagagttgcccttctctctaagtagtattaacttctggttaaatggccatgtttacgagttcctgtaaaatattagctttattttggaattgttttactttcattagagccttttttagatttgaaagggtttttttcaaacgtatcagaaaacaaaatcttcctttctcgttctttttgcgtatatcccagtttttttcgctttaagaaatcatctaaaatagaatacgttttgattaagcactctatataacttctaaactcgtttctggaaacgtcaccatgtcttccgtcataagtgtttctaattccattataaggacctgttttctgaacaaacaaaaattttcccttaacgtaccgtgatacttcttttgtccgtgatatttcttttgacgcagaagattccgaattgaaatcataatcctcttcaagaagatagtggccagggacatcttcaatcaagtattcacactcataatcgcccatgtgtttatcaaatattggttttatttgatcgaattcgagcaaaaaatagttccacttgctgttattatcaaaactttcatagctcaacattttcggctttcctacgtagtaaaagccagttgtatcacataattcaatacaactctcttcatttgcgtttttagccgaactgaaatcgagaccaccatggctgctaaaaagcatgtggttgtagccagcactacttccaacaatattcaatatattaacaatatcagtattgttttcccagcacactgtccttggcgaatatttgccaaacatttgcgtttttataaatcgccaatcgctttcctgagactttttaccatctctatatatattcacccagttttctaattcttttttaaattgacttattgttggcctgttctcaggatcactatttgttgcgtcacgtaaagccatttctatttctgccgtgtgcttacctttagcccgtcctttattatatatgcatagtttcttatttgagtagtcatactctccatcaaacccttttttatcgccggttaaaagcatccataaggttttcgctaaagaaaatacgtcagctttttttgcatcagcatgtctaggatcccgtttcatttccggtgcaatagtaaatattgcgcccaatcccttattagtttttgtatcatcgtttgtgttttctaaacaatcagctaatccaaaatcgctaaaacaaaatttgcctttataaaagtaaatattatctggcttaatatctcgatgttcaatatttttttggtgaagagtttctaatgtggagcacaaaaaaatggttcctttaattatatcaagcatttcaagctgattatcatcaatatatttcattataggaatcgctattggcatggtataccaataatctttaaggtcactgttacatataggtatgatgcctgatactgtttgctgattttgagtcacaatttgaacttcacgttcaaatctctcttttttctctttggaattctgatatagctcctttaaagctaaaagttcattatcctttttcctgttaactttatatactttgggaagtcaacactttttcggacagtttgctaagcgactttttgtgaagctttagaccactatcaagaattcgttatcatcgttgcacttgacttgaaaattgaggtatcaaaaaagaacagcctcaagtgacagactgttctaaaaagctggtacttacaggttaatcacctgcatgagtacctcggaaacacgcgcccgttctttctctggtaagtgggttaagtatttcaccaccgctaacgtgctaatatcgctcatttccggagcaatgaagaagtcgcctacctgcatatttaaagcccgcgcaatgtcggtcaatttttttatgctgatattgttgacgtctccacgctccattcgcgaaatcagactgatcgagacgccggatcgctccgccaacttctcaatcgtcaagttcaaactgcggcgctgttggtgcaccaatttcccgatattgtctaacatggttcccccacctttaatgtgcggcgttatgctttaacattagatgaaacgccgggctatcaaaagattttataatattatttaataatctaaagatggcctattctcacagaacacaaccgcactgatcccccacatcaactcaccaattcttactctataactattgtaaacgctcgcaatgaggaactgccaaaaatcagcctaataaattaaaaaatacacaataaaaaaacaatgccaattaaatcggcatcgttatttactttccgcggttgcttgcacaaaggcccataagctgccacgtgtgaactgttcgccatccgaggtgtccaattcactgatactattattcggcggaatgcgcatcgcatcacgcgcagaatcgagatcggcaccgaggtatgtgcttaataacagcatgccgattaaaccgtgcgccacaacgagcactttgccgtctggatgggcatcataaatccgattgattgcccgccgtccacgttttaacgcatgggcaaatgattctgcaccgatacgctggttatcaaacgccgtcaaatgatgataataatgatcaatctcaggatcatcctggacagaagtgagcggctgaccatcccatttgcctaaatctacctcgcgcaaatcacgatccgtcacaatcggcggttgaacgactcggctttgggccacaattaattcagccgttgtttgcgcccgcggcatcggactggcatagatgcccgcaaaaccagtcgtcgccaaaaagcgtccaactgcgatcgcaccatcgcggccactcgctgtcaacggcgtatcggttcgtccaccgttaaatcgccgcgccaaattcgtttccgtctgtccatgccgcacaaagtaaaacttggtcatctcctgcacgctccttataaacacgttcatcaggccagcaaccggtctgacgaacgttctgtctttgaccatagtgtagcagaagcgcgccaaattagcggcaataatcagaaaagttcagcccgacttaaccaaaactgcaacgattatgcctattacgtcagcattttggcgacatcaacgacaagaatgtgctcaccgcctagaaatgtgtgggtaagacgtttgtacgcaaaaagccgaacatgcaagtttcacatgttcggcattcttacgcgatcattgaagcacagcactcagtaggcgtttactgggcagctttaaccccttgatgatccgcttcggcttcagctttataagccgccacttcgtcatcagcggcaaaaatgtaatgttcaggataaacctcaaccattttacgtttcttgttgtcgccttcgaccttgctggcgtcatacggcagcggcacacgtctacgctcaacatctggatcaggtaccggaatcgctgagagtaaactcttggtgtaagggtgtaacggatgactataaacttcatccgccgttgccaattcaaccaaccgtccataatgcataacagcgatacggtctgagatatacttgaccatcgataaatcatgcgcaatgaacaggtacgtcaacccttggcgatcctgaatgtccttcagcaggttgacgacctgcgcctgaatggaaacgtccagcgcgctgatcggttcatcggcgataatgaacttaggctgtacggccaatgcacgggcaatcccgatccgctggcgctgaccaccggagaactcatgcggataacgagtcgcgtgatcggcgtttaaaccgacttcttccaacaactgctcaacttgatgatcccgatcagcgttgtttttggccaaatgatgaatatcaatgccttccgcgatgatgtctttgactttcatccgcggatttaaggacgcataaggatcctgaaaaatcatttgcgtggctcggcggaaagccagcatctgtttggagccatttttcagtttggcaatgtcgttgccattgtacaaaatctcgccgctggttggatcgtacaagcgaatgatcgcccggccagtggtggttttaccagaaccagattcaccaaccaagcccaaagtttcgccttcataaatatcaaacgagatatcctgaatggctttcacttggtcttttttccaggcattgaaggtttgaaccaagtgcttgacggacacaagaacctttttgtcttttttgtcgaccacgttagttcaccaccttttcatcttgatgtttgcttgcccataacgcatgtcgccgcgcaatttctggcggcaattccactttcggtgcgcctggtgctaatagccaagttgccgccgaatgggtcggtgagatcttgaagaatggcggttcctgctcgaggtcaatcgccatcgcgtatggattccgcggtgcgaacgcgtcaccttttggcggatcaagcaagtccggtggtgtcccaggaatggcgtacagtcgatcgctcttggtttcaagtgttggcatagcttcaagcaacccccacgtatacggatgctgggcattgtaaaagatttcgtcgaccgtaccatactcaacaatcttgccagcatacataaccgcaacacgatcagcaatcccggcaactacgccaaggtcatgggtgatgaaaatgattgaggtgtcgatcttcgactgaatttctttcaacagatgaataatttgtgcctgaatcgtcacatccaaagcggttgttggttcatcagccagcagaatctgcgggtgattgatgattgcaatggcaatgacaatccgctgacgctgcccaccggagaattgatgtggatagtcctttaagcgaccgccggcatccttgatgccaaccaaatccaacacgcgttcagcttccttgagtgcatcggctttactgattttactatgcaacagtaacggctctgccacttgtttcccaatggtcatggttggatccagtgacgtcatcggatcctggaaaatcatcgacacatcattaccgcgcatggcattaagctgcttttcggacttttttagaatgtcttcgccgttaaatagcacttcgccatgggtgattttcgcatttggtgctaataatcccattacggtgcgcacggtaacggatttaccggaaccggactcaccaacaatggccagcgtctcacctttgttaaggtcaaaactgacattccgaatggcgtggacagggccggcataggtggcaaagtcgatctgtaaatcttttacttctagaattttactcattttgccacctcctaatgttcactgcgcggatcaaaggcatcgcgcaaaccatcagccagcaagttgaaggccagcatcagaatgacaatcacgatcgccggatataacaactgatacggtagcacttgcagattcttttgaccatctgacagcaaggtcccaagactagcagtcggtgctggcagcccgatcccgatataactcaggaaggcttcaaagaagatcgctgtcggaatggtgaacatcgtttgaatgataatcgttgaactcagattagggatcagatgtttaaaggcaattttgatgctcgactcgcctaacgttctagcagctaagacgaattcctgatcttttaactgcaacgtctgcgcacgaatgagtcgagccatggtcacccacccagtgaaggcaattgccaagataatggaggtcaagccaggacggaagaccagcagcatcaaaatgacaacaaccaagttaggaatactggagatgatttcaataacacgttgcatcaacgtatcggtcatgcccccgcgccagccggagatgatgccgtagaaaaccccgatggtcaaatcgaagaaggttgcgacaatcccgatgaacagtgaaactcgggtgccgaccatgattcgagacaacaggtcacggccaaggtaatcggtacccagcaagaagtaaacatttttacccatgccagcgtatttgttttgaccgttcatgtagccgttcaaacctggcaaatcgatacctggccatttgggcggcaggttcgcatagttcaggctttgcttgtttggattagaaggtgataaccagatagaaatgatagaaatgaacgcgatgaaaacgagcacccacagggaaatcactgcggccttgtttttcttcaatcgccgaatcgcatcttgcgtgaacgtcagcgcaggcgtggcaatacgttcctgttcagccgcatccactttaacatgcttgaatgcatctggacttaatttacttgttgccattagtttgcctccccgctcaatcggattcgtggatcaatgaagccgtaaagaatatcgacgacaaggatcacaaccgtcagcatggcactgtagagaatggtcagccccatgataactgggtaatcgttggtcgtaattgacttaacgaattgttccccaatcccagggatcgcaaagatgttctcgacaaccagtgagccgaccattaagtcaacagccattggtccgatgatggtcacaatcggaatcattgagttacgcagcgcatgcttggcaacaacttgccagcgtgattcacctttggaacgtgccagttcaatgtaatcagaactaagcacatcgaccatttcagttcgcatgaatcgggccgtttgggcaagcggtgcgatcgccaaggcaactgtcggcaaaatgctataagagaagccgccccaaagtgctactgggaaggcgccagttttgaaagcaaaaagctgcagcagtgcggcgaacacgaagttaggaattgagcgaccgagaatggcaaaaatggtagcagtcgcgtcaacccatgtgttcttgcggatcgcggcaatggcaccaagcaagatcccggcaagtgtgccgacgaccatcgcctgtgcgccaatttgtagagatggtccaatccgagaagcgattaagtttgacacggtttggccaggaaattgataggacattccaaaatcgccatgtgagattccgacaatatacgttaggtattgcatccaaaccggcttatccaatccatactgtttcttcaaaatcagcagttgatctgctggaattttggggttgttaaacggcgtccccggcaacaacttcatcaggaagaaggtagcgctggcaacaataaacagtgtcaggagcaggaagccgatccgttttaaaatatatttgaccatgattcactcctgtttatgggcacacgccctgataagcaaacagcgttgtccgccgcagaacacgagacaacgccgtttgtgagaactacttatttgaaactagcaggcagttattcgtaactgctcacgttttggtttaaaaacgcggttgttagaccataatccgactaagttctacttaactttcgcattcacaaagttgtaggaattagttgggttgtaattcaaaccggtaatggtcttacgctgcaaggttgtttgtacccgttgatacagcggtacaacgccttgttccttcgtcaacagttcttgggccttgagtaaggtgttccaacgagcggttgcgttggtcgcatcggtcgtcttggactgcttgatcaaagcatcgtattcagcatttgaccacttgccatcgttgtaactgttatcggaggtgaacagatccaagaaggaaatagcatctgggaaatcagcactccaagcggagataaccatatcgaactgaccattttgggaacgagatagacgcgtcttgaatggtactgaagcgatggtaactttcagacctggcaggttctgttgcaaggtgctctggaagtattctgcagaacgcttagcattggtcgtatcgtctgtcagcagttccaaagttggtgcggactgaccgacttctttcaaaccttctgtccacaactctttagccttggctggatcgtacttaacagcggaggattcagctttagatgccgtcttggagaagtcttgaccgttcttttcgaacaatccttcaggggtcacattgttggccgcgatggaagcatcattcagaaccttcttaatgtatgcctcgcgatcaatcgacatggaaattgcctgacgaatcttggtgttcttaaagattggatccttcttctcgttcaattcaagatagaaggtcgcactttgcttgaggcctttgaaatcagacatggattttgcttgagccgcttgttcaccttgcaaagctgcgatatcaagtttcttcgactgatacaagttcatcgcggtttgcgaatccttaacaacttgaccattaagggtatcgatgtgaacgttcttagcattccagtaagtagtgttcttagtttctttccaagtgttgccagtgccgttccagttcttcaactggtaaggaccattggacaagatgtacttggaagtagtcccgaatttcttaccagatttttcaacgaatttctcattttgtgggaagaatgctgggttaaccaacatggtcttgaaataaggaatcgcgtggtccaaggtgactttcaaagtcgtcttgttgacggcggtaaccccaagcgtgctggccgctttttaccggctgtgatgtcatcagcgtttttaacgcctgaatataggtaggcgtattgcgacttggtcttcggttcaaccgtccgccgccaagcaaacacaaaatcttgggctgtgactggatcaccgttactccatttagcattacgtaacttgaaggtataggtcttcccgccatcagtaacagttggttgactcttggccatggcattttccaatttgctgccattgtaccgatacaagccatccatggtatcaatcaatgcctgaccagaaatagcatcggtggtcgttgacggatccatcgtggagatcacatcactctccatccgtgtaatcgaagtacctttactgctgctagaagaattagaaccacaggctgctaacacccctgcaagcgcgagcgcagagcccgcaaccattgtctttctaaatttcatcctgttccctcctaaaatgattgaacttaccttacattagaaatccattaatgtaaataagtgaatcctcaatttcgcctaaaaaaaactaattctttgatcttacttttgtcacatttatgctaccgatctcaaattaaaaattgtatatcccgtaaatattctctagatggattccttatttataggcagtaagaagcccacccaagctaataatcggcacgcgtttttgttttcattttgattgatgatgctaagaatagcttatattaaataacactggcaagaattgaaaaatcgtcaaatagtggactaatattcggcttttgctcatagaattttcgcttttgtcagacaagctgccatcttatacaaataaagctgagcaaatgctcagctttatttaaccgctttcatatgttccacttggatttattgaactgaagccttcgttcgccgactgcgaattgttcgaaaaatgacaattattaatccaaccacggaaacaatggttgctaaccagaaaacaaaggccaatgcatgcaggaatggtgcccccgactgcggcgaaattcgcgtgacgcctggcaactgggcaaagagtaacgtagcaccaaagctgatgccgatggtcattccgatggttcgcgccaacgagttcagcgatccggccacaccagagacgctagcatcaaccgcccccatcgttaaggcattgtttggcgaaaggaacaacgccatgcccgctccattgagcacaatcggccagatgatgggtgccatcgacaattttgctggataaaaaacatagccgacctgtgacacaatcaggactaacaagcccagaatcgtgagatagtaacgattccaatgatcggcaagccagccggcaaacggtgtaatcatcaacatgacaacactttgcagcatcatcaacaggccgctttcaaaggcagaaataccgccgtaactttgcaaatagaatggcaacaaaatgttggaaacggagttaaccaacatgacgatcagcagcacgctgacggatattaaataatcgggattatgcatcaatgctggcgcaatgcacggtgacttggcacgttgatcttggatgaaagccaacaacgtcaaaatcgccccaccagcaaggatgagaaatcccaacagatgttgcgtcggctgctgaagccaatagccactggcaaaggtcaagatcatcccgccagtaaacagattttgccctgtccaattggcgctaccccagacttgcttaatctccccagttgctggccggcgcagtggcaaaagtcgcatccccgcaaacacgatcagcagaccaactgggacattgaaaaggtaaatccatcgccagcttgcccaagtaatcaaaatgccaccaaatgccgggccggaaatcgacccgacggaaacaaacattgagattaccgctaacgcctctgctcgattagcatcaggaaagtattggctaacgatgcccatcgaattcgccataatcatcgccgacccaacggcttgaatgacgcgaccggcaaggatggttagataagtcggcgcgatccaagttaacaatgaaccaactatgaataccatttcgccgatcaaaaagacgagattttttgagaccaaatcacgaatatggccaaacatgaccagtaaaacagaggtcgtaatgaggccgatggacacaatccaagtcgcggcactgctggaaatcatgagatccgccgaaattttcggcatagccaagttcgtactggacccagacaaagccgttaataacgacatcatccccaaaacaattaaaattttaattcgttgcgcgcgtggcatggtcatcaccatcacaccctttcggactgtattttaggctaattggtcaggagtcacaattattctaccttggtgtgacagggtttgcttgagctactcaaccaactggctgtctgctggcacacgttgattcaatgaaccggcaagcgatcgcgcaaccggctgcggcaaaatgacacgtttttggataacaaaaaaccacacagattattcactgtgcggtcagcttgctttggaaattatttttgagcgcggcctttgtaagttcctgtgtcggtcgtgacgataatagtttcgccatctttgacgaaatccggcacagtaacaactaagccagtttccaatgttgctggcttgccgccgcccgccacagtgccgcctttgacagccggctgggtttcggtgactttaagttcaacgctgcctggcagttccaagccgatgacttcatcgccgtagaattcaatttcaaccggaacgttgggcagcatgaacttcaattcatgctcaatgcttgaagttggcaattcatattgctcgtagctgtcgctgtccatgaagtaggcagtgtcgtcttgcgtatagagataagtcgcctttttacgatccatgatcgcaatttcgactttttcgcttggccgcatggtggtggtaacgttagcgccggaacgaatgtcgtagagcttcatttgcatgacggtgttgcctttgccaggcttgtggtggttggattccagtaccttgatgagcttgccatccttaacaaagaccatcccagatttcaaatcaattgcttcagtcatattttgtgttctccttcattcgcattacgccgcaacggcgcgtttcgtgtttagtataccatagtgaacgatagcgctatctttttaatcaaagacaaaagcacaagctgagccataatttcatctagaccttgtgatctgtcaaatatcgaataaattggaaaaacaatctggactaaaaaggggcttgccgtgccaaactccgcaatctccggccagctggaactgatgtttttttgcacggctgagccccatctggtctacgattgctccgccttagcactagggtcttcaaatatcagaagggggtgtatcacaaaacgcttgtttggtagacataatgccaaattaaaaagcccgtttcttctccatcgagtcaccacaacagaatagagaaaaacggacttccgaaacactcgacatgatattgacaactcaccaagaacaactgctcactaataagctagagctgagaaacttcggcaatcacttgtcaaagtcagatcacagatttctgaaacatctcattttgtcatcacattgacagaagatgtacctatcttggctccaatcctacgacagaatgcagagagctggcggagcggggatggggctcagccgtgaaattggtcttggtggcgtggttttctccgcctagaccaaggccgatcttcaagaccgcggttttggcgggctcgaagtcgtgcccacagctctagcttcgcggtcgccatcccccatccccgcgtagccagctcggaccatcaattaaaacttaacccagaatagaactaaacaactaaaaatctcaaactacatatcctccacaaccaagtaagtcatgtccaacgggccgtggaccccgacaacgagggtcatttcgatgtcgccagagttggatggaccggtgatgaagttgatgttgctggtttggagcttgccggctttaatgtcagcatcgtaatgatccatggcttggcgagaacgtggcaggatgttgctctttttgataatagccaagtaatgggttggcaggaagtggaagccacggccttggccaggggtggtggcaacggtaatcgtgcctgattcagccagcaaataatccgcaaagccgatggcaacgtccgcagcagccgcttgcttcaaattgaagtcgcggcctttgcctggcgtccagtacatcggcttaggactgacgttgttggtccattcggtcaagccaaaatccgcgtacttgtcagtggttggcaaaatcattgttttaggcgcatcttgctcaatgtaagcattcaaggcagccgccaaatcagctttggtggtgattttaaacgtgacatgcaccccttcgctatttttcttagcgatggtttctagctcatcttgagagtggccagacaaggttgtttctggcagatcattgagcggctcaaatggatgatctttgagctggtgccgcggtcggccggctttttcagcgatggcgttcaaaaaatcttcccgattcgtgtgatcactcatgtttttgcgcctccaatgctgccttgtgctccttgaaccagtgacggaagttctcgttcttcttcggtggccgtggcaggtcacgcacatcggtccagccgcgtgcgagtttcggcaacatcttagtttgtttgatgcgaccactattgtactcattttccacgctgccttgatccttcgtagccaaaacgcccatcatggcatgatccatatcaagcgccatgttgaataaaaccggagcgctagtgccaacgccaaccattttcatgatcttgtcgttgaagctgtgatccatcttgagcttatccatcatgacttcacgatgcttgatcaacaattcgtgaagcggaatgcgaacgggacaggtttcggtacaggctgcgcagagacttgaagcaaatggcaaatcaccgaacttttcataaccgtctaaaactggtgaaagcaccgcgccgattggtcctgggtagattgagccgtagccatgaccaccgatatgccgataaaccgggcagacattgagacacgcgccacagcgaatgcattgcaagactggctcgaatggcgtgccaagggcgttactgcggccattatcgacaatgaccacatgaaaatcttctggtccgtctgcttcgccgtcaacttgtttgccagagaaggaacaatagctggtcagtttctgacccacagctgaccgagacaacatgttatccagtgtttctgcttccttcaaacttgggacaatccgttccatccccatcacgaccacctgtgtcttaggaatcgccatggtcagatcggcattgccttcattagtgaccaaattgatcaacccggagtcggcaatcgcaaaattgcaccccgtaataccgaaatcagcctgtaagaaatagcgccgcaagtattcacgcgcgaatctggctaaatgttctggatcgttgtcaccttcgtaacccagtttatcgaaaatggttttgacctgatcgcggtttttcgccaatgccgggaaaacgatgtgggttggttctgcccaatcgtcttcttgcaaaataaactcagccaaatcagtttccatcagctgggtgccaggaatcttcaacaaatctttgtccaaattgatttcggtggtgaccatcgacttggacttcacaatcttcttggcctgcttcttcttggcaaggttcgtgatgtaagccgcggcttctttgtccgttttggcaaagtaaacatgcccgccgcgtttttcaacgttatcgctaaattcttctaaataatccggtaagtatttgatcacatgctggcggatctgttcgccaagatcgcgccattgcggccagttgccaagttcgtgacgtgacgcctcgcgtttatcccactgggcgtcttgtgctttggcaacactcgcctgcatgaacttgtcctgttcggattctttcacccgctccaagaatggtttatcactggtaacgatactcataggcgcacctcctgttctaccggcagtggatcatggaacttgatccgtttcgggtcaacattgtggttgagcacttcagcaatgtgcatgatcttaattttttcctgacggcgagagaaacgaccggaaatattcatcaagcaggcaggatcagccgaaatcaggactttggccccagtactcagcacatcgtcgactttttcatccaccatctgcttggaaatctccggctctttagcggaaaacatgccgccgaagccgcagcagttttcgatatgtgggagtggttccatttgcagatccttcacatgatcaagcaaaacgaacggtgctgtccgctcacccaacaaccgggtcatgtggcaagagcgatgataggtagctttggcatcgagttcagcgcctgcatcaatcacattcaaaacccgatacagaaactgggagaattcaaatgttttgtcggcgacttccttcgccttttcagcatattccggatcatctttaagtaaaacgcggtattcgcgcagcatatttacgcaagaaccagctggcccgacgatgtaatcggcgtcaactgacagcaacgcatcgatctcattacgaaagaccttctgcgtagctttcacgtaacctgaattatatgtcggttggccgcaacaaatctgcttaaccggcatgaaggtttcacagccaaagtgttccaatacttcaaccattgctgccccaacgttcgggaagaaaagatctacgatacaggtggagaaaatgacaactttcatggcacacctcctatattaaaacgattccaatttaaatatacacctccaaacatgattacggtactgaaagcgtttataaaaaataatttacttctttttgaaatcgttatactaaccagcagcgaccagccaatgagttcactttgaaaaagcactgtttatgctagcttttgatactaggtttaagcatattgtttcttaagcacgatgctgcccgtctgaatcacgctgacaacttggcataactgccactagcatccacaattaggctgtcaccaaaaccaacgacatcttgtggctcttttgccgctttattaactaaaaaaatcaactttttaaaacggtctatacccccctctccccttgacttaacgctgtttcgcacggtttcacagccttgattttttaggctaaaaagactatggtaaaggtggatttaggaaatcctaaataataatggaggcgtgtttatgcgtaagcgatatagggcaacgttacaggcgcttaatgatgattgtatcggtcggaaagcacacgggtttgcgaatcttgaagtcacggatgatgatgccctgcaaattcgcatcgagttgtttaatacgccagcagatatgacgcatatggccgttttggaaggttccgttacgaaagcgccagtcgcggttgcgacagccgcgcaagacgtgaaccatgatggtgtcgttgacgaggaagaagcagagaaggtttccggtaaagtgtttgtgccactcgataatgctcctgaaaagctgaatctcatcggtggtaaatatccagaagccgacgacaatggcttttacatttaccagcagcgagttgtcatgtcagacttgcgggaacagttgctcaaacgttacggcacggatgtcttcaatcttgataatgcggtcatgtatgttgacggcgtccaaagcgatgtcctgttgccgaaaacagtgatgagcgatttggacaaagagaaaccttatctcaccttgccgattgccgttggtaagttgcgtaaggtgatgggttgatcattgtcccccaatatgggattcgtgaaaaggttgggctaaacaattctctgtcgtgccaagctatggagtcgtagactttgatctttcaagcctaaaaggcactgtgacgtgggcaaaaattctttgtttcggtaattgcaaattttgtcctgacctgttcactgtttcttgttagctttacaccattcaaaaaagccgatcatcatctgaccggcttttcgtttgtcatttttgtgttgcgcccatgattaaacagttggcgccgttgtcatttctgccatccgctgataaacagtgacaacttcacccgccaaatcgcggaaagtgatggcattcatgagatgatcctgcgcgtgaaccattagcaatgacacctcggcatgatcgccactggcttcggcggtcagcagctctgtttgcgcattatccgctgacactaatgcatcatcagcttcttttaattgcacagttgcttcaggaaagtcaccggctttggcagcttgaatcgcggtgaaagccgcacttttggcattgccgcctgctataatcaagcccatgatcgtctgttcattcacttgcgtcatcgcgttttctcctttgtcatgatcagtttttgttaactcatcggcggtttgtggctctaacttttaacatgctttaacatgaacgtccgccatggtttcagcaacggcaacaagtcgagatctgagtcagttaattgaccaattttattgcgtcggccatcatttgccagttcacgcaggacaatttgcagttctccggcatagcgggcatacgcctcattcaccacgacaacatctccacggtgtaacgtaccagttgcgtcatgcgccggaatcgcctgtcctgcatagcgaacgcgcggttgggtgtcgcgaaccagataatctgaggcgtcaccacgatataaatgcgcctcactgaatgcaatcttggtttccaattcagaaatggccgccgttggatgcacgcgcaatgccggatacggacagaagaaggccagtgccgcggcgtgcaaatcagcctcgctcgccatcgcattgccgattaacacatcgtcaatcacctcggtcaatcgcaaatggtgcacctgactagcaattgcccgatcacgatcactttccagtgtcggcaagccttcgctgatcggccacggcccatgatcagcacttggcgcagtcacaaatgccgcggtgcgaatgccataatgtcgaaacttctgcgagtaggccacaaaccgctcatcacccaaaccagtatattgctgcgggtaaaaattatggcagcctaacaagttatctagacgtggtccaaacggcatgatggcatcaacataattcgtgccagcactcatattgatcttaattttcaagccatactggttatgcgtcatcaacgcctcttcttgtccagtaaatccctcgtcaagccgcaagcccagacgcccagttcgtgaaagaaactcagatcatggtagattgtaaaattaatccgaacgctgttcggacaaaaaagatcagcttatcaggttatgctgacaaatttgtccaaaaattcggattaaatttgcaatctaccctaaccattaaattcgaaacctctgttccaataaatttaatatgaacctcataatgtaaattaaaaaaatatatcgcaatgttcttgcttgcagtatgtctcgctcttatctgaataagatgacattcaatcttatcaacaatataactaatataacaaaagcaaattaaaacattcacgaaacagaatttgaaaataacaccagagaaaaaatattttcaagctactagaaatttcaactatttatcatgatttttttattttttagctcaaaaatgattgacagatgtctcgaaattgtgtatattaatcacaataaaaatttcggaggtgtcatgatgagtcaatcaatgtttaatgcgattaattgttgctgtcgaacaacgcgtttttggcgatgttcggcctgttagcattgacgttttttgggaaatcatgacctaaaaagagttcaatgtccacttggctggagttgaactaagggcgcgaaaattctggatttcagaatttcgcgccctttttctatctattgcaaccatttcccctagcatcccgccagctaaacactgctccaaatgattagaaaggatcttatttatgcttattcattccatttcagaactgatcggtcatacgccactgattgatctgcaaatcaacattccaaatcacagtcacatttacgccaaactggagatgtttaatccaggaggcagcatcaaagaccgcctgggccaatacatgattcaagatgcgattaatcgtggtcaggtaactgaaggtgtaacaacaattatcgaacctactgccggcaataccggaattggggttgcccttgccgctcaacaacaccatttgtcaaccattctggtcgtaccggaaaagttcagttttgaaaaacaacaattgatgaaagccttaggggcaaaattaatcaacacccccagtgatcagggcatcaagggcgccattgaaaaagcagaagcgcttcacgatcaaactcctaacagtttcgttccaatgcaattcaaaaatccggccaaccctgatacttattatcacactctggcaccagagttgcttgacgacctcaatgacccaattgacgcctttgttgccggtgcgggcagtggtgggacatttgcaggcgtcgctcgttacttaaaggagcagaatccggcgactcaaaccatcgttgtggaacctgaaggctcaattctaaatggtgggcctgcccatccccatcggactgaaggcatcggtgttgaatttgtcccaccattttttaaagatgttcaaatcgacaaaacgttaacaattgccgatgccgacgcctttcatcaagttaaggagcttgccaagaagcagggattattcattggcagttcaagcggggctgctttggctgccagcttaaaggttgccaaggcacttcccgagaatagtaccattgtcacaatttttccagatagcagtgaacgttacatgagtgaaaatatttatgattaaaaataaagtgaggttattaaaatggaatttgatacaaaattaattcatggtggtattagcgaagataaagcaaccggagcagtttcggtgccgatttatatggcatcaacttttcatcagcaaaaaatcggtgaaaatcaatatgagtattctcgttctggaaacccaactcgagaagcagttgaaaaactaattgccgagttggaaggcggcacagccgggtttgcatttgcttccggttcagctgcaatcgacacagtcttctcaatgttctccgccggcgaccatttcgtcattggcaatgatgtctacggtggtaccttccgattgattgacgccgttttaaaacgctttggcatgacctttaccgtggttgacacccgcgacctggccgctgttgaagaagcgattacgccaaataccaaagcaatttacttggaaacgccaaccaacccgcttttacgagtaaccgatattgcagcggttgccaagattgccaaatcgcaccaaattttaagcattatcgacaacactttctcctcgccttacgttcagcgaccgctggaacagggagtggatattgttcttcacagtgcttccaagtatcttggtggtcacagcgacgtcattgccgggctggtcgtcactaaagatgatcaattggccgaaaaaattggttaccttcaaaatgccattggtggtattttggcccctcaggaaagttggctattgcaacgtgggattaaaacgttgtctcttcgaatgcgtgctcatttggccaatgccgaagccgtcttcaattatctatcaaaccagccacttgtcagcaaaatttactaccctggcgatccgaacaaccctgattacgaagtcgccaaaaaacaaatgcacggctttggcgcaatgatttcctttgaattacaggacggactggatccaaaacaatttgttgaacaactgcacgttatcacattggccgagagtttgggtgcactggaaagcttgatcgaaattccggccttgatgacccacggctcaattccacgtgacattcggttgaaaaacggcatcaaagacgagttaattcgcctttcagtcggcgttgaagatcaaaaggatttgttagccgatttggaacgcggcttcaatgagcttaagaggagcaagaaaaatgtttcagacagcaaggtccattctcaagcgtgatccggcagcccacagtcttttagaagttctcttaacctacccggggattcgggccctgttttggtaccgaatcgctcactttatggcttttcatcgactttatacaattgccgggttcctaagtcaacatgccgccaaagtaaccgggatttcaatttcgccggaagccaaaatcggtaagcgcgtttttatcgatcacgggattggcgttgtgatcggtgccactgccgtgattgaagatgacgtcactatcctgcatggcgtgacgctgggtgccaggagggccgttgaaggtcggcgacatccctatgtaaaaaagggtgcattcattggtgccaacgcccaattgcttggcaccattacgatcggcgcctttagtaaagttggcgcaggggcaattgtcctgaataacgtggccgataaaaccacagtggtcggcaaccctgcccgaaccgttaacaagttacccgctaaagtcattaacgtgaccttcacgacaaacacgtcaaccactaaaaattaataacttacgaaaaacaccttgatgaaaagagttgccagttggcaaaaatatcatcaaggtgtttttcgtatttagtggctggtgaaagcagcataactgcaagctttattggcatcaaagaatagtatcaggttatgctgacaaatttgtccaaaaattcggattaaatttgcaatctaccgaacaatatcgaaaccatcatcattggcggtaaaatggccccacgatcagcttcgacccttggctcaacgaccatcgaggaaatccagagtttccatccggactttgcgctgctttcgaccggttccatcgatgcaggcggcatttatgttgccgatccagagcaagcagcagtcaaagaagccatgattgccaatgccaaatgtgtcatcttcggcattgactcgactaagtttgatcaaagcgactacattcgtattacgaacatgaatcaaattgatgaaatcatcacagataaaaagccaaatgccgcctatcaaaatctatttgaaaaaaatcatattctgctgacctatccgcatgagtatcgccaaacacctaaaaattgatttgctcatcaccataattaaaatcattttttccccagttcaaagctaagtcactcaagctgactattccaaatttcagtgcttagaaaccacgatcgcgtacaaaaaaaggcggttcaaaacgctcccaatcgcaccagtacgcgtgattgatgagacccacgctccgggaaaataagttaactaaaagactcatttagtcgcagtatttaaaaagaacctgcccgagcaatttttactcaggtaggttctttgtcatatttgctttctagccaccagcgaaaacgtcaacggaatttgtggcagatcagccggcatctgccaaccatcctcttcctgattgaacgtcagcatcggcaatgcctgccaatcggtgatgcgctgctcccccagtgcttcaatcgttaaaccagccttcagtagcacactcgttatttcttgaaaatcatgtgcccagttgtggttgcgggtgtgttggattagcccttttgatcccgccgtgtacgaaccatctgaatcgtaagagatctcggccccgctgaaataattttgcgtgatggtaagcccgtcattatccagtgcgaacaaaagtgggtgattgtcacgtatcatgaaaatcccgcctggtgcaagtaatgccgcgattgaattagcccaatcttgcaaatctggcagccaagtaatggtacccgcactagtcacgatcacgtcaaacccctgagcttcattagccagcgcctttgcggcgtaacgcgcatcactttggacataagtaatatccgcgccggcctgcttggcaatgtcacgggcgtaatgtaatgaattcggcgaaaaatcaatgccatgaacatggactgctcctaggcgccaccagctcaaagtgtcggtgccaatgtggctttgcagatgcaacagtcgctgacccttaaccgaatttgctggcaagtgcggcaagagtacttctaaatcgcgtttaactgtgccagtcacaccgtttggattgttaataaagccagcaatgtcaccataaccgccaccggcatggatgttagcgcggtcatcccaattgctgagattgtcttgaatatcgtgatttgttggcataaagttctcctttttgaggatgcaatttaaagtccgtatggtccttgtcatgatgggaatacctcagtggctgcggcttgttagtattaaaaatatctcatttgaagatgtgatgcaaaatatcaaccatttgtgggctatttttttagctgcttgtcgctttaatgccaccctatcagcaaaaaaccaactaattttgaagattacgaaccaagttcatttaaatatcgcgtgccacgtaatcgtgaattcacgctaccgactgacgcacaataacttgaaattaataattgtttatgattacatttttacgtcattttcacttgggtaatggttatgaacctttatactgaaattgacgtcaaaaacgagcgcgcgtgaactggtgcagttagaaaccggcgtataagcagacttgggcgtgatggctgcttcttcatcattgcgaccaaaggcccttacgtgatggtttctgcgccagtgaacgcatttaaggaggcattcatatgcacaaaagctggtggcaagaagctgttgtttatcaagtgtacccacgcagttttcaagacagtaacaatgatggcattggtgatctaaccggggttgtcgagcacctagattacatcaaacagcttggtgttgatgttatttggctcaacccaatttataaatcacctaatgccgataacggctatgacattgctgattacgaaaaaattatggcggagtttggcacgatggcagacttcaagcatttgctaaacgaagcacatgcacgtggcttgaaagtcatgatggatttagtggttaatcatacttctgatgagcatccgtggtttcaggctgccaagcaaagtcgcaccgatcctcaccatgactggtatatttggcgcgatccagttgacggtcatgaaccgaccaactggcgggctgatttcggtggctctgcgtggacctatgtgccagaagtcggtcaatactacctgcatctttttgcgcccaagcaaccagatctcaattggacgaatcctgcagtacggaaagccgtgttcgacatgatgacatggtggtgcgagcaaggtatcgatggtttccgaatggacgtgatcaacctgatctcgaaacccgagcaatttactgatgatccttacatcgttgaacatcctaatggcagttcattgggattcattgcaaatggcccgcatgttcatgaatacctccgggaaatgaatcaaacagtgttgtcaaaatacgatctcatcacggttggtgaggcacccggtgtcacacctgttttggcagagaaatataccggctttgatcggcacgaactagagatggttttccagtttaagcatatgggtctggacgatgatccacagtttgagaaatggtccttgcatcggccaaagttgaccgatcttaagcgcgtgctttccgaatggcaaaccgacctgcacggaaaagcttggaatagtttgtattgggacaatcatgaccaaccacgagccgtctcgcgttttggtgatgatcgtccagccttccgagttcgctcagcgaaaatgctcgccgcaaccttgcacatgatggaagggacgccctacatctaccaaggcgaagagctggggatgaccaatttcgatttttcctccattcacgattaccgtgaccttgatactttaaatgcctggcacgagctcgttgatcaacagcatgcactgacctctgaagacatgctgaaacggattcatcggcgctcgcgtgacaacgcccgcacaccaatgcaatgggatgccacgcaacatgcgggtttcacaaaaagtaccccttggatcaaggtcaatccaaactatcagaccatcaatgcagcggctgcattggcagatcctgattcagtctttttcttctatcaaaagctcaatcagctgcgcaagcaatacccagctctcattgtctatggtgattgtgagttattggatccagacgactcagatgtctttatgtatcggcgttttaccgatgatcaagagttgctcgttatcaacaacttcaccgatcaggaacaatcccgcccaattagcacgcgcttgcctaaaaacgcacggctaatgatcagtaattatgctgacgatcgtggtgacgttttgcggccttatgaaacacgcagctatcttggcgaacggcgttaaagaaccaatattcaatatctgtgacaaaaactaaagcgtcattttaacgcaaaagtataacgatggttcggattagaactctctgcaccacctaaccttaagtgacaaggccaatcgcttcaggtcaccacattggcctttatgagcggtcaaattttcaccttgtatgaataacacaatgaacatttcaacgtcacaatttcgtcacacctagtctgtagtattagcaatatagaaatgagccacccactcattcctacaaaccccaacccaactttttcattttatcataagggaatccgaagccgttttaaatgtacctcacaatcgtgcgcttacaaatgaatgacttcaggattttcttgcaaagtaagtgtacgatttttgaggcactttacatcccaaaaaaacgcaaaaaaacagagatccaagttcctacaggtgaacttggatctcctaagttaaggatttgaccgatgcaataatctcaaaacttttcttggtactaattgtaaaaccttcttcgataaccttaatactgcgacaccttctaaaaaatacttattcacttgtacggaacgacgagtgttgaaatgatgttgccctataactaggcgttgtttggtggtcctattgacacaccctattgaacatctatgggaagctcattgccccgcttggattactgagtctttttattagcctcgtacctccatgtgtgttcatctttggtcagttggaacatgaatcgtacgactggtggcgcagatacttactgcaccaacgctctatttgtctattcgtgctttgcgacacacacatcactttcgagctggttcgtcttggtaatgctagacaaggatcgtaatgctcggttcctgcatcgacctttttggttcttccttaacttcaattaaagtgtatcatgtaagcgctaactttgcaagctaatcacgtcatttatttaaaaaaatcgtaccatccgcgatcaatactgaaaacgccgaacacggctcgcagcaccgtagccatacaagctaagcagccgctgttgtgtatccacactcaccacataaccggcatattcgctcggcaaaccaaaacgtcgatcataccggcgattgaacttggttgttagaccgtgatgacggcccatcaacgcgcttgtattctgcaggctgtaatgaatgccattaacaatgtaatctgcttctaaatgatagtgaccagctaaataaccaaccactcggccgcttgactgcctaaagtcaaaccgcagacgaccgccaaacgctggtgcctcgccagtatgcaacaccccgctcgcgtggaagttaaaggctcgcaataactcatggacagcgcggccattaaatttcagtgccggctggccattttccttcaaagccggggcatggctcaacaacaagacatctcgcttaccaacaccttttaatgccaatgcaaaattccgtagctgagcgaatgagaccgcaagtgttttcttgacatcaaaagccttgtgaccatcaatcaaagggacatctgccgtattcaaaacaatgatccgcaagttaggaaagtcttgaaccattagcccttcttgcgaaacagccacccctgtctgctcagcatttggtttaaaaatcagcgtctggttcacttctggcaaaaaactgccgcgatgccctgcacgcttttcggcaaacttgtcattatcgtcatgattgccttttgtcacaagaaacgggacagaaccgctttgataatcagccatgatgttccgtaatcgcagtcgagtcagccatggtgcctcggacccatccaccaagtcgccaagatggacccggagtgccagtggtaattggccacttaaccattgctgttcgcgtacatgccagtaaccagtaggtccataataagtggtggcaaattttgccttatcgtgggtatccgtgatcaacgcaaagtttacggctgaaggcgacagcaatggcgagattgcagaaacaaatctggtcagatcttttttgacaaatggtcgaattgcaatgctcatgaaaacctccatcgtgatattcgggtcagatattcaagaagacgcctaatgcgagaaagacaacctgggccaacgtcgtgataaaaagattcttgatggcattcggaaaagtcagttttttaaccggattggctgcaaaaccgcgtgcgttcttcaccaccatgggtacggtgatcagtgtcaacaaggttaatttcggcagtaaccccagcgcaacagcagcaatcagcatcaaaaacccaactgtatataatccatagaagaagatgatgctgcgagaacggccaagataatgcacaatcgttcggcgcttgagcgtttcgtcctcttcttgatcggcaatattattggccagcaacaaggccgcaatcgtacactgtgccaatccgctggcaagataaaccgatccgatcaacggccatgagaaggcggcaacattaaagacgttgacataaacggcaattaggaaaatcacgaaacccatcgtaaatcctgagaaaaattccccatacggcgtggccgaaattggtcgcggaccgccagcataaccatagccgactgcaaagctaaacaatcccatcaccagcaagggccaccccgtgcggctcaccatccagaggcccaacacaccgctggttaccatcataccgacaaccatccacccaatcatgctcgggttgagatgatgaaccccaataatgttagtcttctcgcgaaaacgcaacgctgctgtgcgctctgatcgtttgtaatcttgataattatcgttcgcgtcaaccgccatgttaaacagcaacatggccacgaagaaaaccagtaattcagggatatgtaacgtatgataatgataccaggcaaacaatgtgcctaataaaaacggaaaaactgaagccgttttggccttgatctcaaccaactcaagaaaaacagataaagacatgacaacctccaacaattgacttttaagaatcacatacagtagagtgaatatgtctataggaaagagagaaaatgcatgattcatccactgtggcaccgattccccatggtctatcaacaactcgaacagattcagcaacggcttgaacacgtcgctattttgcgtgagccgcaagtccacgcattgatccagcaacagatcaacgctggcggcaaaatgctgcgcagcgggctaatgcttatgctagcgcgtttaggcaaccctgacaacgacgatctcataaccgccggcgctgcgattgaggccttacatctcgcgaccttggttcacgatgatgtacttgaccacgccgacctgcgccgcggttccgataccgtctcagctaaatcaggcaatcgtgaggcaatctatgctggcgatttcctctttgccatctattttcaattattaagcgaacaaaatccagcaacaaccgatttagcgaccaatgcgcgcgtcatgaagcacatctttatgggagaagttgaccaaaatggtcccagcgcgccactcattccaagtgtttccgaatacttgaaagccatcgccggcaaaacggcagcactttttgctttggcaacttacactggtgcgacgatcggccaactagactttactgaaaaaaaagccgcatatcgttttggccgccaactaggcatggcctttcagatgattgatgacttgttggattacacccaaacaactgctacgctgaataaaccggtgctcgaagatttacataatggcattgtcacacttccgttaatttatgcctatcaaaacgtccccgaacaactcgccccactggtcgggaccgcagcaaaaatcgctgccaacagcgacctaattgcggcaattgtcagtgaacacggcttgccccaagcccgtcaactcgccacttgctacactgataaggctatcaacgccctcgcgccattgcctgatgcgcgcattaagcaagaactacgcaagctcactcagcaattattgcgacgagatcattgatcgtctggacttcatatatgcctatcctttttgatagaaaagtaagtaccggcggataaagttcagctaacaatagaaccagcaaatctagactcagtcggctttctttgtgatcttcctaacgaaaaattaagtattaaatagcccgccacacttgttacatccggtttctgcatcataccaactttttaaaaattgaaattgtaatatttcagcccgacgttttcacaaacattgggctttttcagtggtatgatgtatgtaaagcaaaagtgaaagagtgatcaaacatggcaaaagttctctccatcaacgctggcagctcctcactcaaatggaagctgttcgatatgccaagtgagcgccagcttgcagaaggcgcgactgacatcctgaaacaatcaaccgtcaagatcaagtatggtactgatcaagcttacgaaagcgctaccccaatttgcaattatcgtgacgctgttgccaacctgctctctaacctgcaaacactcggactcgttcaaaatttggatgaaattaccggcattggccatcgcgtggtagctggcggggaattattttccgccccaattgtcattgatgatcgtgttctggcgcagattcgtgctctgcgtgattatgctccgctccacaatccggttgaagccgactgtatcgccatttttcgcaaaatgatgccttgggcacttgaagtcgcagtatttgataccgcatttcatcaaaccatgaaaccagtcaattatctttacagtattccgtatgagtattatcaaaagtatggtgtccgtaaatacggtgcgcatggaaccagcgttcgctatgtgagtgctcacgccgccaaaatgcttcgcaaaccattggcacaaatgcgaatgattgtgatgcatcttggggcgggttcaagcatcacggccatccaaaacgggcaatcggttgacacatcgatgggctttacccctttgtccggtgtcacgatgggcacgcgttcaggcgatgttgatgtgtcactcatcggctatctgatgaagaaacttgccatcaccgatgtcgatcaaatgattgatatcttaaacacagagtcaggcttacgcgggatctccggcattagtcatgatgttcgcgaccttgaagccgctgcgccgactaacccgcgagccaaactggcgcttgatatctttgtgaaccgcattgttaaatatgtcggtgcttatgccgccttgatggacggtgtcgatgtcctagtcttcacagctggcatcggcgaacacagcagtgacattcgggcacgcgtcatgcaatctttagattatctcggcgcgcggattgatgcgagcttaaacactcaaatccacgataacgcaggtgacattactgcagctgattcaaaggtcaaaacactggtcatccccacaaatgaagaattgatgatcgtccgcgacgtcatgtccttaagccaagcagtggcgcaagcggaatagtggtaggcgttcgctagcccagaaacagaactggcgaacgcgctacgatcgagcatgagcaagcccggttagaaatcgacgcgttataggcttccctgctggcgccaacagcaggaacaggtgagaacatcattcacagtcgtcaaataaagcgaacagtttctctgcacaagggaaactgttcgtttttttatcatggataatttttattgggatttaaagatcccagtgccaaggcggagcaatcggagttggctccgcggcgattcggggtggcgaccgcgaagctagagtggtgggcacagctttgaacccgcaaaatgcgcggtttcaaagtctggccttggtctaagcggagaaaaccactccgctaagaccaatctcaccactgagcccatcaccgctccgccaactctctgttttctaccggaaagcaaaaagcagaaagaccattatcatttatgattcaattatttaaacctacattattcgggaattcccgtacaaacagcttcaaacctttttatgctcaaatcctaaaaccaagcctctcccggattcggtagcatgcctgtcattgctgcaatgagcaggagcacactgccaacaacgagtaaaccttgcagtgcgatttttaaccataaccgttgatgaatgatctcatctggtgtccagtagagatcggtggcgctttgaacaccagttgttttatttgccgccagcaaggcatcacggagccacttggctagccatgaccaagcaacacctgcaatcatggcagccacggccagcacccatagtgcatgatcacgttcagttaaatagtcagtcggaaagacgtagaagttgccgatgatgggtaattgaccaaattcgctataaaactgattgccaatggcatatgcaagcgccaagccaccaacaatactgcttatcagtcccaatcgccgcacccattttgcaattgtattctcacggtacaaattacgaatgtaagtcttgcgtccgctgcgcacctggttcggaaacatcatcttgtgtgttgctaattgcatcgtcacgattttccgttccaactgcagtgcccaaattcctgtccctaccaacgccaacacaaccacaatgattaatccagcaaacatagcagccagcccttctgtttttttttgagttttcttattctatcagttaggtttcatgttgaccactttggggcacatactcgatatggcagattgccaacaattaaaaaccccagacaagccgaccatcgtaaaaacattcagaaggtcaatctgtctggggctatttttaatgtaaaaatacgatctatgactggcttgttcaaagcgctgcttttatagcaaatcaatcaaaggtggggacgaattcgctcaatggcttttaacgttccataagacagtgccgtttggattggcaacatgaccacgttcttgatcgttcgcggccagataataccttgccatggcgtacccatgatgtttaaccatagtgttgtcaaaatgatattgctaatcaacaaaaccatgccgacagcgagcaatgtccgaagaaccgttaccttcttaccgtggaaaaacataccgtaaagcattgccgcaatggctgcactgatggtaaaacccgggaagttggctcccggactgaagatcataattgacaactgatcgttcagcgcagcagcgccggccgccaaccatgggccaaaataatatcccatgaggatcgtggcaaagaacgctgggctaatcttgagccaaggggttccgaacgagaaacggcccagaacgatttgcatcgccatcaacatggccatatacaccatgttccgggtggaaagcttgggactactaaacgataatacttgcataagctgcaatctccttttttcggagacgcctaaatatcaggcgaatgcggcacctgcaccgcgacacttgtcttcgtctgccgttcacattccgttccggcagcacttaacgcgcaggttcctactcctagattttgtcacgagacatatcgtacaccgaaagttgtggaaagggaacccccgaaatgttcgcattcacattttttgtgatcacaggtgaaaattgacgtgaaaaatatctcacgattttctcggtattttcttggtttttaccaagttagctgccagattgattcgctaaaatagattctcgtaatcatatctttctggttgctcatactccctgaaaagggattccctcaacacttcattttagaagtgtttttttacacctaattatgggtactttagctgttcgcggctgcataaagagccgtataatgaaatgcgacaacgtttgaaaggaagatatgaccgtgactaaacatattctcgttttgcatacgggtggtaccatttcgatgactgaaaatagcgaaggtgacattatgcccagccaacataacccgttacttggtgctgacagttttgtccctgctgacgtcgaactcaccactgaagaaattttcaacctcccatccccgcacatgaccccagaacggatgctagaactagttaaacgcatccgccaagcggaaaaagaaggcagcgatggcgtcgtgatcactcacgggacggatacgctggaagaaaccgcctattttcttgatctgacccttgattcggcgatgccagtggtcgtgacaggcgctatgcgctctagtaacgaaatcggcagcgatggtctggagaaccttcaaagcgccattaaaacggctgccagcgacgactcacgcaataagggaacgctcgttgtcatgaatgacgaaattcataccgctcggttcgtgaccaagacgcacacgaccaatgtggctactttccgaacaccaacattcggtccagtcggtttggtcaccaaagatggcgtccgattctttcaagaactgattaatcaagaaatctgtgcgattgatcacctcgtcgacaaggtcttcctcatcaaagcatatgctggcatggatggtaccttgttcgatgcactgcctgaagatacccacggcttgacgattgaagcgctcggtgccggcaatctaccgccgagcaccttacctgccattcaacggctgctggatcgcaacatcccgattgttctcgtttcccgctgttttaatggtgttgcgcaagccgtttacaattacgaaggcggtggtgtgcaacttaagaaaatgggcatcattttctgtcaaggcttgaatggccaaaaggcacgaatcaagttgcaagtcggcctcagtgacggcaaacaggggcaggatctagccgacttcgtggataatgctgttagctgacaattaacaaatagctgggactatcctcgatttcgaagaccgcaacgcaaaaacggcactaagcaaaaaagagacttttgcttagtgccgttttactatgctttaaaatcctgccaaatcatctgcgcttctgcgttgacctgttcgccggttacgacgcggtgcaaagttttggtgggatcatccggatcatgctgatattgggcaacaggcgtcgtgccatacgcgacttcacgttcataccgaatatccgccccgcgtaacgtatgggtactcaaaaaatcatagccaagactattttccatccattccaagtaatgagcattgttgacgtgtccgttactgtcaatatcaaaatagcggacatgaaaatcttcttgaccatctggggtggtgatctttttaagccgcggaaatcgcttgattttgcgatcactgaccgcgccgacacgctccaccagttccggaatcacgtccacaattttgcgggtgcgcagatccatgatgacccagttgctattcactgttaccaagcgctgcccttgcgcatcgtcaatccaataatcccggtaagtaaagaatttattgtaagtcgtcgcctcggtccccacgcgcaatggttcctcaattcgcggcatccgctgaatatccatatgatactgcgtgatcacccaaccagcctgaaattcattaattgcatccatcccggcatgcaacgtctctaactggcgctccgaaatttctaacatgacattcatcatatttgccaatccggcgcgaccataccgatcacccgcaaaaccgggaatccggtaatcatcttcgtagacctttcccattaggatgactcctccttaaatcacacttgctggcacagaatccggttggcttcgcataagcctgtttctaaacacaccagatctcacgctttgcttatttttccaactcatgataagcatcatacaccacttgcttcgctaagccattttgtttggcgactaatttaatcgctgcatttggtttggcaccagtggccacaattgcctcaacttgcatttttaaaggcaccgtcacatcaactgctggcttatcagccgcaccttctaccataatcacaaactcgccttttaggtcaccagcggcataagtttgtaatgccgacaatgaaccgcgaatgaaggtttcgaattttttcgtcaactcacgggccaaagccgcctgtcgatcaccaaaagcagtctgcattgctgccagcgttttgccaacccgatgtgggctttcataaaaaagcaaggtggctgattcatgggctaacttctccaattcgcgatttttctccccaactttacgcggtaaaaagccgtagaacaaaaacggctgcggcggcaagccggaagcaatcagcgcagttgtcgcggcgttggctcctggcaatggcaccactggcacaccggcatcaatggctgcgcgtaccaattccttgcctggatcagaaatcgacggcataccggcatcgctgacttgagcaattgtctcgccgtttgccaacttagccaacagctcaggaatgcgcatctgtgtgttatgttcatgaaacgaaatcgttttagttttaatctcaaaatgatttagtaacatttgcgtgtgccgcgtgtcttctgctgcaatcaaatcgactgttttcagaatttcaatcgcacgaattgtcatatcgcccaagttgccaatcggcgttggcaccagataaagtgtgcctgttgtatgtgaaccgaagcttcgttgttgctccaagtcaattctccccgtaaataatctcagtacaaaaagcgcatggctcatcattgacccggcgctggccatagaacatcgggcaaacatggaagccttcattatacagactttcaagattttgcttcgacttagacaattcaaccccaccatcactggttttattgtcatctttttctaattctgccaaatgttgacgcaaatgcttgttttcgatctcaagttcagcattgcgttcaagcgtttctgccatatcgtccttcatagcggcgatttctctgagcatctgctgggcatgtttttcaagggtcaagaagccatcatataattctttcttttccacaagatcacccttctaatagtttaagcattaactgttctgttgcggattgaaacgtaacattctggctcaatcgcacctgcgccgttaaaatagcctgcagcgccgtggttagttgctcacttgatcgctgagccaagacgccgatcgccggcaagtccagttgttgcattgatgttacctgaaaatgttgattcaatgcatcagcataggccaagccgatcagcgccaacacttgacgctgactatcagcatctttagcaatcggcagcagttgcgtctgcacccgaacaaaactttccggatcgtgatccgccaaacgctccagtaactggaaaaccttcgtcacccggtcttgaaatgttgcagacgccaacaaggcctgcgcatcagccacattgccagtcaatcggcctgcgactcgtgccatttgcgaggttgccccgccttcttctagctttgcaatcacggctgagcgatcagggctttggaatgtaataacctgtgcccgcgacaaaatggtcggtaaaagttggtttttcgaggttgcagtcaaaatcacggtcatcccaggcactggttcctcaaaaaatttcaataaggagtttgccgcacctgctgtcattttatcagcatcttcaacaacaaacacacgttgattgccttcgaccccggttttgctcatttcttgcttcaacccgcgaatatcgtcaaccttgatgctttgcgtttctgttttgaccaccatcacatctgggtggttatgattcaaaattcgctcgcactcaggacactggccacatggcgcaccatcctgcacattttgacaaaataggcgcatggcgatccactcagccaaggccagcttgccagccccttttggccccacaaacaaatacgactgtgccaattgcttgcggtcaatgattcgcgcaaactgagccacgagtttaggctgaagcgaatcaattaaaaacttggtcatcagaagcgatgaaaggcttcgatcggtaggacaaagacggtggcaccgccgacttgaacctcaaccggataggccatcgaactgtcagacgtggcgtcaagattgactggcggtgtcatgaattgttggcgggtttgggaagtctctttgataatcttcagaacttcatcgacccgatcgtcagcaatcccgataatgaaggttgtattaccggcttttaaaaagccaccagtcgttgataatttagttgcctggatattagcatcaataaattgactgctaagcaagttgctatctttatcttgaacaattgcgagaattaatttcatgcgtgccctccttgaccgcgatgacggttatcacttagttaaatagttccggaaaacgacgagtaatggtctgaaaacaagcggcaacaaccttttccagtggctcagttgcatcaatcgacacgattcgctgaggattatccactatcagtgtcatgtatgcatcatgaacgcgttcatgaaaagccagactttcctgatcaagtcgatcatattgacgctcgttttgatgggacttgatacggtcaagtcccacctgaactggcacatctagatacaatgtcaaagccggctccagtcctgcagtggcaaattggttcattttcaaaacggcatccggcccaatttctcgaccaccaccttgataggcaactgaactgtcgacaaatcgatcacagacaacaatgtcgccttgtgctaacgctggttgaatcacttcaaccaagtgctgtcgacgcgacgccgcgtataaaagtgcttcagtccgcgcatccatagcagtgttggcagggtcgagaatgacctcgcgaatggtctcggaaatctttgcgccgcctggttctctggtcaaatgcaatggcacccgcacgtgctgttcgagttgcgggatcaacgtcttcaaaacgctggtcttgcctgcaccgtctggaccttcgaatgtgataaatgtgcctttcaccatgtgtctctccttatctaaaacgcgttcactagtgcaaaaatgttcatacttttttggaattaagtccattttacttgatatgtttcacaattaaaaacttatctgcaaattcacgagactaataagtcgttatacataggcaaaaaagcggcaaatgccatgatcctgaaatagcagtcatgggcatttgccgctttagtgaatgttgattggtatcgggtagctgcacgatgccctaatggtgaatgagttatgcttggcattgaggtttttgcatgcctcctaggaaggcgaaaaaagatgccactcggcgtagcaaatgattggcgcgttgaacgttctcttgttggtacgtggaaaagctctgttaccccttcacgactctctgaaccgcgcaaaaaagcgcagaaacctccgtgtaaggactttgaaccaaaagagccaaaacccagcccttttggttcaaggccacttacattccggtttctaaccgcgcttttttgcgctctataaatctctatactccgcaatttgctccgcagccactcgggccacaagttcgcccttgatttggcgggtgcgcgcttcgcggtagagaaagtcgaacaggcctgtctgtaaggctacttgcgctttggtttgttcgtcgacttcgcgaaaagtagcaacgagcttgcgttgtgccgccatctggtcgcggacacgatagacgagcatcattagttcttcgtctttttcttccttgacctttacctgtttgcgtccaaacattacagctcagtccttccttcaaccgccttcatcaaggtcatttcatcagcatactcaatatcactgccgaccgacagcccatgggctaagcgagtgaccttaataccagctggtttaatcagccgagctaggtattgggcggtggcttcaccttcaggcgtggcattagtggcgataatgacttctttgactgccttatttgccttaagccgttttaacaaactctcaatattcagatcttcaggaccgcggccttcgattggtgataaaacgccatgtaatacatgatacaagccatgataatcctgagcccgatcaatgctcatgacgtctttaggttgttcaacaaccaatatcgtgctttggtcgcgatttttatcgcgacaaatagcacacggatcctcatcggtaatgttgccacaaatggaacaataatgcagatcctcttttgccgcgacaagacttttagcgaacgccgtcacatcgtccttattcatatcaatggtgtaaaaagccagccgtgttgcggtttttgccccgatacccgggaggcgcatataactgtcgatcaatttactgatcggttctggatattgcatagtgtcccctcttgttgtgaaaacgtactgagtgatgatctttgctgtcatgagaacagctttggtttcaaaatgatgcttatttgcttatgttgctgaaactttgggtgcgaacttgggttgttgtaaaagttcggtttatgcggtgaagacttcttgatgatacttgtggtccattgttgttctccgaaacgcgcaaaaaggcgcagaaacctccatgtaagcggccttgaaccaaaagggccaaagcccagcccttttggttcaaggccgcttacactccggtttctaaccgcgcctttttgcgctctgttgttacattggcaatccgcgtgtatacttacccatcttatcttgagtttccttatcaatggttcccatggcttgattaaccgcttcgataatcaggtcttggagcatgtccggatcgtctggatcgatggcttctggtttgatttgaatgtctttcatgatcttttcaccggtaaacttaacggtgaccatatcggaagctgacttgccttcaaactccgttgcatacagttccttttgtgctgcctgcatttccttttgcattttctgcatctgcttcatcatgccttgcatattacccattccacgcatgtttcatcatccttttctagtcatttttgattgttacgttaggtgcatctttaccaaatagttctgttaatttgctaacaactggcggtatctgcggtttagtgtcagctttctgttccttgttttcaggggccttcaattcttgaatataatcttgtcgaatggttggccagacatcactttgaaccaaaacaatttttggctgcttgccggttaatttttgtagaccactttccaattccgtcatcagtgcggcatcattcatggcgcgttcaacgtagatatcataatcgaaactcacgatcacaccgttaggactggcagcaaccggttcactgactttcatcatggcgcgtttcgtgatactaagcagacccagcagattcggccaaacatcctttaaattggtcaggtcctgtttggttgcggcacctaaaatcggataaatagctttacgattgacatggttggctttggccttcacatgtttccgggttctggttggtggcggaatggtgccgccgttcgcctcgacccgtttcagttgatcactcagctgtttgacttttgccgtcaatttttcaaattgcggattttctgcctgtgctggtgctgccgtaacctgtggcgttgtcgtttcgcttaatcgaaccgttgccacttctagataaatttccggatgattggtcatccgcagttgttgctgcgtgctattcaacacgtcaatcatgtggtagatctgctctggcttgaagttctcgctcagaattttgaattgatcatcaagtaagcttttttctaaatcacccaagagtgtcggtgcttgttgattaaccaacagatcccgcaagtattcaatcagatcttcgattaaccgcccagcatctttacctgacgctaacaaatcctcgatcattttcaatgcctgcgcatgatccttggcgaggaccgcggctaaatacttgcccaaaacagcagtagtcacaccgcctgcgacatcaagtgcatcttccgttgtgacgtgattatcgccaaaactcaacacttgatcaagaatcgataaggcatcccgcatgccgccttcagctgctttggcaatcactttcaacgcagcatcgtcgtatgtgatttgcttatcatccaaaataaaacgcattcgcttaacgatatcttccggcgtgatccggcgaaaatcaaatcgttgtgttcgcgaaataatcgttgctgggattttatgtggctccgtcgtggctaaaataaacaccacatgcgccggcggttcttccagcgttttcagcagagcattgaaggctccgctcgataacatatgcacttcatcgatgatatacactttgacgcgagcttgtgttggcgcatattttgccttgtcccgaatgtcacgaatctcatccacgccgttgttagaagcagcatcaatttcgataacatcggtcaaactgccattattaatagcctgacaaatttcacaagtattatctggctcaccatcctccaagtgtagacagttcaatgcctttgccagaatcttggcgaccgatgttttaccggtaccgcgggggccggtaaaaagataggcgtggcttgtctggccagtaatcagcgcatttttcagcgtcttggtgatggcttcttggccaatcacatctttaaattgctgcgggcgccacacccgatataacgcttgataactcaccgtgccgcctcctttaaacacgtttgctggcgccgtcacctgctcataagggcctcaggtgcaatggccaaaaaccagccatcacccctgaacccgcttatgctccggtgactaaacgcgcccgttcacgctcttctttaaacgcgcttaccggcgccgtcacctgctcataaggacctcaggtgcaatggcccaaaaccagccatcacccctgagcccgcttatgctccggtgactaaacgcgcccgttcacgctcttcttagtgaaatattcgctgtgttctagtttaccatagctgcctcatgagtagacagaatctgcgacaacaaaaacggccgctccaattacaagcgaccggtcaatttctcaataacaaaaggcacatgacgaacctaccttagtgctgcttccttccggacctgacacgattcggaaagccaccattgccttaaggcctttcggcagttttcattataactgattctcactggtttgaccagcccgcttggcggcttttcttttggcccggatcgttcggaaaaacgtttgtagcaacgtggcgctttcatcggctttgatgccgctgaccacagcaacttgatgattaaagcgggtgtccgccaataaattataaaaagtgccagcaacgcctgctttaggatcagtggcaccaaagtaacacgtcgccacgcgtgcattgatcatagcgccggcacacattggacatggttctaacgtgacaaataagctgcaatcttccaggcgccatgtaccaagcgttttgcatgcggcctgaatcgccagcatctcggcatgatgcgtcgcgtcttgagttgtttcacgcaaattataaccacggccgataatctcgccttgatgaacgatcactgcgccaatcggcacttcgccgattgcagcggcttttttggcctcggttagagccgcatccataaattgattgatgtcgtgttcgtccatgattgccaagcactccttgttttatcattctgatgccaataaatagccgtccatcaggaaaatcctcatggacggctattttgatcacgcagccagtttatttacctgacgtgtgatagccacatgtcgctaaactaacggctagtgactcagtgctgcctttaagcgatcaatggctgccatgccttggtcgcgagccgatccggcatattcgctagcactgtcttttagactgcgcagcttgtcgctaacccggagcagactggcaacatcatcatcgctcaatttatctaaaacggtttgaacccgatcactgtcgccaaaaatcttcttcacgaagccttcaacctgacgccgttggtgctgccgttcaaaatattcagtcaagcttttggcacacacaaatgcccctgctgcgattgcggcagcggccactgcaccacctaatgcgagatatttcgattttgtcatgtcatattgctcctttctgtcctgacctgagtgtaccacgcctagtataaaaacacttattttgtcgctttaagaatatagtacccgtgttccttttttacaatgctggcatcttgataaattgttttcatcattttcaatgcagatggcgcaccttgtttcttttgaatcaccgcatataactgaccatgcggcaacaaatgctcggcagcgccggcaagaataccggaaacgatggttttaccagcacgaatcggcggattcgtcacaatcacgccaaattggccatctatctgatcatacatggaactttcgacaatcgtgacattgctgatatcgttatccgttgcattgcgctgtgccaaagcaagtgcacgttcattcacatcactcatcgttacttggcgatcaggaaagcgcttcgccaaagcaagcccaatcggcccgtaacccgttccaacatcaagtatcggtcccgctggcaattcttctgccagtatggttgcgatcaaaacccgactgccaaaatccaccgtgtgtttcgaaaacacgccattatcgctggtaaagcggagcgaatgcccacctagctcaaagtcaaagctgtgctcatcatgggccaaatcaggatcattcgtataatagtgattcaatattggtgcctccttgttttgcgcagcgctaaaaattatctgctagccctcagccatgaaaaaggactgtcaaagaccatactctaataacacctaacatccggttatttgtcaatgccttgaccgagtcggctcacccaggctaaccgctttggccaccacttgttcggcgttgcaaaagtgaccttctgattcacgaccatcatgatctgcagcaacgtgaatagcaatgacgtccgtttacgataagcaacgtacttcggtacccactcagttacatatttatttttatacgagcgcaatccttggaatccataaaaccgatagccgtattcatacacaaggtgagcaatcttttcttcaataaaagaataactagacgtaccgacattcgccagcggggccatccccatattgaaatacttaaagccgcgatccttggccaattcaaacagatgaataaacacttcatccataataccagaaggcgcatcggcactagaacgcatcaaatcaatgctagtaacctcattattacccgtcggcatgtcggtcgcaaacgccacaatcttgccatccggcgctcgcacaaccgcaatcggcgcctgattcagataatggcgatcaaagaaccccaagctgaaacctttctcactgcgcccgtccaaccatgaatcagacacggtttgaaggtcgtctagcaaagcatcatcaaacggcggcttgagcagctcgacactgtagccttcacgctcaaacttgtgcatgagcgcccgctcaccttttcgcttcgtgccagccaatgtaaaggttgtcacatccacataaccttcttcaccaaacttcatgaagtcaaagccaaattcatgcaatttcatcgtcagattttcgttaatctcataaaagactaacgacatgtcctgatcatctgcctgcttcataaagtcagcaatcgcggctggaatttgggtctcatctccaaccggttcacccatgacaatgagtttatcagccttctttttaaacaggaagaacacgcgatcttcaccgtccacttgataaaaatgcagcgatttatcgcgcatcagtcccagatggctcacttcgttcccgccaaatttagccacaaccgccttcaagcgcgcctcatcgtaaggatcggccaacgattttgtcgacgccgacaaatatcggaagatgagatacaccgtcaacgcggccagcatgaccccgattaaggtagtgaagaacatccgctcagacgggaaaaggaaaacatctggcacatgccggtgatgaatggcaggcgcattatagaacacagcaaatgcataaaagataaatgtcaagccaaagacggcaccatcaatcagcttgttgccccacgacagcgccaaccggtctctggtcaattcacgacgcgtcaagataagcgcaatgaccaccaaaataaggaacacgataaagcgcagatgattatcctcgcgcaatgacgccaccatcgccacaatcaacacaatcacagtcggccagtaagcgcgcttcacgcggctggcaatgccacggccaaagccaagaattaagaaagccacaatgacatttgtgacccgatcaaggaataggaaggtgtagggataaaggcgctgatacaaggtgttttgaaaagcaagatcaggcgcaacaccgcgcaagagtaacataatcccagaaaaatacaggaaaaccactagaaagccgaatgctgctttgcgaatcaactgcactggtaagccttcaaggtaagcattcaatcgcttgccagcatcttgcgcaaacaaaccggcaccaatcaggaacggaatgacatagtagaaaagccgatagaaaagcaaccaaacaacggcggcactgctgtccagacccaactggccgagttcaacaatcattaacacatcaaaagaacccaagccgccgggcaccattgaaataaccccgatgacattcgccaccatgaacaacggcaagacagacaatagtggaatgggcgcctcaagaaaataaccaatcaaaagaaagaatgcagcacaaccgccccattcaagaaatgatcccagcgtcaggcgcaactggcgcttgagtggcatatcggcaaagaattcactatcacgcacatgggagatgatcatgagcaatgggaaataagccgcaccgcccacaagccagacccaatagttagcaaactccgccccaataccaaaaacaaaaatgacgacaatcccgatcatggaccaaagcgacaacccagccaacaaaaacatcgcgatttttgaaatcgcaaatagcacctgcttttgagacgctttttcatggtaaaagtttgcccgcaaactagcacccagtaaccccccaaagccggcaatattggtgaaggtgttgacaatccagcctgatttaatgacataagccggtttgtagtgccctggtaacaattcagtaatcacaaaatcataagttagcatcggtgtaacggcgatcagccccacaactaacaaaatcaagagcgaaacagggctttgcgtggcgaggctcgcccgcatttgttctccattcaagtcttggctgatccggccaacctcaaaaatcacaaacactaggactgctagcacaaacagtactttaagtgtggtgagatgtttctttaaaaacgatccggtttctcggaatagttttttcattgctgcgtcctccgtgtctatattcctattcattataggaaatctacaagcccctcgcaccctttctgacctttttgtaaggtgatgtaagtttgcaagatgattgaaaaattttttaacttttttagttgaaaacgcttgacctgaaacgcgttacagaaattacactcagtctagagtcaagagcgtgagcaagagcgtgagcaagaccgtttagaaaccggagtgtaagtggcctcaagcctaaatggctgggtcttgtccatttaggcttgaggttcttatgtgcaggtttctgcgactgtgaacgcgtttccgccaaagcgtgctccgacgcgcttagaaaccacatttaggcaatgatctcaatcaagtcagcagttattttcaatcaactcataggaggtaaacatcatgttaatgcaaacacatctttatcaggaacttcctgtttatcaggatacgcaaattggcgccttgaaggccatcgctctaaagttgaccaatgatttcaattttgactatcaagaggttctaagttccttgttagccagcgcgggtgagcaaacgcaaaccatcaacgatcaggcaatcttaacgtatggtcatgtcaccagtttgacagaacctgttgttattggctttgattttggcaaggctttaccttgcgccgctggtcaccaaatcagtcaggcgattgtcttgttagtccctgtcgacacagctgaggcaaccattcaggatcggcttcagacaatctccgcggcaattgcacaagatcaggatttgaaaacaatgacccaaacggcaacagctgcaatcgcttagtcatgctcacaatgagctactgcattaagatcaacgtttatgtcacaaaagtcggcatatcagggtctaaaacaaaatgaccactgacacgtcggctttttgtacgcttggctttaactgcttgttatactggaactggaggtgcttttatggcgaatattcatgacattgctcgactatccggtttctcaacggcaacggtttcgcgcgtcatcaatcagcaacattatgtagcgccttcaacccgcgcagcgattcaagcagtgatcgatcaacttgattacgtaccaagcacaatggcacaaaaccttagcgcaggcaaaacgcggacaatcggggtcatcttgccgcacaccgatcatccctattttgaacagcttgtgaccggcattttgaatgcagcaatggccggcaattatcatgcggtgatcctgccatctcgctatgatcagtcactcgaacaagactatttagaagacttacgccgtcatgcatatgatggcttgatcttcacgtctcatggtcttggcctgcgcacaattgctaagtatcaaaaatatggccctattgtggtttgcgaaaatccgggaaaaatcaaactcgccgccgcttacgccgaccgaacacctgcttatcaagaggcattccagtggatgggtaaccaaggctacagcaaaatcgccttgctgctaagtcggccctatgcccaaagtgcgactagtaaacttaccattaacagctatgtggatgtgttcggtaaacgtcctgctaacgaaatgattgtctatcacatgcgaaccttcgaagatggctatcaagctggtgcgcggttagtcaatgagcatccagaatttatcctcggcaatggggacgatatcacggccggtcttcgccagtacttcgtcgaccatcacctgcccatccctcctttaatgggtcaagagaatcagctctccagtcgattactgcaaatgagtacgatcgatcatcatgttacagccatcggtgcagcagcgttaaaactggccttgcgcgatgacattgctcagacggtgattcaatccgatttgattttacggtaagtatatgacaataaaaaagcagcaacctgccatggcttcaaagccatgataggttgttgctttactttttgccgatacgctgctgccctaaacgtaacgcatggacaggctattcttcacgttgtttccgtttcaatcctaatacccccatcagactgaccacaatgacacccaagaagccaaacgctggccgctcaattgtctctgctgtcttgggtaatgcccccttaccggatgtatgttgaccattacgatcagtcgtatcatccgtgctcgttgatgtcgttgtggctggctttgttgggatattaccgccagaactaggctggctgccctcatcgcctttgtccttacctgtgtcgcctggagcgggcgccggggtaccttgaccgccgcctttgtcgctagtaccggttgtatcgtcgcctttaccagctgtcttggccgcttcaacggcagctgccaccttcgttttcagactttgcaaagcttgtaaatgtgcaagcttgtcagacgcatcagcactggcttgaccagacgtcaatgtgtcagcaatgtcggcataccaagttttgccagttgcagcatctttagcattgccaacctcagccggtgttgccgctttaataccctccgcaagttttgctaatactgcatcaagtacctttgcaagactcgcttgaagctggtcggccgtttgcgtgcctgcttgagcttgtgccactaggtcgtctaacgctgccgtaaatgttttgccagtgcttggatcagtttgattgcccaagtccgttcccagcgcagccttcacagattgcaactggttaagcagcgaagtcttcttatctgcaggtaatttggcagctaattgattgatcgcagtttgcaggtctcgattggcaccagtaagtgaatcaactgaggcgtccgtctgatcaagcgccgtttgtgccttctgcgttgccgctgctaaagcagtcgttgtggcatcatcatacttaccgctggcacttagcgttttggcggaagcaatcagattagtcagtgcctgcttagctgcctgcaattgtgcaggatcatcagtcttgatattggtcacaacatagtcgacggctggtgattcattaccgtataaatcagtcgacttaaacttgaaggtgccatttgccgtgaccgtgacaccggctgccggcacatcctgatatgtcttgccaccatcagcactatactgaaccgtttcacccgttgcggcagcgtttgccgtcagagtcaccgttttggctggttcagtggtacttggcgtcacagttggtgctgccagtgttttctttggttcgtagtaaactgtgatcttcttggtcgtggtgttgttttcgctatctgtaacagcaacagtcagcacgtttttgccttcgagcaatttaacgggttgatcaatagccatatgacctggtttgccgctattgatgttgatgtctgcgtattggctggcgacctgactgccgttaattgccagactcagatattgtgcattgtcagtggccgttccggtaatctggaagttcggatcgttggtataaaccggtgcatctgtcgagctgtccaatgacaatgttggcgccactgcatccaaaatgaaggtcaacgcttcttggaaggtcttgttttgagtggtgtcacccacaacaaccccaaacggtttttgtccaagagtacctaaatctaaagtgaaactgaaagtcagatcattcttgattggaatttgcttaccatcaacctgcaacgttgtcgttgggtgcttgaccttaccagtaatcgtcgcaatcccggtcttagggtcatagaacttagccgaggtggcattgaattcattggaaccaaatgtcacaccttgatcgaacgtcacagcattcttcaacacatcaggatcataagacgaggtaatcgtcttttgctccgtcgtggtgttgccgtcttcgtcggtggcggtcacccagatggtattgtcaccataattaaccggtacatcaacactaaagtgatgttgtgcatcaagtgctgctacggtgtcgccaacattaactgtcttggtgtcagcactaaccgtccctgtaaccttgatggtcgcttcagaggtctgatccgagccattgttgaatttcaaatcagtaaaggttggcgccgtcagccgaactttggtgtcaaaatgtttaagcaactgggtgtgcgccttatcggcatatagatccacttgcgcggcgtaatcagcattcgtgaccgccattgaggcagtgaaactgttagtcgcagcatcgtaggttgtgttcaaatcatgtttctttccttgtgcatcagtgtaagtaccgtcaaccgctgctggatacgttccactaaacgtatacgtcccgccaccttgagtattggcttcgtagccagttgtggtacttgagatcttgtctgggataccgccgccgttcacaattaaatcaaacgatgtagaccccggcttctgaacgctggcatcttgatcagtggcattggatgcattatcagtcaagtacagctcagccgaattgtcgccattgccaagtgcttgggcctgttcatcagataatggcgtttcaattttggtgtacccatcagccgttgtcccagcatcggtaaaggtagcatcaagattcgtcacttcattaattgcagttttaacgctcttggtggcatcaagaccactcaaatcatccttggcttcagctgtcaaataatactgggttttcccattttccgttttggctgacaaagcgacatgacgaactgtcggcgccttagagtcgagcttgaaaggcacatcaaacacttgacgtttgtcgccgccttccggtacaccggaaatacgataagtataactgccatcatcagccgtcttgatgttgccatcacgttgatcataataggtgccatcccacgctggagcattgtagtagatgtacttctgcgaacgagcatcataataggtcttcgtctgattggtggaactgctgagagtcgtaactttattgccctgaccatcaagaatatcaacttggacgttgctgatattgcgcaatagataatactgcatgctgatgtcattatataaggcattcttgtcactcgaaaaagcaatcgcctgatcgtcaactgtctgtttgccatcagcgtctgtgaccatgccgccataatattgatggcctgtatttttgttcgtcaatagtggcacggtgccataattaccaccagcaggactataagtgatcccattgagactatcgacaatcttaccgtcattccagtcaccaaagaagcccatgtatggcaagttcaagcgcgacccatcactccccttaaagttcagaaaaccttcaacaaattgctgttggtcaaaagacttcggcaaagatagtgtgaattcaatctgcgccgttttcccagcaggcacagttatgtcactgccggctttaatggctgctccatcaatcttcttgtcatacaaaaccccagacttacggtcagtcgctgatgtataaacggcattagtatccgtattactgtccatttgataggttagttcatgggtcgtgcggttcgtgaaggtcagtttaaaggtcttgtccgtactcgtgaagtctttcaattcaactgccgggtagccgttttcggcgacaaccgttgacggattcttttctaatgcatcaatggctgccttcacatcaacaagaccggcaccttgccgccgcggcgatacgataacattgttgtagttaatatcgttgattggctgggcagtattcatctcaactgtcttaagaaaatcggtgagcgctgtccctttaagttgtttgtagtcagcataaaatgggttgtttttgttattcaacgcttgtttcaacaatgcttgtgaaccggcaataaatggcgaggccattgacgtaccagacatatttgtgtagccattgttgttttgcgttgaccagatgttgccgcctggtgcggtaatatctggtttgaaggaaagattggaaactggcccataggatgtgaagtcagacatcttgtcgtcagtatatttctgatttggtaacagcgtcagggcaattttgacaccgagactatcatccgggtgtgctgtgacccagtcaaccagcttttgaccggttacactggagagcccaaatgttgggaaggtggtggttaacgccatagaagtcaacggtgttgctgtgccatcgttgttgacaatgatcaagccagcagcaccagcggcttgggcgtatttttgtttatcagcaaaggtaagttcgccacgtttaacgatggcaattttgcctttagcgtcagcagtatagtcggctgctgcccctttgctgaggtcgccactagcatctttgacaacataaaacttcttttggtcaaagctaccagtgaaatcgttgcttgaaagctgcatggcttccggtccaagccctaactctttaccatctgtaatggtcactgcctgacccatgacatccgtgttctcagcggaagcaactgtggtcgctcctcgtgatgtccctggcgttcccaccatttcattgtcttgcaaaccgtaataatctttgttgacgccttgagttgctgaaccggatgttcctgcgttcccagcagaaatgacggcggctgttcctgattcgttagcattttgcaccgcagcaatttctggatcctccaaggtttggttgcctgaatcagatcctaaggacatgttgaggacatcggcaccgatttttgccgagtcttcaatggcagaaaccaaggtagctgacccggttgttgcagaagtgtcagagttggtgaaaactttcattgccagtagctgtgcttctggcgcaactccgacaacagacttggttggatcgtcacctgtcccgttagcaccgatgatcccagcaacatgcatgccgtgttgttcgtcaaccgtatcatctgtaatcgtgtcgttattatcagcgtaattaaacccatatggcacttttgaagtaaaatagcggccatgcttggcggtatcagtgaatttttcaacatcagatttggttagtttgacgtctttatcatcgcttagccgcatgtctttatgtgttggatcaatgccagtgtcaataaccgagacaactgtgccttcacctttatatttgtaattggaccatacggcctgcacattcgccatcgagttagcattagcatcagtcggatagtaaactttcgccaatgtgactgttttaactccggcaatttgtttcagtttagggatatcaacaaccctaactttagttgaaaaaccgttaacgacatagccataactttcaccggcagtttgttgggtgacttgttcaacagctgccttaacgcttgcctgagccgcgatcactttattggtctcctgctgaatctccgccgtgctggagtaatcagttcttaaagtgccgttttcagaggcaggcgctgcgctcatttgaacaatgacgtcaacataagtatcttgctgctgaactttattcagcttattgtaatcaatacctttagccgccaactgtgtggcaatcgcttgattcgttgtcgctgcggttgtgtcagtggccgcttgcttagcagtcgcggccttaaccgtatttgcgagtgatgatcccttagtttgctgcgagatagccgcctttgcttggatttcgccgactggcaagacagccagcgcccctaaagcgactgtaccggctaacaagatcgatagccctttctttttcctttgcatccaataccctccacttcccaaaagtttcagaaccaaatcaaacccacgcttgatgtagttaagattatatactctcgaagaacagattcaacgaaaattttaatcttttattaattttcctatctgtaaattagcttttagtgttattatttagccatttacagactatagatgttttgaaatttttggcattattagaaaatgagtatttgcattgaaattctcaattgccaacgctagaataaatacacaacgtttactgtaagcatttcagaggagaccgagtcgatgaagaaaaaaatgcgccttaaagtattattggcaagtaccgcaactgctttactgctgctaagcggttgtcagtcaaatcaggccgaccaaacagttgcgacctattcaggcggcaaggtgactgaaagtaacttctacaaggaactcaaacagtcaccaacgacaaagaccatgcttgctaacatgctcatttatcgtgcattgaatcatgcctatggaaaatcggttagcactaaaacagttaatgacgcctatgatagctacaaacaacaatacggcgaaaatttcgatgctttcttaagtcaaaacggtttcagtcgcagtagcttcaaggaaagcctacgaaccaactttttaagtgaagttgcactgaaaaagttaaaaaaggtttctgaaagccagctcaaggccgcttggaagacctatcagcccaaagtgactgtccaacatattctaactagcgacgaggacactgctaagcaagttatcagtgatttagcagctggcaaggattttgccacgcttgcgaaaactgattccattgatactgcgactaaagataacggcgggaagattagttttgaatcaaacaataaaacgctcgatgccacatttaaggatgctgcctacaaattaaaaaatggtgactacacgcagacaccagtcaaagtgacagacgggtatgaagttattaaaatgattaaccatcccgccaaaggcacctttactagcagtaaaaaggcgctaactgccagcgtttacgctaaatggtctcgcgattcaagcatcatgcaacgcgttatcagtcaggtattgaagaaccagcatgtgacgattaaagacaaagatcttgcggatgcgctagatagttataagaagcctgcgacaacgaattaaggcttaaccgagtatgatgaaataacagccagttcttttagaaattggacatcaacgccccgaaagtcatagcaacatgactttcggggcgttttatgtataaaaaaagcatctcgcctttcgcggtatcaccacgattgagcgagatgcttttatttgaagatggggctaggttatttgagggtaaccgttgcgccaacgccttcaagttgttccttaagcttgttagcgtcgtcttcggaaaggccttccttgataaccttaggtgcggcgtcaaccatacccttagcatccttcaagccaagaccagtgatttcacgaacagccttgataaccttaactttttcttggccagcttcggtcaattcaacgtcgtaggtatccttagcagctgcagcgtctgcaccagcagcggcgccagcagcaacaggggcagctgccttaacaccgaattcatcttcgatcgacttaactaagtcgttcagttccaaaatggaagcatctttaagttgtgcaatgatgccatctacatctaaagccatgtttgtttcctccgtttattaggtagtttgtaacgtatcattatgcagcaggttcttcgtctttggcttctgcaacggccttgacaaccaatgcaaaatcgcggacaggtgcctgcagaacagaagcaagttgcgacaacagaccttcgcgatctggcattttggacatttccataatggtatccaaagaagcaaccttgttttcgatgatgccgcccttaatcttcaaagcatcaaattggtcagcatacttggccatgatgcgagctggggcaacaggatcgttattggagaaggcaacggctgtaggacccttgaaaacatcgtccaatgcttcataaccgttagcgtcagcggcacgacgcaggtaagtgttcttcaggacttccatcttaacaccggcctcacgcaattccttacgcagtgcggttacttgttcaaccgttaagcccagatagtcgacaacgacagcactggtagcactcttgaattgttcagaaatgcttttaacgatttcagctttttttgcgatagcttgttcactcatgtttttttcacctccattagtttggttgaagtttttaaatataaaaaaactccatgtctaccaagacatagaggtatctagtgtttccgataccacctcggcaggataattaaggcttacgccccctgagtcttaggcagagtgaatgatcacaaggagtagaataccatggtcaccgacctgtgtcaaaatgttttgagaaaaagaaactttgcaggccggccaatcccatgcaaggtcttaaacgctcgcaaaacagagcgtgtttttttagataacagacgccattgtagattgcactttgttattcgtccaaatttgttatccatttctgactaataggctccttgctatcgaattgtaagccccctctgattgaggtatattaattaggtaactattttctgaaaggaagttggcgctcttgccaagtaaacttaaaagcctcgagccatggcagcaaaatctggctgtgttatggctcggaaccttcattgccggcatgggcttcagtgaagtttcgccatttatttcattatatgttgatcaacttggcgattttaccaaggggcaactgagtatttactcagggatcacgtttggggtcaccttcatggtcgttgcgatcgtgagtccgctctggggccgactcgctgatcgccgcggtcgaaaattgatgttgctgcgttccagtttcggaatggccatcatcatcggagcgtgtggctttgtccacaatgtctacgccttaattgccttacgttttctgcaagggctggcagcaggttacattccaaacgccagcgccttgattgcaaccgaaacaccaaaggcaaaaagcggcactgcgattgggattctcacaaccggctacgtttccggtaacttgatcggcccaattctcggcggctttcttgcccagaccttttcaatccggctgactttcatcatcaccggcgttttgctgctgattgtgtttgtcttgagcctaacgatggtccatgagcattacacaccggatccacgcttgctcaacaaggaaaaacgcccgagtttattgtctcaagtcaataatccaaaagctatcatggtgctattagtctccaccgcggtgattcagctaggtaatatgtccatttatccaattatcagtctttatgtcaaagagttgatgcacaatgttggtccaatcaccgttgttgcaggcgtcattgcagctttgccagggatttccaacctcatcgcggcaccgcgcctaggtcagcttggtgattgcatcggctcaggcaagattctggtcagtggcttgattttcgcggttattatgtatattcctcaaggcattgtcggcagcatttgggcgctcggtttcctgcgtctcatgatcggcgtttcggatggcgcgctgtttccaacaattcaaacgcttctgtctaagttgacaccggtgagctataccggcaccgtcttcagttggaatcaaagtgcccaagcctttggttccatggctggctcgctagctggcggcttcatctcaaatatttttaattataatggtgtttttattttcacagccctctgtttagcgcttaacctagtgatggtgctcgtctttattccacacatctggtcaagccgaccaaaacaacaagcataacgcatcaaaaaaaccgacctgcgtgggcagatcggtttttttattggctaaattaaatcactgcattagcgtggcatcaagcaatagctgccaactgatcaatggttttgggtctgggagagctaactgctgatacacagtccacgcatgaatatctgtatcatcaaattcaccattcaccactgaatagcgcgcccgaacttgaaacaatgccgtttgcaataagcgacgaatgtcagcaaactgttggccgcctatccatgcactggttaatgctcccggttcatcttcaaaccaaaagacatatgcctgcacttgctggttttcgactaagaaacttggttgagtgtcctcagcttcagccaattgttgttcaaaggttgcatggttaaaggtcaccggattatctgcatgagcagcaacatagtttgcaaaactcatttgcactacgtcatgccactgtgccgacgtcaactgggaccgtgaccgaacatcggcctctggggtagcgacaactttccgatagtcactcattgccgtacgacgaaaggccctgaaatgcttggcctgcaattgcgtgataactgctgattgggcagcataactgctgtactgcagccgatcatgatgatcggccaattgccgcaaatcttcaagtaattgcggcaaccacgcaacatcacccaccacatcaaaatacagcgcattggcatgaaatgaattctcccatactgctgcagcaaacgtcacagcactgctttgcggatatcttagtaaaatcgcatgacgattagcaaaatgttgctgtgtgaacgcatcagctgatgccaagaaaggttgaagcatcgtcagtgtcaccttgcgaccagtaagcgtcctgtcctcacgcatccttcttggcttgccatgtgccatgcagtcgggttaacgaataagcataacgactggcaccgtagacgattgggaaaatgaatccgatccacaaatgattggcaaaataatattgcggtaatggattcatatccatggaagcttcgtaagccatctcaaaagcaaaaataaacacgcccattaacaccgctgagagcacaccacgcaccaccgccagccattcataccggcgatattcctccggcgtatctgcttcaatcacatgcagtcgataatgccgcagcgtgatttcattcatcaggttaatcatgatcgtcacaattaacaaaatccatgtcccggcactaatcattttaagactattagcgtcaataaaaatagcgattatcgttgcaatcagcaacatcaattcagcggtcagcatattgcgccccatgatagcgtcataggtgcgttgtttaaatcgatctttgagtgaaatgccataataccattctgtgattttcttcataggaaccctcttctattttttaattaaacaatgttccaatcttaacacggatcgccaacgcctttttcatgaatcacgcgcatttaaaaaatttttccgtgacaataaactacgattcatcaaggaaaaatctctgtgtctgttccagttgtcaaaatattgaaattttcattgacatcacggtttgtttttggtgaaatagtaaacaagcctagggtgtcaagacaccctaggctccattaaaggaggcgcgaaaatgtcaaaaaaaccgtccggccatacgcggctgatcgttggcatcggcgttgcatggctgtttgatgccatggatgttggcatgttaagtttcgtcattgcagccttacatagcgaatggcaattaagtacggtgcaaatgggctggattggcagtgtcagttcaatcgggatggccgttggtgccattttgttcgggatgatggtggaccgttttggccgtaaagcgatcttgattcttactttgctagtttttttaattggcagcggcatttctgccttcgccacaagttacggcatttttcttggtttgcgattcatcatcggtgcaggcctcggtggcgagctaccagtggcatcaaccttggtttcagaaagtgtgccagttgaaaaacgtggtcgtagtgttgtcctgttggaaagtttctgggctgccggttggctgttagcagccattatttcttacttcattatgccaatctggggctggcgcgttgccgtctttgccactggtttagccggactctatgcgttttattttcgtgaaggcatcaacgaatcgcatgtctttaaaaaagtggcgcggcccggcgtgctcaaaaccctcagcaccctttggcgcccgccttatgttcgcgcaaccttgatgctgtggatcgtctggttcatggtagtcttctcttactatggcatgtttctttggctgccaagtgtcatggtactcaaaggatttagtctgattaatagttttggttacgtcttaatcataacgcttgcgcagttgcctggctatttcgtcgctgcttggttaattgaaaaatggggacgtaaaatggtgctgagtctgtttctgctaggcacagccgccagcgcattaggctttggcctagccaccggtttgccaatgctactgactgccggtatgttgctctccttcttcaatctcggagcttggggcgcgttatacgcgtattctcctgaacaatacccaactgttgtccgcagcagtggttccggtatggccgccggtatcggccgcatcggtggtgtggttggaccgttgttagtcggtcatcttttgggatcacactggtcagttggcggcatctttagcattttcaccgccgccatcctcatagcagtcctagcaattgtcttcctcggccaagaaaccatgggcgtgaaacttgccgacacgcttgaatagtctcaacagccaacaaaaaagggtctacactttctggtgttgagaaataatcaacactgaacgtgtaggcccttctttcggataaatcaattctcttatgtttctgtccgaaattctagtacagaccctaatgattggaatactgaatggcgtctgattgcatcttgttgacgccagaaatggcttcttttgctgactcaccaccagtagtaagcaagttcttaattactagaagctgattttgaaatttgattgctttagcagtcgcagcaacaaaagctgtagctataggcacagtgatgccagtagtcatgctgtcgccaagtgacttcatgcgattgccaatagctatctgggccgtaccaagcttgttaatcgcaccagtgacaccggttgttttaacactcatttcggcttctgctttggcggtattgatgtactctttagccagtgatgcaagttttgcttgttcggcttcaaaattagctgcaagtctagcggaactttttgtcatttcgccttttgaagtcagtgatccgtcgtacgccttcttagattcagctacaacctttgactgtgcagcaatcatcttggtcaagccttgttcttttgcacttaagccgtctactttacttccaaaagcgtcataagaagaggcctgagctttcatctcagacccgaaatatttcaactgtgacttggcgttcttcagaccgttaccgaacttggtatcatcaagcccaagctcgatcatcatttgacctaatggttctgccaatttgtttcctccttcctacattgatttgataaagtcggcaagcgagactaccttttctttttcgggtccgctttgtagcagcacctcttgtagcgtctcccaatcagttttcataatgtcattgatcgtgaatcccggaacatttgtaacaaccgaacgaatcattttgtagatttgatttaatgcttcttttctgctgattcgctcgctgccactttttttgggtctatcccgaaaagctgttgattgaatgtgtcaaatactttgttgaaatcccaagcggcaacaccgtctaaaattcgtttcttagttacgcttttgtcttcaaaacaagaagccataaattctgcgtttttttccatccaatctgattcatctagatcaggaaagttctcgggagttagttttaagccttcgatcagttttaaggcgggcacgaatgtttcttgaaagtgctcaaccttgccatctttattacgtaaatcaagttttagcatgataagtctccttattttagatgccgccctgaactcaatcagcattgtttatttctgaggcgacaattttatttttaagcagcagttacggttaccgcagtacttgcggttttgctgccatcgtgtgttgttgcggtaatggtagccagagccttcagaaacgccagttactacgccactactgttgacagtagcgaccgatattttactggattcatagctaacagccttgtcagtcttgtattggccttcctgaagatagttcttaaaagatactagacaggttcttagattttggacgtctttcataggcgaccacctctttgtgattggatttgccaaccgtcattaacttttctgctaaaaatagtataccataaaaatggccgtattcctagagccacaagggatatagcctatttttgtgtgcgggtctgcgagctttttggctcaacgttagtcggccaaggccgaggagcgtggggcgcctgccccgcccacgcgctccgggcagcgtactacgtcgtctcatataaccaatcaagtttttgttaggtaatggacgaggaaaaccacctcgtctcgttacgtcgagataaggacgccaaaaagctcgcagacccggtcatagaaaactattgctccaacgcttgatcatgatgcttaggtgcacttctaaaattggccgtcactgccctttcatttgctgttgctattttttgatccaaggtcaaacctttgctctttgaacgctcatggatttgtagtcgatcattccaatcctttggaacgtctcgtacaacttgaaaatcacctttttggtaacgatgcgcaacctctgtgattcgggtgatcaggttgttgtgatttgctatggtcagatccggcgcctgctgcttgaagtaggctagccagtcaatgccattaggttgcagataaggcttcaactttttagcaaattcaggcaagtcgtcaaaagatcctttggtaagaatatcctgataatgatagccgtttgccatgccatgaccgggctgtaaattgacggcgactttcagatacgccatcaaagcgacggtaggaatggctgcctgctttgcagcactgacaactggcgctagacactcgtgtggaattgcctggtcagctgggattagactcgtatacggcacactcgctaaagcatgttcagccctcatctggtcataaaagacatgaccactcgggtcattgtcgaccccaaaagcaatctctgacggcgcatgaccagttttctcgcagaaataaatcagcccttgtttgaccgtatttggcttcaagccgtccatcgacattaacgtgacgtgattcaagccacgatgcagtgaccaataactcagggcatcaatcggcgcctcaaacattaaaagtcgttcaggcttgcctagggacaaattgaagccaaagttttcttgtgagtttttggcaatttgcttgaaggtaccccgtttacccaaatgctcatggtcaattctcgttccttgtaccgttgcccctacgattttgtctttccttgaccagacaaagatggcattgccatgctcgtcttgttggataaagcctttgcgatgcagcaagtccacaatctgtggatcaagtttccgaaccgtcgttagatacttagtggcctgctcaaagttagggctatttttaaagttgtattgaaacggctcacgaaccttatgcgtgatagtttcagctcgctctaaagccgcgtgattcagatacgcaactgcctcgcgaaaactgctgatgcctaaataatgttgcacaaaatctaatgcaccgccaccaacatcgcgactattccaacggaagagatttttcttgtcattaatgactaatgaatcatgttcgaccccacgccaatagccattggactgttgcactagggcaatgccatttgcttccgcaatcgccacaatggcgacgtgattcgcgtggtcaatcgttgctttactgagtcgtttctgtttgtttgtgaccatcttggttaactcctttctgcatcaaaaaaggacgccttggcgtcctatcgttcaatatcatgatgatggtgttgctgttcttgctcttcctggggcggttcaccttgtaaatcgtccattaagtcagcaatgtcctcccacttgttgaccatgatggtttgctgcttgagactttgttctaatgaccgtagggctttttcttggtctgtaatgacacttgccatttcttcgttagtcagtagcgggttaaagtctcggttttgcaaatgtagtacggcagtttgatacatattaatttcatgtcggtacttcttagtgagtcggtgttgctcctttgatgaaacgtcctctaatttgtcaataattggttgatattggttgcgggtaaagatgaactttgctaagtcgttgtagttggtaatcttatcgtgaagcatttcaattttctgctgcacgtcatgcagctgatttttgacggctgtgacttgccgaccaagtgaaggcagatcggtaatatgatttgcacgtaactcaccaagggtagtcgatagacgactgatatcggcttgttgtgcttgcatatattgacgttgccggttggctattaaccaacgtcctaacatcggctgtgttgactttaacgctggttttaaggttgctcctgttaaactgactgactttggttctggatcgtccaacgtagcaaagggcgttgcattgtagtgccagcgattgccaatttgcacggtgtactgttgatgcaaccggtcataatttacggcgtcattagggataaagacccgttcataaccggcatcaggtagcgtaatcgttaatcctttgtcggagtgaccaaagacggcttgaggaggaacttttaccaattcaggattcaatccttggtcaagatcaatcgcatgtatcaatgcttcaccacggattgaaacagcacgtggccgttttccagattgatccgttaatgtgtagtaataattggcctgtagggcaacttgcaaatgatcaggatcaccgcgcaattcgtaacgattcaagtgaaccgttagctgcccttcattaggcacttctagttgaaccaaagcccccttttcatcaacacttagcacctgatcctcagacaagtccatcaaggtttcggtgttggtcatcttcgacttggtttgctcctgatactcggctaaaacatcaggtgctgccacttttgctttgagtgcactggggtcatgccaatgctcattcatatagtttagttggtaggcaggggggagaagttccgcgggcactttagcaccatcatgaaatgtgaattgagagctaccattgcgctgccgtttgaaggtaacatcatgttcctgttgcagcataaaagttaaatcatcaaggctatcacacattggataaacatcatcaatcaaggccattagtcgtcgctggttgtgagcattctcagccgtggtttctttgatgccttcggacgtgtaggaaccaatatcagataggattttgtcgcgaatattgcgctgctggtcaggcaaccgataccctctgtcttgaccacgcttcgttgtcgtgatttctagctgttcacatagctggtcaaacatttccggtgacgttgcacgagacgcaacaaatcgcagtcggcgacgcaactccgcgcggaatgattggtgaacatccttatcgtgaacaaagccatttttttcgagttgttcatcgcgtctcaaggacacggacaaaccatgttctgccgtcaaacgattactgatttccttgatccgattagccgtgatgtaaggttgactccggaacttctttaaggttgtcatcgagtatgcgttaaagatgatgtgattgtgaatatgatctttgtcaatgtgggtcgcaatgacaaactggtaatcgttgccaagcagttcgcgcatgagttgtaaaccgatctcgtgagcctcctccggagtgacgtgatcgtctggcgagaaagactgaatcaagtggtagcttttggctgcttgatgtagacgctgaccaccaacgtgacgaccaccaacgcgctcgtagttaccgttgtattcgtgcgacatattagctaacatttcaaactcaaacgcagcaaatggaggagcacaatggacgccttcgaccaacccaccatcacgagttttgagtgggtcactgatgtacttgattgcatccttggttgaacggttaatcgcgtgtattttcgtgattgccatttaagaccacccgttcataacgttggacaagatcaagacgatgcagcaagttgtcattgatgactgaaaagaggtcgtagacttcatttttaacttcggccacatcttctcctgtcaccttttcagtttcgtttgcacgatgagcaatttgatttaagttattaccgattctcgataactgctcgagcatctttttcgtgttcgtgaactcaacatgaactattttgctagttagcaacgagttgcgcgcataagttgtaaacggcgggttgcctgacttggcaattcttaggtttaagaagttcatttctccgtgattaaaagttacaagctttgctaagggacgtgacctattgcctgcatagtttcccatttttgattcactccttagtcgttattcataagtgacgcagctttgaaattgaaggttaaaaaagaacacaatctgtgaattccagattttgcttttttgacgtttttctactgtcgcgagatttgcaagtgtatatacacttgcgataaattgactcattatcagctccgctgatagtcaattttgttttgggggcacgcccccaatcccccgttattttgaaggggtctgcgacaccctccaaaatcaaagttcaaacccttctaagttctcattttggctcagccatttctgatattcttcgaccgaaaggtcgcttaattttcggatcgtttcgtcgtaacattcgagggtaaattctttctcaattggatctgtgatacccgtcaggtcattagaaatatcatcacgtactgttttaaccttttgtagaattgccggtggtgtatcttcgctcacagacttgcgatgaagcaagataatgtcacgatcaaattcgttcatttcatcaatggttttcatgttggtaattcctttcttgggtgatcaagggctggagaaaagcaagggctggagtgtcctcttgagtgagagtattcaacaaatgggttagcgtgttttctcctgcgttgcttgcaccagcccttgctctttttttgcgatgttttccgttgtcgcaatggttttagcgcgttctattttttgatcaagcgtcaacggtttctcacgaatcttttcaaggttttgatcgacggttttattgaatttttcggcggtggattggatacgcgttaagcttttggagagctgggaaagatccttatctttcgaccaaacagcaaggtaagggaacgtataatcactcgtgtcaattcccaaatgttgacaaacaataaacgcggtactttcagcttctaattccatggttgaacgatccaattttaacttcggatcacaatgtaattcactgtgcgcgagttcatgaatcaacgtcttaatggtttgcttctcgctcataccggaacgcaattggatttctttttggcgtgggcgagtaacacccttggtttcgctgctcggcatctcacggctaaagcccacatgaaagtcagttgcttgaacaagtttgctataaatagtggcataatttggtacttcaccagtcagttcatgcgtgaacattttgataggctcaccactggtctgagagtaatcaaagacggccgccggtcggcagaataccttggtctcttttacgcgtttgatggtgccatcaggttgccgaactctcttttcgtacttatgttcaccacccgccaatatcctgatacctttttcgtgttgattaacttgtcgatggtactgatttttccatgtgtgataccctgcaacaaaagtggcatgtgggttctgtaaatagatgagtaactggtttctgacactgtattgatgaaacccactgatgaactttaaatactctcgatactcgtcagtagagaagacttttttggcgccatcttgcgccaacgccagtaactctttggtactctttggtggttgcttttcttggcttgatgttggcatctttatcacgctttcctttatgagtttgtgctacgactttcgcccagtgttgagagggcatgctcaaatgttttaacggtttgcttagcttgttgtcgcttctctgctgattgctgtgggtcattggcaattttgttaaaggcatcaatgccagcagcatatttttcaccgacctcaattgcttgtttaatcgtcgaatccttaaggctgtcattgatctttttagccttgtcaaagtctttctgacgtacgtaaccaagagcaatcacttccgataaggttttgctctcgagttgctcgttaatcagctcggcggcatcgaattgcttagtgtgaacataagcaactgcgagttcgatttggcgctcttgagacagtgttacttgactgctcgttttgatgacctttggccaattatgctgtagatacgcaaggtcaaacgcggtctcagcttttgggtaggagcgttgaaacttaacaagttgtttaacgttactttgatctgtaaggactttacgcacatcgtcccgtcgattcggatacaacttacctgcttgaagatagtcccccttcttaatcagggaggtgtagcttgggggtgcgttgtacgcatcaacgactagttttgttccaaacaaaaaaccgcctgctattatcagcaaagcggcaatggttatcaggtgtttgagaaacgatcgactaacccttggtaatgaaattgaaggtaatttgatagcattttgtttcggttttttggcagtagttctacgtgatcgattgcttatcctttttggcgttgtatcagccgccaacgagtcggtaaaaactggttcagatgcaggttcggatgcagaatccggctcagtttcattcgctactgaaacgcctgttgctggttgtgaagttacctcttgccgctgagaaattaagtctgtgatcagatcttcaatttttccttcaatcggtagcttaatcttgacggaaaaggcaacttggtcacggtgataggccgtgatttggcagctaccatgttgcgctaaatcaaacaggtgatcactagccgcctgcaactgtgctagcccatcatcaaacggttgcgggtcggtagctaacgcgatcccctcttgattggtaatcttgatggtgtcagtctctttatcttttttccgacccacatcagtccctcctttccatgtcttttacatcatcattaatgaaacccaggggcttcatcatggctttcttttttaagtagcttcgcaatgtcgtcataagttagatggctctcagataacaatgcgtcaaccttatcggcttttaagactttgagatcacgcctagcggccgtcagttgttgctgcacctttttttgctgctcttctagttctttgatccggttctctttactcttgattcgcttttccagactcgtacttgccattattgatcgctcctttattagtcatgacttgcctgtgattgattgagacgatatagcgtgcacccaattatcttttgctgcttcatcggcaagcgcagcactaagtcgttttttattctgttgccatcgctggtgatagtgtatgctaaccgcgccattgcgattgtttcggaacctacttgtgtataagtaacctcgcgatcctggtacgtcaccttataagacagatccggaccaacacccgctttaccaatattagccggtggtacgatttgatcagctatcgctttggtcgatagcttctcaagctgatcgtgtcgtttttgttgatccgcacgatatccaaaaactaaatccgcaaaaacaaggactcttttatctaccttttttgattcaccgcctgttattgcgttcagatgcgtttttgtttcttgtaagacgctttgactgtccgaccaacgataccagcctacgaccatcaaaaccgttattagcacggcatacagcggtaatagccagtggcgccatctgtgttcttccatcgtcttcctccttttaccgtgggtgaatataggtgtaagctcccacgtttcctaacgtttgcaaatttggccctggttgctgcttgaagcccgttcctccctgagagatggtaattgtccctttatccgaatcaactgattctacatacgccacatgcccgtataccgggtctgcctgccaattaccaaccatttggcctgccgcaaagctcactaaggcaccctgttgaggggtatgatcgacactgaatcctgcggcggctgctgagctaccccagtcagcaccattgccccagttattagcagcccatccggatctggcttttgcccaccacgtacactgacctacaggataagaattaccaccattatgcagcgtgatattaccgattgagtcaccactcttgaatccaaaaatggctaaaagtttgttgacgttgggtacccagttaagattcagattgttagggtcattaatggcgccaataggtgcataggcggcgcctaacttctggacagtattcaaaccacgggtaacaactaagttatgcaacgtgttcccggtggcatcaataccagcttctagcgatggataggcaataatggttcccccgctcatctgaccactaggattattagcaccacgtactgctgcactggttccccaagaggactcagttcccatgatagcggcaattagagcgggattgacgcccgctttcttagcagcatcaattgagtagctttctttgtctgctaaaacgccattagaaaaatacttaacccaggcagcgtgaaatttaatagcatcgaaatcctgaccagttaaatcgcctccacttgtaactagtccataggtagtcgcatacgtgtatttcacatttggtaaagcaaaggcaggatttaattcttcctcaacgggtggcaaaggtgctgaacttgccgcaacggttgaactgaaagcggaggaagagttttttgaagataaacctggtgcctgagagacgctttctgaggtgcttgacaatgatgacgttgatgaagactcgtcaggagcgctctgctgcgtgattttgataagctgaagagtgatgttcttttcgctaattccgatttgatctcctttcttgatttcctggtttggtttaaccgtcacggctttgagcccaccggtcacggttcgtttaccatcagttgcgatcgtcacacttccatttgaacaggcagtcactgtgccggacatcacggccacaatcttttttccagtctcgcttgaaatccgaatgtgattagacatgttcttttgtccgccacgcattcgccaggcgtaccggtcgttgaccatgatcgttgcattctgatcttcaaagggcgatcctagaatctcttgcgttcgatattgacccacttgacccattgcatcaagacggtctttatcatcttgtgagagtgctttaggatgattcttctcccactcatcaaagctagacaaattgacggtcacagttttttcatcaaccgtcaccgacatcatctgatcatgtaactttttaatcttctgtttgaacgcatcatcaacggtgaagtcgtcatacttaatcgacaaataggccaattcgcggtcaaagtcagagattaattcaatcccatctgttgttgcttcctgaccattgataatcagtgagcgtccactcccgtccgtgttagccatactgtcaatgaccttcttagtggcatcagtgtccaactccgtaatgtaactgtaggcgtcagttaagggcttagaatcggctgtcgtcgacatcgtaggcaccaaccagccaaacatggaactcatcaaggcgatcagaccaaacacaagtcccactaataggagaatagccatcgacttgatcacgactggtagcatcagaatggcctttaacagatgcctgattgaactaataggatgacgccacgagaaggtagcaccctttaaagcacgctgcttcatcatttttctgacggatttacggctgtatgaagtttgaactggcttacctaacttttttgctagtcgcttgcctttacgattcctatggcgcttcaaccgagcttttaagcggctccctccttgcgttgtctttgacaacgtttggtaggttggatcgttttgctcttcattttgctgaccattggtagctgccagtacggtactcttcttagccgtttcaatcgcgccatgttgaagcgcttctctactacggtgccgaaagcgtttaacccaactagcctgtttctttttatgcttagcgttttgtgctaaaaggccacgcctaaactgccctttttttcggacaaaacgtttgccaccaaagccgccaacgccttgtatgcgatatttgttaccgcgcaaggctttcttaaaccggctcggatcactactgactaaagcgtctttagggtcatgatgctgcttattaagcagcatgtctttccaattattcgccactcacctcgcccccatcctcatgcagtttcttgcgggaaatatattgctccatgtcctctggtttcgtggacataatcttataaagcttggtctttttcggaaagtcattctcaaatggaatgacggcgtcacccgcaatcatcaagccatggccggagtcggcattggtgatatagccttcctcctgttcagacagatgcagcatttctgtgagctgatcacggtcattggcagcttggtcaagcaaaagcacaaattcactgttagacaacatgcggcgggcattatcactcagtagcaaggtttcaacgttttgcgtaatcccagtaggcaacgcgccccatttacgggcacgcgaccacagttcaaagaagtagttagatgcaaattcattgctcaagagcagctgcatttcatcaacgtaaatccacgtccgtttgcctgagttccggttctttgtaatccggttccagatttggtcaagcacaatcaacatacccattgaccgcaggttcttacctaaatccttgacgtcatagacaaccactgaattgtcgttgtctacgttcgtttgatgcgcaaaaacagacaacgacccttcaatatatggctcaagctcaagcgcaatttgctttccctcttcttcgggctgttgtttaagggtatttgatagatcaaccatcgttggcatcgctgtatgctgctcaaaatagcgttgatatgttaaccgacaagcacgatcaatcaaagtccggcgttcggctgacagcccgtttttaccaccgagtaacatgtcgcacatagacaaaatgaagtctgttttgaaaatgacagggtcttcatcgtcaccataatcttcattgatttccattggattgatatgcgcggcggcaccttgagagatcggtatgacttcgccacccagcgcttgtgcaacagctgaatactcacgctctggatcaataatcaacacttcggagtcagcatcacgtaaccgtacagacagcatttcctgcttgctggcaaatgacttaccagcaccgggacgacctaaaatcatgccgttaccagctttcaagttccgacgatccgcagtcactaggttttgagtaacttgattgacgccataaactagaccgctactgtcacttagctcttgagcagtaaatggtataaaaatagcggccgctgaggttgtcagtgtccgcgatactggtacataattttgtccccacatgagcacagaattaagggcttgttcttggagataatcgagatttgcaaattcgcagctatgtctacgaccggccgctttaacttgctcgataatctcatcaagctgttgatcggtctttccctgtgccatgacgaggaatgtcacgtcaaagagttgctggttatcgtcttgcatctgttggagcaagtcctcagcttcatcaaggctgtgcgtcaggttctccggtagaatatcaggatcataccccgctttcatcgccttctgctgctcatcagctttctgcttctgcataaagcctttcttcgtctgcaccatcttcatgccttttactggatcgatagggtgaatttgaatggcaatctccaagtccgccataatatccgttaaatcagtaatcagacgatcgctgatttcgggtggataatctcgcaagtacaacacttgtgcaacttggtcgcccattgtaaaacgattctttgcgtgtttgaaattgaagctggttggtgcaattactgagtgtgtcgtcaagccactatatttgagatcgtcatagtcaaaatgcaacacactgccaggcctcaatgtggcattagcaagttggagtcggcgcaaaccattcaacggacgcgctgttgatcccatttgatgaaaactggtaaccacattcgcctgtagttgattcaaactggttttagcacgttgtcggtcatcagcatgttgcgtaaaggttacgtacttctcctttaggagactcgtattgccgctttcaactctttctcgcatgatgtggttcatctcatcacggagcgcgttgagatcatcaggtcgatgcttgaaggacgtctcctgcatgaactggcgaatgtcctttcgcctattgatgatgttaatctgaacagtcgattcactgtcaaagccattaagaaactctgcatatttgctaaagatgtcactttgatgatcgcgatcgctaatttgatagttaatatcggagatcgcaacactcttagaaaaaacacctggtgccacttcacagaggccgtcttcatacatggcacgataagctaaactgtcttgagttgctcttgatggtgcatttttccgctcttgcttgccacgttcctttttgtggcgttgtaacaacttcaaggctttactatggcctgtcttctttgtattctttgatctttcctcggttcttgtgaacatgaaggctaacctcccttcgattttcataaattcttagcccgttcatttgttggtaatgcaagatgatgccgatatacttttctaatggcattccttttggcctgatccagccaaatgccaacactggcatatccaatgggattagcacattaccggcactatccattgaccagtgcaacttccagaccaggaaatagataatgcccgctgaatagatgaatgcgatcgtggcacagattagttgccgcaaatccattgtgcctatgatacgttctttgtaggtcttgatttctttgggtactctcacgcgtaaagccactgttactcactcctttcctacattgctgttgtcagcgacttcgcccatgagtttgtttggaagaccgcaaaaattagtagaattgaaaatcccatcaatgatgctatcaatggaaggacgccacttttatcgacattcgcaaatgctgttttcatgaggaatggatagaacagctgcaccatataaatgagggttccttgtatggatactgccatgaagctcttgaagaagtttttagcaatccctgaaaactcatgatggggcatggttgcaattggaataggtgacacagccaaaaacacgtacatctgtaaaaaccggccggtgacaacaacattaactaagactgtggcgagcatggtaatgagcatgacaaaaagaagaagcaccatgatcatcagcttcgtccaaaaaccttcttttactaagggactataaatatcatcaatgctaataatggtgcccatatgtccagaattcactaacttaccgataccctgcgatagcgtgatgctcacttgcataatggcattcatgaataaattcatgctatccattgcaatcttacaaaaagccaccttcactaaggcggctgaaatcagcctgacccctgcatctgatccacctcccatagcttctacttgttccgaaattcgatatagttctagcaacgcaaacaacgccagaatcatatatccgaccggcatcatcacattagtctggatcgttgttgcgaatccgtataagtccttgctccaccctgccaacgtttcggtaatgccgttagcctttgcggaaccagaaacggagttcaagataaacttaataaatcccttgatcgtgttatccacgcggttccgcctcctcacatcacgttagtgaaatagagttgaacaatgctccagcagcaatgattaaaccgccacctgcaatcgtccagataccgctttgaataccaggcccattgtgatccttcaaagcaccaccaagaccaaccaagccccaagcggcgtaaatagaaccacctgcaatagcaaattttgacattaaagaaatagcttgagataaaacgttcatgtgttgttcctccttttttatcgaaacgtgtctaatagattgacatcagctaggatatccgaatccgcttcgggttcgttctccttgaccgcatcattcttggtttcctcttgactgatattagccaggaaatctgactctgctttggattcttctgtttctacctcacctcctttgttgttctcgcttttgagttgaggctgatagacatagtctgagtgatccatttgaagctctttgtaccgtggatgtttttccaacgaatatttttgcgacaaaaatggcggcaccccgcggagcatgtaaatactctggtcgccgccaattcggtcgacttcatcaggcgctaacaaatcacgcgcgattttgtcgtagttttggttgaatgagccattattgcctttggattcaccataacgctgaacgtctatcgttcctttgccaagaatcttggaaatgtactgagcggtttcactgtcgtgtccgccaaggtacagcagtgaatccgaggcaccgagaatcgcttggtatgactttggataacgttctttgagctggctgagttcctgcacaattggcacacagaaaatgccccgtgaacgcaaggtattgatacgcttgtcaaattgtggaatctgtccactgtttgcaaactcgtcctgccaacaaacgactgtttcattaagccggccgttcgcctgatggtcagcatgttctaccaaagtagtaaacaatgtttggtaaaccaagctgaccaaaaaattaaacgtttcgctttgatcaggtaagatcagaaacagaattcgtttttcatctcctaatttttcaagttctagtgtgtcgtcactggtaatatcaataatgctaggcacatcaaacggtgctaaacgaacaccaagtgaaatgacgatactcatggctgttttggctggtgcgagcttgaagataccatattgtttaagcccaaacgcatccgggaaatcctttttgaagtcttcaaatattaggtcaagtggcgttgtgttaccgccagcatcttcctcaattgttgctgctctgactaagtccaaaacattgggtacgttggcaacaacacggttgtcaggattgccagactctaaacgtaaataatcaaacaaggcttgcatgagcgctttttcgcctttatcaaagaacggatcgcttttactttgcggtgaggttgtgttttgcatgatcgcattcacaacttcaatgacgtcatcctcattgttgatataagcgaatacattgaaatgatcagtgtgtttgcgagtcaccaaatcaaagaccttaatctgatagccagacttctcaaaaaagttacccacccatctaagcgtctgtcctttggtatcagtaacaacataggagctggaacgctgcaatagattaggtacgacaacggttctggttttaccagaaccagcacccccgatgaccgtcacaaattgatttcgctgcagtttcattggccgtttatgatccaagtcattcaaatacagcttttccgtggccgtcataatcaggttgttatctgggtttttggtatcctcaaatgggagaatatccttatgagtcccccattttgcgctcccgtgttcctcacctggtcgataatttttcttattggtcaaggcatataaaactaccagcgctacaactgccagtagaataagaccacctaggaatggtttgccattgaaagtcggcggccaccaagaaaccttgccaagattgttagacacgtacagtattttgtcgagtatagacttagcgtctttgtcctggacgttatagacggctcgcgttaaaccactgccaacgatatataccgcagaactaccaatagccacaaggccgaaattccagactaggtttttcgctttttctttgtccatcagcgctcacgttccttgctacgctgtcgcggctttttctctttttgattgcgttcctttgcagtcactttagccttttcaatcttttcttggagtgtttggccgtgttcgggtgttttgtcaaagtccttaacaaccttctgcaaaacaagttgaactcggtctacatcagcacccttaaaaaagacatggtacatgcccgtttccttgtctcggcggatagaaaagtcgacgtgatacttcttaaactcctttccgagcgcgcgcagatcggttttactaatatccacgtgttctagcgcaccctttttttgcaattccgcaattttttgtttaccagttgtccgctgatgatggattgcttgcttactcatatccattgttttacttggtaacttgactgccagtgctttaaggagtgcttgcgcggacaaggtacttaaccgtagaacatactctgctgcttggttgtccatttgattcacctaccctttttagaccgtttcactgaccgttacggtcagattttgcgttgttgcttggccgaatttatccgttacggtataagtcagcacgtaactaccaggcttactggtatcaacggaaccgtcgacatcaacggtgacatcaccataaggactggtagccgtaacactagcctttggctcaaattgatcgccaacattgagttttgtcggtactttagacagatcaagggttggcttgtcagccacaacgttgatagttacttgcttgacggtcttctgtccaaacttgtcagtagcagtataagcaagctcatagctgccaggcttgctggtgtcaactgatccatctacagccacaatcacatcaccataagggctaaccgctgtgacattggccttcgggttaaactggtctcccaccttgagctccgttggaaccttcgacacatcaagcgtcggtgccgtggcaaacaccgtaaccgaacgtttcagcgttgtcacagtgccattcttatcagtgacggcataagttagttcgtaatcgccaggtttgctggtatcaacgtttcctgcaaccttgatttccgttgtgaggtcaccatcttgataatcatcggccgtaacgccttgcaacgggtcaaaggcatgaccaacctcagtttgattattccctgagacatgaataacgggagcgtcattagtcacgacaacatcacgcgtaacactcgttttgtgtcctgcgctgtctgtcacttggtaggtcacttgataagttccctctgtgttaatatccactgtgtttgcatatacgaccttattggtcaaatcaccatcttcgacatcatgagcacttacaccttccatcaaattgaaggatttctgacctaaatgcagatgcaggtcatcagcaaaggatatggtcggggcttggtcaactggtgctggtgttggattcggatctggcgttgggtttggctctggtgttggcgttggattcggatctggcgtcgggtttggctctggtattggttccggcgctggatttggtgttggactaggttccaccgatggggtcgtcttggtatcagtcgtctgtttatctgttaacggtttaggttcaggcgttgttcctgtattgtctgccgcttttggcgtcttctgttccgctgttgcctgatctgccaacgaaataaggctttgactattactcgactcaagctgtttgctcaaatcatttttactgaaaggaaaggcgactactgtttgatcacttttatcgctattcggcagttccggagccagggcatcttttatggtctgatcggctttgttagaggaaggttttgtgttcttctgtttttgctcgaccttttttgacggcgtccgccattgcttagatggagtgctacttttcttgactgattgcgaagcgggggcagcgtttaactgataagccgtatagccgccgcctcccaagacaatcgcacttatcagcaagattgctgctgttttctttttgttgtttgccatgaatgaatcctcctttttccgcattaatatgcttcaacaaatcgcttaaactcgttctgagggcgaacataagccacgatcacgcgctctttgcttggtaacacccgcacgatctcaccaatacaagttgtatctggcagaataggccaaccggtttcgatacttaacacggcatgccgtagtttcagcatcaatgccttctcctttgggggtgggaatctgatttcaagaagaccattgtgccgcttagcttccttgatgtcttttgtttgaagaaccaaattgaacatatgatcacctcttatattcagcaaaaagactggcaaggttgtaggcgtcatgtacgaagatgtggactacaaactagtgccaatcaaacaggaggacgaaaaatgacaacgccaaggagtgaacaagaaacgattcttagctatgatcgggaacttgatcagtggcactactattcagacattccaaagcacaatcgtaaatggcgtgatttggtatctgaaacgcacacggagacaagcgaaaacggagacattacagttttggaaggaactatcaacggaagcgtatcgatccgaaaacacacagttatgtcggaggaaacaagagcaaaagtggccgctcgactaaaggcatatcgggacaagaaagtagaggacgaaaaatgagcgaagaaaaactgtacgcggtaaagagcgatgaaggcgaatacttggatagtacacctcgttggaacgataaggcaggaactgctttcaaaagcagtgctaccacgctagcgtgggctaaaatttatgacggccacgttgtcactttgattgaggagcctgaaaaggtagtcctaaccaaagaacaagccgaaatcgttgaaggggcaaacaagtctcaatatccagcaacctatatttctaactatactaatgcttatgacgtcgaggaaagcctactgatgaatgcttacgtcaacggatacaccgtggcaaaggagaagaaatacaacgtcaaggtgccaaaaaagtggagtggtgatgataagcactattggacgaagatacaagatggatcactgatgttgatgtgggagtgtttaagcaacaaagactacatgatacccaaccagcagttcacgctcactgagatcgaacattacggcttgcaagactgcgagaaagaagaggtgactgacgatgctgattaatatggacaaaggatcatattctcttaacaccgataacgttgaagcgttaggccactattctggcgttaggcatggagaaaaagcctattttgcagatgttgtttcgggtaaccgctggagcatgacaaaaaaagaccatgatcgaatcgtggccgccatgagcaacaaagaggtgactgacgatgagcaatgagcaaagtttcgacggggacggtttcgattggttaattggacgccatatcgtgaaggttgaagatgcagttgcgccagcggacacgtatatggagaccggtggctacttgttgacttgcgatgatggcacacaactgctgacatacgagaacgaaggatgtgggggctgtggaaatgggtggagcgatttgccagacttgtcactgttagccaaccacgataacgcaatcaccaacgttgaagcagtgtatgacaaagatgaaacaacatttcgcttgtttatctactactctgatgagcgcttcgatgtgggaagtggcgatgatggttatggtaacggatactacggcggtggtttctacctacgagtaataaagcctgttaaggagaaaagcgatgaactatgagacgaagcggaacgtgttcggacagctactcaatgcatatcagaatctaagtgtgaaagacatcgaaatgcatgacgaaaactaccgtgaaaatatcacaacaccatggaatattgtgtatgatgccgccttgccagatgacctgccggtgattccagaactgattggtaaatacctaaagatgtggaagcatgatcatggagacttatttcaggcgtttgatgagggcacatcagcgagcttagatggcactaaatgggaaagcgtgcaagattggttcagcgatgccaaagatagctttgacacttttgcccgtgcatgggtgctaggtgtctggcgcgttgaggaaacaggcgaaatcgtgaaattggaggtatgagaaatgaacttacatgagcaattcaaaggtggcttcacacatggatcagggattcgaactgaggaaattctacacgatgatcgtgttacaaacgaacatgtgcttcagtttctaatgtatgatgctaacctctatcctttccctaatctaagtacttggaaaccaaaaaactaggcaagcggtcatcgactttgttaaagagcgagtttccaaagtcaatgctgatgtttgggtagatgatgtgcaaatcaaaaaatatgaggcggagaaatgaaacgagagattaagttcagggagaatccggagctgctggaggggaaacaatgaaaaatggaccttaccgtttcatgtcatggcttagtttcatgttagctctggcgtcttcatttttgcctgaaaaatatatgaaattcggtttttacaaaacgtttattttcctaatgctacttgcaatattgattgaactttgggacatcgcggatgcaatcagggagggaaagcaatgaagaaacgcgatagagtcaacaaaaagtttgttagtaaagcacaccgaactatgagaatactactcacgcggatgtcgccactggaacgagaattttgcagaactgccagttttgatatttactattatggttttggaaaaagatggagagcaattgaacgatcatggcgaaaaatgatggaagcaaagcaatgattgccgtcatgccgataatctcaggtgctgcaatgtggatgtgggctaactggaaaactaagtaggagatgaatgatttggacagcaaacgagcattggccgaaaacattaggaagaatatatacgatctgaacatgacacaagccaaatatgcaaaagagatcgctttcggataaatcaattctcttatgtttctgtccgaaattctagtacagacccatttggtttggagcataattttggctagtacatgatcagaatggcttaatcacatttttaactgataattcgcctgctcatatcctgagcaacatgttagaacggcaagcaaagaacagctaggtgactcgtttaaaataaacagtgactcaatcttcaactgcattattatcaaccactgataggcactgaatactgtgagattcgcacacccttcaggctagtagtttcaacaataggagaccttagtgttcaggagcttttatcttgaagttatgtaccaaccgcggccaaacatgctcgtctgcccatgcaatgatgatgccgttgccgagaaatgagaacaatgtcgcgatattgatgcctaagagcttacctgtcgcgatccacgcaactacgatcacgatgattggggggataaaatcagtaatctgggaagcagtggcgttgcctttaaaatagagaaatctcaggatattggtggtgtcatcgtttggatgcatgatgatgttggcgcgttgatagagtgaaatcgccacacaaaaacagaagaccccgaagcaggagacgaaaatgcgcgccaccattggccagttgccaagtccaagccatgtgaatagccaagtaaagacattgacaaaatagctgaagaacagtgtataaattacttcgccaatcaaccgcggccaatcccagcgcctaattaacaacagattcgatagcgcgttcagcaccccaaaggtaaacagtaccgcgccaatattccacccttgccagtcattcaagttaatggcggccgccgtccataagccactacccatagccccaacaatacaaaggccatttccggcagcgttcagaactaagccaaccatcaaaccgatccagcgttccgttttcgtatttttaatgcgatgaccttctttctgtcaatatacttgtcaaaagcatattgcctattataaacgcccagccccgctgatgaaaatccgtcagtgagactgggcgtttatttttttgacatactgcttcttttaccggtcgcacctgcgctaagttcgcagtccgattaaagttccccgcctttttcaaagcttggtgtcattttctccgcgcggatgcaaaccagctggtgtaagaggtattgtaggtcattcgtgatcgtcgctgccgtttcggcgttcaacgcatcatgccacgctggcagatcttctggtttgacatcggcaaaagccgcatcccccttagccacagcggcacggccggcagcgaaaccaaacttgcgactttcagacacggcgaactcggcatcccagtcatgttctgcaaacaacggatcagccaccatagcgattagcttgttgagccaatagaagctatcggttgaacttttatcaaccggcgtgtactggaaattctccggtgtcgttgtgcaattggcgaaaaatggcaccgggctgttgaaaatattaacgccttccgcaagccagtgaatggcagcgtgactcttcggcatatttggccgaatttgtagaatatgcatttcttgattgcgattcatgccaatcggacgatagcgccgccgcgtctcaggcgtgccggtctgcccgtaaggatcaaagtcggtggcttggtaatgactgctcaataccatcgctacatcttcgactgaaatcaaatgactcgggacacgactaaacggcatcgtccgactttcaggatcttgatcaatttcaggattcagcattttctgggcataccagacccgcggcgtattgtaatagtgatcggcctgcgtatcttcaccgaaaatgtatcgaaaattgaacccttcctttgctttattcaaatgatacttagctgcaaagtctttgagatcagcactgtacttgtaatgttccggtgcctgaaaatcaatctcctgaataccagtttgattcggagccagcacataacgatcatcaggaatccgttccgccgcccagtgatggccgccaactgtttcaaaataccagatttcgttagcatcagaaaaggcgatcccattactttcgcaggtaccatacttggtgaccaactcgcccaggcgttcgacaccttcgcgagcgttgtgaatataaggcaataccaccgtcaacatggcctcttcaccaataccgtccggctcaagcgggtccaatcccagcattgtggtgtttgtgaactcagtttcagttgcactcatcgccacattctcgctgttgataccagcttcaccccaagtcccatgactttgatcagcaaccggcgtgcaagtatactgcaacggtgtttgcggtaaatccaactgaaacccattgaatgtcgatacataccgttgcggctgatcagccggctgcacaacaatgaaacgcttcggattaatcccaccgctagcatcctcatttcgcgtaatcatcgtcgatccatcaaccgacgcctttttaccaacaagcaacgctgtacaactcaagtgattcacaaactgatccatagccacgcttcctttcagatgactttatgatagcactggttcgtactaatgatgctgaaaagtaaaagggagaggcgaacgtggtaagttagatggtcatttttggaatgtttggcattttatgatttagtcgatattgttgcttgtttaaacgtttgacatgttgaacatatggggttaaaatcggttcgtagcatgaattatacttctggctttttagtcgcaagggggaaaatcaaaatggaatcaaataatttagcgtctcagatcacaaaatttgttggagaaaagcaccgtattgttaaagcggaagaaatttacactgcttttaaagaagaattttctgacggacaaatcgctggcgtattacggcgacttcggacaaccggtcgtttggtttctccaaaacgtggatattacgaaaacactaagtctagtaatgttctggcagagttagtcaaagatatttctaacctaattcaaaagtacaatacttctgtccccatcaccgttttcaatggcctcaatgcagcagacagaaaaaagtatacagagacacttgataaattaatggcatgtcaaaagtcaattgagagctaagatcaaatagcgacttagcttaaggggcttatgagaaagatttaagctcataaagctctcttttcggttcaagaaatgggcgttttttcctatactaaaccttcgtcgaaccaagtacttaaactgatcatcggcaccatcattggcctttttgtgctcggtcacctaacaccaacactggcagtcagaacgcagcttttgatgcatggatactttcaaagtgccttttgcgcgaagattgagcggtcatccgaaaatgcttatgctcctgcgtatagtcatgacaatgatggcactgtctattacgttaagccttcaccggtttcccaagaagaactcaaaatgacgagtgcccggccgaatcgttacgctgttcagacatttggtttgagctttgccaccatgacttggtataactgatgtcaattgaacgcaggtccactctccttcgtgacggcaatacttgctgttatcacaatgactatggctctggttcagccactatatactaggacatcagcgccaataacactcgctgcccttacgccgaaatttgatgagtcaactgtcccctttttaaataaatcgacactaaaagccgctcgatcagcgaatcgagcggcttttgcttgctacaatgacttatttaacaaaccctaacgtctgcgcaatcaggtaaaggttcaaaatgatcagaaccccactgatgaaccatgctgtccacttcacccaagcacggttggcgaactcacccatgatttttttatcactagtgtagagcactagcgggatgacggcgaatggtaacgcgatactgaggaagacctgcgagaaggtcaacaggttttcgattttggcttcgttgccatggtagtaaatcgcgaagatgagcactggggtcacggacatgagccgagtcaaaagtcgttgggcccagagcggcattttcaaatgaatgaagccttccatgataatctgaccggcaagtgttcctgtaatcgtggagctttggccggatgcgagcagcgcaaccgcgaacaacatggaaagcatcgggctggcgatcgcaccgacgatctgggaattgcttagtgcgttgaaaagatcaacgaagcggccaactgagctacttgtgccgaagaacagcgctgcgcccagaatcagcagcagtgagttcacaatgaaggccatggtcagttgcaggttggaatcaatggttgagaacttaatcgcctttttgacttcttcgtgcttcgtgcgatcaatttttcgtgtttgcgaaatcgaggagccaaggaacaggtcatgcggcatcaccgtggcaccaacaatccccaaagagagatagagcattgatttgttggtcacgatatccgcgtgtggcagatagcctttcagcagttccgggacatttggttgcgcgagaatcacttcataagcgaaaaccaataagataaccagcactaaggtcgcaacaaccgcctcaatcttacggaaaccgaggcgcatgagcagtaagaggatcagcacatcagcggtcgtgataatgatgccgacaatcagcggcatgttgaacagtaacttcaaggcaatggcagagccaatgatttcggcgatatcagtcgccataatcgcaagttctgtaatgacccaaagaaaaccgcccatcgctttgctggtgtgatcacgtgtcatctgcgctaaatctctgccggtcacaatgccaagacgagccgccatggcttgcagcagcatcgcaatcagactggaaataagaatgacagatagcaaagaatatttaaatgaagcgccaccggcaatactggtgatccagttaccaggatccatatacccaacggcaactaggatgcctgggccagtgtaagctgctaaagttttccaaaagcccgcattgtgcggtacttcaacactgccattcacttcatcaagacttttgcttggcgtatcttcgaagtgaataatgtgttcgcgttttgattttttatcttctgatgccattgtgtgaagccctctttccattggcttgaaatttgggtctaatttgagtatttactcaacatcgtccggcataaatatacacccttttagatacaggtcaagaaaaaggttaggcttgcttaacttattcgccaaaatcgctattggggcaacaggctgcgtgctataatgggaccaacttgttgactttaagttttcactcaaacccatgagaagggatcctgacctatggccagctcagcagacaacatcttgcatcagacgcaactttttaccaatttcaccgctaagcagaaactcatcatcattgcggccattgaggtttttgctgaaaaaggatacgccgcggccagtaccaaagaaattgctttgcgagctggggtggccgaggggaatatttacagccgctttaccaataaacgcggcttgctcaatgccatcatcgcaccggtgctgagtcaaatgttccctgatgagttggacgatttcattaagtctcgcctccatcaggactatgtctcattggaaactttcttgacggtgttaataaaggatcgcgtgacttttttaaaagataatgcccagatcatcaaaattgtactgtcggaattactgaatgatacgcaggtgcgggctcaggtcgttgatggtttcaccacccaatattgggaatccatgacacatgacctgaacgcgatggtaaagcgcggtttgattgttgattggccgcttgaagatattctgcgaacaatgtggtcgatgaccggtggcttgattttaggcttcttgtattttgaccaacctttggacgccaataccgtcaatcacgcgatcaccgccgctatcaaggccttatcgccgaactagccacctgctgcttaccgctcacttctgttttgaaaaggacttttgctaatgccaacccctactgaaacctggcgtccggtcacgcgcgacgatgcgtcaggactgacacaattacaaattgattttggtatcaccgatgaaatgctgggatacgcccgtgacgattacgagcaaccgcatatggaatacgatgcagagagtgatacttttctgctgatttataatgtgcctagcgataaacctgataccgatggctatctttctgaacccatggcgtttctcgtcaccgatgaccgcctcatcacagttggcagccatgatgtgaacaataccaatgccgccatcgccaaaacggttgcgcgatttggcagcgaatcggtgtacagccttttgtggcaatgcctgcttgctatcaccgataattttgtcacactggtgaagcagcaagacgccactcgtcgtcaaattgccacacgcttacgcgaacacacgaccaaaaaagacttgttgaaaatcgccgaacttgccttgagtgctgatttcttggttcgagcaacgatccaaaatgccgctgttttgaaacagatccacgcgtcaacccgtgtgcctggcatcactggcacacaaggggaacaactggaggatgtcatcattgaagccgatcagattgcggaaatgatgaacttgtcttcccacaccttggatcacttaacggatagctacaacaccgttttgaataataacttgaatgacatcatgcggttcatgacagtatggtcgattttactcaccgtgccgaccatcgtttctggcttttttggcatgaacgtgcccctgcctttcgcccacgaaccactcggctggattatcacgattatcatcgcggccatcttgtggatcgctttgggattactgcttaatcggtacattcggaaaaattgaacaatctaactcagccgtgccaaactccgcaatctccggcatggcactggggtctttaaagctcactaggtcattcatgggaaagaaaagaacgtttcccattatgcgaaaaattattcgcctttacttagctttgctttggcgctgaagccggcgtccgattgtattattcaaggttcgtgctcctaaaccgagggcaatcacaacgagaatccacttcggcagcagcaagcccaccagaatgtagacaatggcgacgagcaccatgagtgataccgcgcgatactcttcccaatcatgggcatttaagttttcttttttcggtcgttcgccaatgacggatcggaacaaaataaattgaaacaaatcgaccataaaaataatgatggcaaataatgttgcactgatccgactacctggatggtcaccgatgaaactggtcgcaaatggcactaaacagatgaacacaagatagaaaaaatttaatactaagaaattagtgctcggttgcgtaacggtatgtagtagttcttggtgaaatgtccagtattggccgaccaccgcaaaactgataaagtaaatgacgacagagaaaccagtcgcataaagatctgctatggtcagtgttttaggcaccttaatgtccaacaccattaatgtcagcacaaccgcaaaaacgccgtcagaaatggcatcaagtcggctcttactattttcaaacatgtgcatctgtcccttcttcgctttttatcataaccccaaatgacggtgctttagcgtatgattgacctatcaacgtttgccagcgtaaaaaaactgtgagtgccccatggtcacagtccgacctgacacacggcatttctaaatgcgctagatgacgtccattcaaattcttggaggagcaatatgaatttttcgatctttgcctttctactgattgccgggatcggtgctggactaacgtctactttagctggcttggcttcactggtttcgtacccagccttgcttgcaattggcgtgccgccggtcattgctaacgtcacaaataccgcagcactcgtttttactggggttggctcggctgtatcctcactgccagaactccgtggccgcggtaaatttctctggcggctgatcttactggtatcacttggtagtatttttggcagtgccttgttgctgatcgccccggcagccacatttgaaaaagttgtgcctttcttcatcattgccgcgggcctgttactactcttcagcggccgactgccaactcaagaacatcgtcccggagaacctgcacgcaccttaacatttggacaagaagccgctcaaaccatcgtcatttttgttactggcgcctatgctggctatttcggcgccgctgcgggtgtggtcatgctggcaaccttaaccttgaccgttgatcaacctttcatcgtctccaattccatgaagaatttgaccggattcgccgccaatgccatcgccaccgtcatttacgccttcaccaccaaaattgaatggctcatggtcatcccgctcggcatcggtctgttcatcggtggctatatcggccccatcattgcccgccgcctgccggttcaactgttacgattcatcatcgcagccttagcctttttgttagccgccaagttatttgcgcaggcttatctttaggaataggtcaaaaagggatacccggttttgtcccttcaaagcaaacgattccttggcgaattgtcgtgatacgagtacctataaattaaaagactcagccagatcagagcataggttgctcatacgccgagtcttttttggtctatacatttgtatcctcaaaacagcttcatcaacattaagtacagcaaatctagttgccgctgcagtgatcattgctggtaccttaatgctagtgcctgtttagtataaaatagaattggttaaaagaatgcgcttgctactgtattgaaatacatgagaacacaaaagagcattgctagcaaaaataatagtccaatgatgttgatttgattacgacgaacactggcattgggcttattcgattcaaagaagtcatgaaataagagatttcgatcctctctacttttcaaactttgatacgccttcatttggagtatcatttttttccggtcaattatttgagccaaaattaaacataagatgccaactgacataaataatatagtgacaaaaattgaacttgtattggcttgttttaaagaaacattcaatcgttgaaggaaaagaaccatgcctataaagtaagatcccagtcccatgaaggtgctgaacttaaattctcgagataaactagctatttgataattatcagtttctttaaatctatacgggttccgaagcgagtctttaaatatctttgtcaataatctatcgtgaagattaaatttatatcttatcgagagtgagtaaagaagacaacaaaagcttgcgaaaagaaatagaatgacaaaagctggccaaatatacagtgaaagcataggcaccactgcctttcagtagacatcacagatatttacaaactatctcggttcaaatcatttaaactttctcaatttaaaactctaaaaatcgcttggtttctttgaaacaaggtctcaaaagtctttcactttaaggaacttggcgaatcggccaaataaaagaagagacagagaacgatctctgctattagccaaaattcggaaacgccaagattgcgattaggacaaaaagcacgctccataagaaaattaagttaatgatacctagatttagcattctcaagccaattgaaggtgtttgcccttcaaaaaatttccttattggtttagaaatctcttctgtcttttttaaaagttggtactccttcatctggagcgtcaactttttttggttgattgcataggatacaatgcccaaaacaataataaaggagaagacgccaatagccaacaatgaattgtctatcgtaccggtggaaatagtttctgtaagaatgatcataaggaagcctaacgtagcaacggcacttaaagcgtaaccaactagaacgatctttgcccaatgtgccaacacacttatttgaggattgctgctttctccaaatcgataagggctggtagcatcacttttaaaagcccgtcttaggctcatagggttatatttaaacctatatctcaaataatacgtataagttgacaaaccgatacttataaaaagtaacgagaagatcacaaaaatccaattctccgccaaagtcacatttttcactcacttttcattagatttctaacatctgaaggcattgtatgattcagttcttttaaaaagacaagtaataaccgacaatcataaaaaacaatgaggctgttgaaccaaaatttttagaagttgcccaagattcttctgtccattatgtatgagctatcagcaactagctacaaaaaaacttgattcaacaaccaaccttttatctgatttcgctactcagaacagccacaccgttgaaccatgtcaccgcggacaaagccaataacccaatcaataaaacggtgagcgcactgaacttatcggggataactgccgcagtcatcactaaggccgcagctaaggccgtcagttggtctaaacgaatatccccttgctttttctgccatgcttgccacgccgttaataacatcaaaaagccgtatacagcaattgccacacgtattgagataactgccattggcctaaccttcttgcgcttgtaacacctgatccatcacatgcaagacgccgaattcatcgttactccgcgtgcgatatttggcatgttgcgccatgccttgcgttgcattggccatgatgtaactgtagccaaccgtttcgagcattggaatatcattatcataatcgccaaacgccatcatttgtgtcgtaggaatatcaaaatgacgactcaaaattcgcatgccgcgtcctttgttaacgccgaggttctgaatatctagccaagtctcaccgctgacttgaacggtataattcttgccaaatactgggcggaaataacgttcggaatttttgcggctgtctttatttggaaaataaatcgtcaccttatcaactgccagcgactgcgttaacaaatccggcacctttttcaattggtgataaaacggcaatagggctggtgaatattgggcatcagcagcattaatatatgcagcgtccaaggcacacaggacaggaacaccgtctgttttcgtcatgataaattgcacgatctcacgatatttttcctcgggaattaggcttttaccaattaattgaccgtgcgaataaacaaggccgccgttatcgcagaccatcgaaattcggtcactaaagtgtggggaagtttcctgtagcgtataaagcggccgtccactagccacggcaaactcaatgccagcctcgccaaggcgatgaagataacgatcaaaatgcggcggcaggatccctgcacttgtcagtaaagtctggtccatgtcactcgcaattaattttacattctgcatgctaattcccctatattatttgtctaatttcacttgctataatttaatgcggtgcgcctttagtcacgacattttcgatcaccgccgcaatctgttcagaacgctcaaccgtgccatttttcaaccattttgtcagcacgccaattgccccgtcaatgaagaacgcgtagtagtaagtgagaacacttttgtcggtctcaccataccacgattgatagctggtttctgttttttgtcgaattggatccgttatcttcttcaacaccacgctatcaggattattcaaaataatcgctgctgcttgcggctgattggcaatgacatttaaaatcggcaccaaccatgtggtcatatcgtttattttaaccgttagataaggccgaattgcctcgaccaaatccatttcaatgcgttcgaacaaatcgcgtggagattgaaaatgtaagtaaaacgtcccgcgattcaaatctgcctgtcgacaaagctcagtcaccgtgacctcatccaatggtttcgtcgccaaaatatgcaacaaagcgtctttaaatcgatccatcgtatactgaacccgccgattatccttcgtccccgacatcgtcatcctccgaacatcatttgaacaagttgtccatttaaaaacaaaacgaccatttctgtccttgaacggccggtttaaatctaacataatgttatgaaatggacaatgtgttgaagagcgtgagcaggcgcggttagaagagcgtgaacaggcccgcttagaaaccggagcataagcggcctatggctgggctttggccatttaggcttgaggtccttatgtgcaggtttctgggcctgtgaacgcgtctaagaacttcacacattgctcaccatccatgctaggaggcaatcatggcatatatcgaagtcaaacatgaatcaaaacgttacaaaatgggcgaaaccatcattacagcaaataacgacattaattttacggctgatcaaggcaaattaaccgtgattcttggtcccagcggtgccggtaaatcaaccttgctcaatatcctcggtggcatggactcccccactgaaggcgaggtatggattgacggcaccgatattgcgactttttctgatcgtcaactgaccgcttttcgccggcataatgttggcttcgtgttccagttttacaatctgattccgaacctgacaacaagggaaaatgttgaactggctggctcaattgtcaaagatgccttggatccgacaactgttttaaggcaagtcggcctaggtgcgcgactagataattttccgtcacagctgtctggcggtgagcaacaacgggtggccattgctcgggcgttggcgaaaaatccgaagctgctgctttgtgatgaaccaactggtgccttggattatcgaaccggcaaacaagtcttgcagttgttacaggatgccagtcgtaaagatcataaaaccgtcatgatcattacccataatgcagcgattgccaaaatggctgaccggatcatcgaaatcaatgatgcgcaggttcgcagtattcatgatgaaccgcagccaacgcctgtcgcagacattgagtggtaggtgagtaacgtcatgaaaccactaactaaaaatctttggcgtaacattcgcgactctttgggccggtttatcgccattgtcattattatcatgctaggtgtcctgctgttcgtcggcgtcaaggccacgggcccggcacttaaggattctctaaacaccacggtgaaagccgatcatctggctgatagtcagttgctggcaacgactggtgtcagtaaggctcaagttaaagccgctgaatcagttagcggcgtgcaggcagaagccgtcaagtttaagtatgtcatcggcggccgcgccagcgatgttgttgccctttacggctatcaaaaagggacaaccatcaatcgactgcatctcaccagcggacagctgccaacgcaagccaatcagattgtcctcgacacggcagctaaaaaaagcggctatcaacttggtcaaacttacaccttcaccggcggcagcaagcttgctcgacgtacttttaaaattagcggttttgctgattcgccagcctacatcgaagacactagtcgtgggtcagcgaatatcggtgatggcaccgtgcgttattttgcctacatcccagcaagtcagatgaagatgccggtcgcctcgcagctcaacattcgcttcccagctttgcaaacacgcgataccttcagcaaccgttacaaggacgccgttgccacaaaaatgaagttggtgaaacagcgcgtgaaggcgcaaggcgaaaaggatctgcgagcagcagtatatgccaacattgttaaaaccgctacggccaaagctcaagcacaattagcggcgtcaggcatgccggcagccgccgttgctgcagctgccgatcaagctatcaagccgcaactatcaacctttcagcaacaggccactgtcacagctcgcaaacaactgtcaaccagcctcacatggcaaactcgggaagatctgcctggctttggcgattacggcggttctgctgatcgaattgccgccattgccaatgttttcccagttttcttctttcttgtcgctgcgctgattactttcaccacggtcagtcgcatggtcgaagaagcccgcgcgcaaatcggcacattcaaggcgcttggttacggcaaatgggcgattgcgcgaaattacctcgcctatgctgccttagctggtttattaggtgggatcatcggggtttttgctggcaacttgagcattccgcgcattgttttgagcttgtataaaaattacattccgctccaacaagtcgtctccttgcaatggccgttgatcgccttgtcattgttattggcgctgatcgcaacattaggggccgccgccattgtggtccgcaatgaactaaccgaaaagccggctgccttgatgcgtccgcgagtaccgaaatcagccaaacgcattttgctggagcggatcacgccgctttggtcgcgtctgtcttttaaccaaaaagtcagctatcgtaatcttttccgatacaaatcacggctggtgatgaccattcttgggattgctggcggcaccgccttgatcctcaccgggtttggcatcaaagactcaatcactgctactggtgttcaacagtatggtgatgtcatccattatcaagccattgtgcgattggctgatggcaaaaagccagctgcggcccgcgacattctggctaaaagcaaagcttatcgcagcgcgggcacggttagcggcgcggtggctaagctcagtgctaaaggccatagcctgagcgatgttaatttgtttgccccagcaaacggcaacgatcttgaaccttatgtcagtctccgttcaacggcgtcaaatcgcaaactgaccttgccgcgccacggtatcgtgatcaccagcaaactggctaaggcactcaacgtgacaacgggcgatacccttaaagtcgccacaactaatggtcagagcaagcgattcacaattaaaggcattgctaagaattacgttggccattttggctatctctccaacaccgcttatcaccagctcgctggtaatagtgcgaaaccaaacaccttgctagtccgcttgcagccccaaagcagcaaacaaaatgatcgactcgctaagcaattgctcaatcatcacgcgattgtcgggattagtttcacgacgacagcaaagaaaacgttaagcaatatgagcggtatgttagatcctattgttttgatttttattctgctcagtgcggttttgtcattcgtggtcttgtacaatctgaataacatcaacgtttcggaacgcattcgggaactatccacaatcaaggtgcttggctttttcgatcgcgaggtcaccatgtacatcagtcgtgagagcattgtgttgacagtgatcggcatcgtgttcggctatctgctcggcaatttgctgacagcctacattttgtatcaagccgaaaccgaggccgtggttttcccactcacgatcagcattgtcggctacctcacggccacgttactcatgttggccttcaccggcgtcgtcacctggctcacgcatcgtcgactccaacgggtggacatggtcgaagccctgaaatcaaacgaataacttacaattttgtcaggcagcgtcgtcacggcgctgcttttttcatacaaaattcatcaaaaattgggattaaaaacgtttatgatcgcaattttgaagcgcaaatgaagattgagaccaactcctaacagtcctgtaacgctgacgtaacattgacacagtaaagtagcctttagttaatcaaattaagggtgaggtcaaaaatgaaattcaataaagtcatgatcacgttggttgctgcagttaccttagcaggttctgctagcgccgtaacaccagttttcgctgatacaagcgacagtatcgcttccaacaaaagcgaaaccaatgcactgttgaagcaaattgaagatgcgaacacagaagttatcaatttgaacaagcagatcgataccaagaatggtcaaatcagcgatgcaacggctaagatcagcgcaactgatgccaagatttcatcactcagcggtgaaattgttgccgctcaaaagaatgtcacagcacgcaagaacaacttgaaagatcagttgatctccttgcagaaaaaggctggcaactctgtcagcggcaatgtctatatcgactttgttctgaattcccagaacttgtctgacttaattgcccgcaccatgacggttggcaaacttagccaagccagcaaagatgcgcttgatgccgtgacagttgccaaggataaattagctggcttgaagacggaacaggaaaatgcccgtcagacgctggtttcaactaaggcttcattggaaacccagaaatcacagttggtttccctacaaaaagatgctaacgataaacaagatgctttgaataagcaaattgccgatcataaagatgagttggttgctttgcaaagccaatttgcccaagaacagtctgaagcagctgctgcaacccaagccgctttgaagaccgttgccgcttcaaccgcaagttcttctactaccagcagttcaagcagcgcaacttcaaccagcaccatcgccaacaacacatcaagttcttcaaacaacagttcttctgttatcaccaacaacacagcttcaggcagtggcagccacgctgacttcagtggttcaggtaacacctatccttggggtcagtgcacctggtacgtcaaatcagttgcaccatgggctggtaatggctggggcaacggcgcacaatggggcggttcagccgcagcagctggcttcactgttaaccacacgccagcagccggctcaatcatcgtcttcgccgctggtcaatccgttggcggtcaatggacagccgatggatcatatggtcacgttgcttatgtccaatctgtctccggtgacagtgtcacaattagccaaggcggcatgggcttcagctcaccaaccggcccgaacacccaaaccatctctggtgcaagcagctacgtttatatccaccggtaatttttacctacccttaatcacgtcttgggatcacatcacggtcccaacctaaaactaccgagttatctaaaagaagtcacaaagaatgtttgatcgcattccttgtggcttctttttttgcattgagaaaagtttatcagcaactattttgcttgttcgagacacgccccccggtagcaatcaaacgcgacatcacaggaatcgcaattgtcaccagttatgatacccaacacggaatcgatatcggcttttcaccaaacgaccttgtttatctctgctgctgtctgtaactgagacgcagcacaacactatcaagtctgaatttttgttggtatgatacgtgtacaacaatgtaaaattgattcgtcctttacagcacgtttaaaggagcccaataaaatggtgtatctcaacacaattttacagctactcatggctttgttgctgctggcacagctactagtcatggccacggcttggttcaccaacgccgtcacaatctggcagcgccttagcatgacgttcactgcactagtccttgctggcagccaccttgttatcatgtatggctttggctatttggcagatgctcatgttcccattgccggttggacttggtttgctttggcggcggcagtcctgcttctgcttgcaaccatcgcgggagccagcagacatgaacgtagaagcagtcatcgataaaatgacggtctcacactgaacaattgcttcacttttgatttgctttttaaatgtcagatgtattgatacaagcaatacattcaattaatatcgtctcgtttatatattaattatatttttatagttataaattgattttaaaacacgttgacaagccgtttccttctatgtatccttgcatttagaaaacgttttcttagcggggtgatttatttattgataaaattacttttaaactgtatttacgtttctctattttaggcatgctgctatgggttcaacacacttcggaaaatcaaactggtaagatcgccttgtctctgaatggtggttatatcctagattgcataattaaagttaccacccagaaaatgtgaaaaaagacctgtccaaggcctagatgcttcacaaaagatctatcaactctacttgacgaagagcctgaataatgcgataaaattacttgactggtttcttaacggctttaatcacgcgttttgcccgtgaacgggttttcgggtttttactcttcaaccgccgtgctgcggatgcgtagtcagttttttctgccatattgcttcctcctgttttgcgtggtacactagtgattgattaatcgtaatcaatacgatttaatagtctacacgccattaatcaaagtgtcaagctaaaggagttcgcatggataacacaacgattgcattagaagaattgaaacagcacggttatcgcgtgaccaagcagcgtgaatcgatggttgattatctcggcaggaatcagcatcgctacacggcggtgacgatactggatcgttatatgcgtacccaatttccgggagtctctcacgatactatttatcgaaatgtcaaatcatttattgagatgggcattgttgaaagccggatgcaagatgatcagattgttgtgaaattacagtgtgatttccagcatccgcatcaccaccactttatttgtacaaattgcgggaaagtgatcgagttgaaaatgtgtccactcaattacttcgagaaacaagtgccgggtgcaaaaattcaaagtcataattttgaactttatgggctgtgtgcggaatgccagcaacacgcagaccgccttaaaaatgcctaagcgacaggcgagcatgtacatgttgatgtatgtgctttttttatgaacgcaggcggcagcgctttgaagacagggcgtcagcggaatgcgccccgaatgagttgaggtggaagacgtttaggtgtacgttgtcggcttcttccatctttgaatgggagcgtgttatcagggcagacatgaccaccatttaaagactccggaaatggcaaacttgtcatcttagcaagaacttaaatggtatcatctagttattgaggtacaattaaacgatggatgaaaggagctggcttcatggcttatcgtaccccgccattattaccaccgactgcgattgtgtcactcattgttttgattagtgcatataacattgtgaacacgatcaatccggtgaaccaaccaaaatcggcgaatgagcaaagtgaattggtatcaaaaataaaatcagaatctgcctcgcgcgctggtcagtccgcgtcgtcacatgttgcaccgagtcaagcttcggcgtcgcggcaaccagaggctagccaatcgcaggctgaaaccagcaatcaagatcaaaatgatgataacagcaccgtgagttcggctgcttcaactcaggaaccaagcagctcagacacaacgtcaaccccgtctgcttctgcctcaacaagctcaacaacacctagtcagcagaataataatcaaaatggacaagaaacagacacaaccggctctggcggtcagtaactcgcggaaaggatgagatcatgttaactgttattgatattatcaaccgcgtgttgggctattttaacgttgccgacaaacccaaggggaaagccttcacgtgggtggcactcattgccaacttctatttactatatgtggcgattcaaaacctgcgctatccggactttcgcattcgcggcgcactgtttatgcttgcatttgttgtctttttgtattttattggcttgaacttcttatattattttacaaataagacaacgaagtttgacatttcacccaaggttgaaaaatggcttggcagtaacgctgccaaaaaaaccgctgtcgaaaatgaattgcgcacacaattgggtgcagcaccggctcaaggcgttttttcacaagatcaattgctgacggccgatgtcaccatgacggaggaacagcaagccaatttggatacgcttgtcgatagcctcgttaaacaaggtgtgctgagtttgaattatcaaggactagatgacaaagccgttggtcgtgtggcacaggagacgcaacaaccggttctggcgattggcgcaccgttcccgttgccattctttgatctacagcacctagacagtaagcttgtcatcacgggcggcttgaatgccttaatggccaagccactggccaccgttgatcgggtcggtttgttgccggtcgaagcggcgcagcgtgactatcatcttgtggttgcgaatgtctttttgatcggtggtgaacagaagctgctgggtcgaagcggcttacgcaaggaagcgcaaccttacagtttaaccgtgcagttggcgtatcaggacaaggcaactactggtgatcggcagcctgagcatgaggcggagcctttggactcacgacacacaacgcgcgaaagccaacgcgaaactgctaagatgaccaatgagccagccccgtcaacctcgcaggctgcatccaagcccttgccgactcgcgaaagcagacggcatcgccacgatgaataaactgttatgaaatagttgtgccatcaattgaaaaaaggctacagtcaggacgatgttacttttctagaaacgcaaaagtgacgttggcctgattttttgagtgtgagttaggtgattaaccagcggcaggcaatcaagataactgtccttttgaatggtagcaaggcaatcataacgttttaggactgattcatttgtcatagaagggtagctactgacgtctgagcggttttagataccagtgatcacaagaccttttaaaacttcatagaacgctcagaagtcccaaataaaggcgatgagaagctcttcaaagcaaaaaggttgtcataatgaataagaaatatttgcgcattattaagtttctctgtaaaatccatgataagcatcagtgaacccaaggaggtcctcgaacatgtcaatgatcgaatttcatgacgttaataagtactttggtaaatttcatgctttaaagaatatcaatctcacagttgatcgtggtgaagttgtcaccatcattgggccgtctggatccggcaaaagtaccttacttcgttgcatcaatgggctggagcggatcacatctggacaactaatcgtgaatgattttgacctagctgacaagaaaaccgatatgaaccgcattcgcaaaaatgtgggtatggttttccagcattttaacctgtatgccaataagaatgtgttgcaaaacgtgaccttaggaccagatttggttctgaaacgaaataagcaagaagttgagcaggaagcgcatgatctgttgaaaatggttggcctcgaaaataaagccgacagtttcccaggtgagctttctggtggacagcaacagcgggtagctatcgcccgcagtttggcgatgaaacctaaagctattttgtttgacgaaccgaccagtgcactggatccggaaatgatcggcgatgtgctggatgtgatgcagaaaattgccgaacagggcatgaccatggtggttgtcactcacgaaatgggctttgctcgtcacgtcggtaatcggattgtctttatggatgacggccagattctggttgactcggccaatgtcgatcaattctttgatgatcctcaagaaccacgggccaaggaatttctcagtaaaattattaaccactaagggcgtgagctgggcggtgaaaatggcgcgtaaacggccttggaagtgatggccttggccaccatgatcaagatccttatgcgcagatttctacgccagcgatcgcgtttaaagaggaggaagttgaatggcaaaattgtggaaacgcatgctcctgccgttgctcttagtgttgttaatgatgccactaagtagttgcggcaaaagtgtcgccgatcgcgatattttaacaactgccaagacgacaaatacgattgtctggggtgttaaagctgacacccgtttgtttggactgatggatatcaaaaccggtaaaattgaaggttttgatgtcgatatggctaaggcaatcacgaagcagatccttggtagcaaaggcaaggcccaactggtccaggtcaccagtgatactcgggtgccgatgattaaaggcggcaacgtcgatgcggtgattgcaacgatgacaattacgccagaacgtcaaaagattttggatttttccgatgtttacttcaacgctggccaaagtattttggttaaaaaaggcagcccgattaagtccgtcaaagacttgaagaaggggacaaaagtcatcggggtgcaaggctccaattccgttgacaacgttaaaaaagccgcgccagataccaccgttttgcagttgtctgattatgcgcaggcttttactgcgctgaagtcagggcagggcgatgcactcacgactgacaacggcattctttatgggatgtccgaacaagatccaaattatatcgtcacaggcggaacctttacgaaggagccttatgggattgcgatcaacaagggtcaaaaaccatttgtgcaggctgtcaataaggcgattaagcaacttaagcaaaacggcacctatgccaagttaattaagaagtggtttggtgatgtgccaggcttcagtctcaaggaggtggaatagcatgtggtcaattcttaccaataactggggaacctttatgtccggtgtcggttacacactggcttccagcattctcgccttgattggcagtttaatcgttggcaccttgttcgcactcctagaaatttcgccattcaagagtttgcgggtgatcgggcgcatttacgttgaaatagtgcggaatatcccgctgctagttattacattggctttttacgtgatcgtaccgcagttcatcgttaaaattgacggttttacggctgggacgattggtttgctgatttataccagtgcattcatcgcggaaacggtgcgtgccggcattgaagctgtgccaggcgggcaaatggaaggcgctcgtagcattggtatgacgtacaatcaagcgatgatccagattattttcccgcaagcttttaaaatggttattccgccattgggcaatcaattcatcaacttggtcaagaacagttctgtcctcgcttttgttgctgggtttgacctgatgtaccaaggcaaactgatcgccgccacgacgttttccacctttgatacgtatctgattgttggggttttctacctcgtgttgacgatgccattaagttatctgatgcgatatcttgagaaaaaatgggtcaccgcctagaaaggagcagggcttatgcataattttattgacgcgtattcatggattaacctgcgttacctgcttcaaggactaggggtgacactggaagtttcgattgtctcgatattctttagctttattctgggcgtgattcttggcctagcacgttacgtgaaaattaaatatttttcagcaattgtaggttttgtgattgatttgattcgaaatctgccattactgctgattttgttcttcacttattttgccttacctgacattggcattcgcttgaatgttgtcgctgcggcgattatcgccatgagcattttcgaatcggccatgctcgccgaaatcgtccgttctggcattaacgcggtgccgcgtggccagatggaagccgctcgcagcaatggactcacgttctatcaagccatgcgctatatcatcatgccacaagccttgaagaaaatgattccgccaatcgtcagccagtttatctcgctggtcaaggacacctcgctggccaccatcattctcttgccagaagcaacctaccacgcgcaaattatttatgggcagaatatcaactatatgatcccgatgttcgtggcgctggcagtgatgtacttcgtggtcaactatgccttgtcactggcaagtcgttggttggatcggcggctcgtgcagtcgaattaggtttatgttagacttttaaacgtcgcacacgtggcggcgttttttagtattttgtgaacaaacggctaatgacgtggttgtatgttttagctgtgatatgatgttgatgtgtttaaattgaagtaatggaggctactactttgagcagctacttagtgactggcggagccggttttattggagctaacttaaccgaacttttgctaacggatccatcgaataaagttgttattgtggatgatttatcaatggggttaaaacgaaatattccaaaatctgatcgggtgactttctttgagcacagcattactgatcatgattttatgtcaaagttgttgatcgatgagcactttgattatattgtcttattggcggcgattgctagtgttgctgattccgttgagcgaccttatgagacgcatcaggttaatcaagaagctaatctaagtatgctagaaacgctgcgtgtcaataagatcccatttaagaaactatattttgcaagttctgcagctgtttatggtgactcaccagagctaccgaagaaagaaacaatggcggttaaaccattaactcaatatgcagttgataagtttgcaacagaacgtgaagtccttaattatggtcgtctatacaacatgcctgttgtttgcacgcgtttcttcaatgtttatggccctaaacaaaatccaaaatcaccatacagtggtgttttgtcaatcatgatggattctcttaaagatggtaagccattcacctttttcggcgacggcgaacaaacgcgcgactttatctatgttggcgatgttgtcagggcaattcgtggtttagtggagacgccagatgctcgtgatgatgtgtttaacgttgccaatggtcagcaaacaacattaaatcaggtggctgccgcgctagaaaatttgaccggcaaaaaactagacgcaactcataaagctcctcgtcttggtgatattcgagactcatatgcagatgcaagtaagatcgatcactttgattttatgcaacatacgtcattaagtgaaggcttagcgaaatatgttgcgtctgttcaagataaggcttaattattaattgctggtgatacgtaaagggtgtttcaacatctctgattgatgacagctttcagagatgtttttatgtcactgtaggtattttaatttccttaatttacagaccggtatgcatcatcaataaatttactttaacagttgtatttggccactataattgataactttggagatttgttcatggcaaaacatcaggctcgtaactttagattcaaatttcttctcgcgatgctcattggtattcttatcggtggtttgtgcagctttgcctattatcattttgaaatcgttccacgaaaacaacaagaagtagaaaaaatacgtcaaaagtatgaggcggaacttgttgttcaacgggcgcaagcgcagcgttacaaaaatgccgccaaaaaagataattcacaagaaactgcttatcaaaaggaagtatcaacgactgagggtaaaacctttgagcagcagttagagaataagggctttgtggggtccgctcttattattaagaatggccagattattttaaataaaggatttggttatgctgatgctaatcaaggaagaaagaatgggccacaaacactatttcaaattggctcaatccagaaagggctgacggcggccttgttaatgaaactggttgaacagggcaaggtgaagctatcagatcccgttggaaaatatctttctggtattcgtacaggaaatcaagtgacgttgagaatgatgcttgatatgcgaagtggctttcgactttccactttgcagaatcaggtgttgtctgatgacgggattgtgcggtggtccatcgaaaatatgcagtattatccgcaagagtactcttatcaacctgttaattttgcccttttggccggcgtcatcgaaaaggtttctggaaaatcgtacaatgagcttgttcaaaaggaaatcattaataaaattggattgtataatactggcttcatgccgggactgttgaaagaaccaaatagggcgattagttatactggctctggtgaaaaggctgtctacacaaatccctatacacaatccgaagttgggtataatcgagaacttggaacaggcaacatttatgcgacaactggggatctgtttaaaatgttaaacggtattgatcaaggccaggtttttaaaaaatctaatcttgctaaattacgtgatcttggtgatggacaatatactgctggagtttataactacgacacgtacacgatgagtcaaggagttgtcggtgcccaagcggcaacaacagcaattgataacagtggtaagaatgcggttgtcttgatgagcaataacattttacaaggcatggtattacacaactacgcgcagccatttttggaaacgattatgaaaacaaattgatgctttcatatgtactttgggaaaattttttaaatttggattttataacgtatgtatgccaatcgatgatggtgaactgaattcataattagtaatattgccagcatattaagcacagcgcagccagtttaaattttgaaagttaacctagatgaagcaaaatattgaggggtaattcaacaaccaccaatttaagacattcttttggaggatgaacatttaaataagattaaaacgttatattctaaatttaggaattcctatatccattatcttgttaatatcaattggtattgcaagcgtacaaataacgcatcatgggttaatattgggggatgatttttcatttcacttcaatcgtttctatgaaacatacaagcaaataactacacatcatatcaatctgtttcagtctctctttagctttagtcaatcaggtagaattgttaatgcagtatacgggctgggattttcttattttgctggcggactgcttgcattagtacacaactggtttaggtttcaagtactattgtcattcctttgtgaatttactgcgggcattactatgtttgccttactaaaaagaatcaacataaaaaactggctagctgtttgtggagctggcttgtacatgagttctagcgttgttagtacttggggtttaaatcaagcaatgacaggttggggagctgctcttcttccgttactgtttactgaagcaatagccgtcacccaagaccgtgaagcacgtttttcgccaattgtgcttgctgttggaatgagtcttttgatcgggacacacttattttcaacaatgctaggatttttaggtattattcctttctttttagtggctctaatccgaacaaataacaagcgaaaactgttaaccaagattgggatcagtatcataatcaccatgttcttgtccatagcaagcttgcttacctttattgatgtaaatttaagtaatcaattaattaagccgtggaaaaacactaacatgttggcatcagctgttaaattcacaatgggtaataatagttattttgaacttgggcttgtgttaaccgttctcttcctcgcacaaattagttacgttactctatcttggagtcagcggacaattcaagagagaattataacgtctgttggcggaattttcttgcttctatcatcgacattagtaccttggaactttcttgcaacccattcatcaattattgcaggaattcaatttcccgcgcgctttcaagttgtagcttgtattcttctcttagcaggaagtgcgttaacagctcaaaatttaacaatacgaaatcctcaatttcaatatttcccattaatttcttttttcattatgtttatgttaatcttttttggggccgtagacaaaatggccacaagtgcaaattactggcaatcatcgacgccgacagctgcaggaaataatcttatttcaccggcgggtatatcagctgatcgaattcgagcaatattttccaattcaaacctgggaattgcgatgaatacagttataaaatggacaccagattatcttcctttaaaagttcaacaacggcacaaccaaattaacacttatgatttatatggaaggcaaatacttaataatccaatcaaagtcacacatcaagtaacccgtgacaacaaactaatgctgtcatgggtatcagactcttcaactactgtgacattaccagtagtcgtatattcacactctattgttcaggttaataataaagcactgcgtccgagccaaatttcagtttctgatattggagccttaatggttcaccaattgcatggcaaaaaccaagttgtgattggttataaagaaaataacttgtttactaaggcatttctgattcaattaattagctgggtatttctcatcatctttgtaggcattaagaaaataaacagcaaacataggttgcaataataaagttaccaccttgaggtaaacggaagcggcctaaagtcgttgtcgtattttggatggtgtggcgttacactagctatatcttggggagcttgactaacatcataatgctcatggggtttatccttctctctagatggtgtgttaacaaatatcgtctagagagaaaggacaaacctttttcatttttggggagtggtcactttaattatccaatctcgaactcaaatgccatttcagcaaccgtgtcttcactgtaggtgttataatgacacgtataagaaattggaataagaaagatccgcaattgtatttggatcaatcgtattgagcggatattttgcctttctgctacattgggaggtgaactcaagatatgtgatcggaatatttccgactcgattagtcatgatcgggaaatctttagggcagccggcatcctctgagccaattattgaaagggagagcagtcttgaagaatacaagcacatacaacgaaggatttgatttagtaaaaggtattatggccatttttgttattgcaatacacacactgttattaagtagtagtacgaagatcggactggtgctgttacctttggtaagaacggcagtgccgatattctttttatttagtggttacttttttttaaaaaaatagacaaaataccggtatctaaacatcgagcatttttgaagaaaaacatcagtggatacttgcagctttacggtatttggtttgtcattacgtttcctgtaacaattgagttacgaaaatattttcaacatggcttgttttcaggaattttaacgatcattagtaattttttctttggttcgacatttgttgcatcatggtacattatgggactgattataggaataccaattatatacttgttgagcaaatttataaataaatgggtgcttttcacgattactctggctttaaatgcttattgcgttttactaacgaattatggacaaacaggatttggaaagttgctttgggcctggactgaaaatcatttttttggttattcaccctttttaagcttcattgttggtctgttatggttaatgataggcaagttatttgcagatggtaacctaaaggtaatagctaataaacggtcaaaatattttgtagtattcttcctgcctttgctttacattgaagagtacgtcacttttaaaacagcctcttcattgtacacggattgctttttcatgctcattcccctttgtacattcttttttgggtggattatttcaactcactggtctattcctggcagtcggtatcttcgcgcatttagtacgattgcatattgtttccacgcttcattcgcgttgattttaaagtatttgttgatggttgcaggtatgccagttcaacgttttcggcagtcgttgttagtttggtttgtgactgttgccatgagttggttgctgacacttttgattttaaggttagaaaaaatttcattcttcagttggttaagattgagccactaaatccgcagtgaatgagttgcgtggcttcaccattagcttttgaaatcagtaaagggttgccgactcacgtattggtgaatgatgtggtatctcatttcaagaatcttggacggaatataaatattgacattttttaatgaggaataaataatgcgaaagctttttaatgggtaccataattttataagattattgatctttccgcttttctttttaacggtttttgggtcaattcgtgcagaacagcttgatttgacgtttctgtcacattggttttttagtgtaattatttttttagcggttgttgtcgcgactttgtattattttcgtgataaatctaaaatctttttttcttacgtttataaaatactacttaagcatattactcttgtagtttgtgcgtcgatgattgtagttgcggctctgcaaatcataatactgttaaataccagaactccaattggctgggacgtcggagctgttatgaaggcagttatacgtcccaaaagtggagcggagtatgtatctattaacccaaacaatttattcttgatatctatttaccacggtatttatcaactttttttatcccatgggagttccttagcggctacgtggctttttttccaaatagtgacggcaattgaattagacttttcggtcatctgtatcgttttctttacatataaagtttttaacaggaaggtcgcacttaatacctatcttcttttcttttttctctttgtgttaacaccctatattcaaacgccatattcagatatcgccgttttagtgcctatttcccttggaatgctttgttttgctggtttggaaacaactgtgcatacttatttgaaagttctttttgctgttttaattggttttctctttgtgatcgtatatgagataaaaccctcgggacttattttgctagttgcgtggacaattgatgctttaacgcgagaattacttaataatgataactctagaaaaaaggtgaatttaattcttgttctgtttgtggtgttgagctttgctgggggacaaaatattgccactaaactgatagaaacacattcgcctataccagtagtgaaagatagagggttaccttggcagcattttgtcttgattgggatgaccggcaatggtgggtataattcacctattaggcacacaaccttggattttgtgacgactaaaaaaatggctcaatattcttcacaacaaatttcgaagcgattaaatactttgggatttgtttcttatcttcagtttttggctggcaagcagataaggaataccgacagaggtgatttttcttgggggcaggaaggcatcccgcaaccaccttttaatagaacaaaagggtcacttcaagatcgcattcgaagtgtctatttaattgggggcaggcatcaggctgatatgagcttttattatcaggttgtttggctgttagcattggtaggtattttgttgagtttggtgaaggtgaatccggtgaaagacaagtgggttagcatcttaattcttagcatgctgggggctttcttatacttgctcttatttgaaggtggccgctccaggtatcttattcaatatttgccaacgctaatgcctttatccgcttggggatggtatgtcaacactgaaaaaaacatcgaaaattaattaatcgttgatggccttgtgaaatgatgaaccattgatgctataataactgatgttttcaaattggggaggggaaaaatgagaaaagctaaaattattcggacacgacaggtcgtttcaccgttattggccatcagaagtcttcatgggtaaaaagttgcacttgagttgacaattcgtcgcaacaaaaaagcggccgcccatcgtatattgtctataggatagctaccaagcctgcaagtctatctaggcaccaaattttcaaacagcagatcaatctaaggaagtgccgaaaaagctcggcaacaatttatagctttacataccaacagcttggacaaaatcgctagtggaccggacattttctgtcattgatctcgactcaaccacatgatgttgcgttactggagatctcacaaaattggggacagaccttagccaagaacatttcgccatccattgcaaaatacatctttaaatcccctacaaagactgctccatctgaactgatcaaaagtccggactatgatgattaggatagctatcaatcgttgaatcgtactggatatcccgtgagtgcaggatattttttgccccggaatgaaaaaaaaggaacaccctctcgcgagaatgttccaatttaattttagccattagttatccttatagtgaaggacgaacagcaaaatcaggcatgaagtaagctaatgccgtatacttcacattttcacctggttgtggtgcctgaatcattgtaccgccaccaatgtagagcgctacgtggtaagagctaccatgtccgccccagaagagcaaatcaccaggctgaagtgcactcagtgagacttgctgaccagaagattcttgtggcactgtccaaccaccgatgttaacaccggcgccgttcaaaaaggcataatgcatcaagcctgagcagtcaaagctgttaggacccttgccaccccatacataaggtttcccaatttgctgttcagcaattgagataaccgcctgaatttttgcctgacgtgacggcgtaacaggggctggggttggtgcaggcgtcggcgttggtgcaggcgtcggcgtcgcgttatttgtcgtttcctcggcattgaccgtaatgcttggttctgcctgctgttgctgttcctgagttgcatcaacctgtgtctttgcaggcgcagcactggactcaggcgtcgtagtctgcacagctgcagcgctagaatcagcagcagccttagatgcagcagccctggattctgcagcagtactggattctgcggcagcactcgctacagcagcagacgatgcagcagcgctagaggcatttgcaaccgaagcagctgcgttcgaagccgttgcatcagatacaggcgcagtcggtgccgcaacactcgttgcagcagatgactgcggtgctggtgcaggtgttgtgctagcaaaacgttctggcacgtaaccgccatttgctaaccgataccatgtttcgccattggcttgcaactgggcaaccgccgtcaacgtctggttgccttccagatactggccagttgcctgactgtacgctggtgttgcccaaactgtgactgcagaaccaatgtttttaacatataactgaatgtttgctgtctgggtatcaggctgtgcggctgcttgactcgcaggtgcctgacttgcaggtgcttggctagctggtgcttggctagctggtgcttggctaaccgctgcctgactggcagtttgttctggtgcttgaacggtgacagtcttgccgtcaaaattcaaataaatgccaggaatccactgattgtcgccgaccttataccaagtagcaccgtttcggtcaactttttgacctagaacttgtactttgtcaccaaaagtcacatagcgttttacttgatgccatgatggactattccatacggtggtcgcactcgatttgtaattgactgtccccgttgaagcggaaacagtattagcgccggtagctaaagttgccaaaccggcagcaccaatgaatcctgccgtaactgacaatactttctttgcatctaccatgtatgtactcctccaatccaaaactgaattttttcaaaaattgcgttttacttgcgtttaccatttcttaagaaaccatatacagaataacacgtttcctactggtacgcacattaaaaaaatatttcaactgtaaagttcacggcgccaaagccttggtataacaagatttcatgcgttatctaacgatcaggaactgttttggcaacaccgagtgccagaccgatcatgtcattaaagctggtctgtcgctcttgggctgaggtttcttcacccgtaaccaagtgatttgaaaccgtgaggatcgataacgcgtgcacatggtacttagccgcaagtagataaagtgccggcgtttccatctcagtcgccagcacttcataatcaatgagtttttgacgatccatctcatcgttataaaagcgatcctcgccaagcacgttaccaacatgatagcgaattgcactagtatctgccaagtttgccgccttacgaagaaggttgaagtcggctagtggggcaaaataaagcccggcgccaaacgtattcaagataatgctgctatcagtcgaagatccttgggccagcacaacatcgcgaactttgacattttcgcccatgccgccagctgtgccaacgcgaatgagcgttttaaccccatagtcttgaatcaattcattaacataaattgagatcgaaggaatgcccatcccggtcgcttgaaccgacacgcgccggccttcaaacgtgccggtgaatccaaatgcattccgcaccgtgttgtaacgttgggcattgtccagaaagttttccgcgatgtactgtgctcgcaatggatcacctggcaataagacgacgtcggcaatggctccttttggggcatcaatatgtgtgctcatgacaatgattctccttcaaaatgtgggtttatttaagcagctttaagaacgactggccaacttgattacctgtgacaccaaaattatctaaaatcgtggcaccaaggtctgaaaatggcgaacgaatacctaaatcgccattacccggcaattgcttgctgtaggctagcaacggaacatactcgcgggtgtggtctgttccgcgaaaagttgggtcatttccgtggtccgccgtgatcatcaatagatcctgatgtcgtagcactgtcattaagtcgcccaattgtcgatcgaaagtcatcaaagcatccccgtcgccttgcgcgttacggcgatggccatacatcgcatcaaaatctactaaattggtgaaaataaatccgcggcggtccgatttgactgcttcaattgttttttccatgccatcaacattactagtggtatgaacaccgtcatctagcccttggccagagaaaatatcgttaattttcccaatgccataagtcgcaatgccagcaccttgaaggcgatcaagatctgtcggcttatccggcttaagtgtgtaatcatgacggtcactggtccgcgtgaacgtagtgggatctgtcccgacatatggccgtgcaatcacccgaccaatgcgatatggtgcgtcaattgtgatgctgcgaacgtaacggcaaatgcgataaagttcttcaagtggaatgacatccgtttgcgccgcaatttgaagcaccgaatcacctgaggtatacacgatcagatcgccagttttcagctgttgctcaccatagtccttaatcgcttctgtgccagaataaggtttgttcaaaacaactttacggccggaaaactcttcaatttgtttaatcaactcagccggaaaacctttgggaaaatagcctaaaggttccgtcacaggcaaacccatcatttcccaatgaccatccatactatctttacctgcagaaatttcggccattttgccaaaatagccactgggactacctaacgccgtcacgccagcaattggtgttggtcgagcaatattacccaacccaatggcctgcaaatttggcaaagccagtttaccatcaaaataggcaccaatatgaccaagtgtgtcagcgccggtgtcatcatacttagcggcgtcaggtgcttcaccaataccgattgaatccaacacaatcgtgataatgcgatcaaatgccatcttatgcttcgcctgcttccttcaaaatttgaatccctgcactggcaccaagacgatcagcgccagcatcaatcaatgccttagcttcagcataagtgtgaatgccgcccgctgccttaacccctagtttatcgccaactgttttgcgcatcaaagcgacatcgtgcaccgtcgcgccgcctgctgcaaatccagtagatgttttcacataatcagcgcccgccgcagctgctaacttgcaagccgtgactttttcatcatccgtgagcaaaaccgcttcgatgatcacttttagcaaaccacctttagcatgggtcatatcagcaactgcccgaatgtcagcacgaacatgatcgtcatgccctgccttcaattcgccaatattcaggaccatatcgatttcctgagcaccttcgtcaattgcctgtccagtctcgaaaaccttcgtctgggtggtgtttgccccgagaggaaagccgataaccgtgcagacgttcacatccgtgtcgcgcaaactagccgccgcccgaacaacccaatagggattaatacaaactgatgcaaaaccgtactgttttgcttgtgccaatacttcatcaatttgatcctgtgttgcatccggtttcaataaagtatgatcgatgtactttgccaatggttttgccatttttacgcctccgtcataaatagccttctgatcgcagccaaaaagcttatcttatctgcagaagatgaatgcggttaccaaatgacgcattcatcagattgccttaagaataccatggtatggttaatcgtgcatagaaagggttgaatagatcatgagtacgcgtaccgtcaagccaagttgtggcttgcaaatgcgttttggcaaggcagttgattaaagcaagctcgaaggcttcgggacacccgacctatggcaaaacagtcataaaggtgtccttctcgccttcacctaatctcatccattataataaagttaatcaaattgtttcttgaaagtgaggtacttccatgacgaacatgcccccgaatttaacttctaagctccgcactgatattgttcaagcaccttcagcgattaaagcggccagtggcattacgctttttggtaaaaaattcgcagtatcatctataccatggacgtcgctgtaatcgcgaattgcgatgctgatgcgattctggctgtctatccgtggacacctaatacgcgcattctccaagctgtagcaacggtggctaacgtgccgattctggctggcatcggcggcgggctaaccaagggcttgcgagccgcaaccattggcgcttttgcggaagaaagcggtgctcaggccgttgtgttaaatgcgccaactccgattgaaacgctcatcaatgtcaatcgtgtggtggacgttccaacgatctataccattgtccgtcatatggatgatcttaacgcccgaattgatgccggtgtcgcggcctttaacattgctggtggcaaagaaaccgccaatcttgtggccgaagttcgtgcggccattgacagcaagcacccgaatttcccgattattgcttctggcggtaaaaccgatgagcagatcactgccacgatcgaagctggcgctaatgcggtaacatttgcggcctatggcgtgacggaagcgactttccacgccaagatggaggcctatcgaaagtagaaatcgtaaaactcgacctttcataaggcgtctcatcattgttttaactttcttttcaatacgaaaactactcggcgatattaatatttgttagaatagcattgataatgcgccattaaaaaaattgaaaagggagatggcagccatgagcaatctgatgcagagattgctgcccgtgctcgttaacaatagcgttcggttgcgacacacccgcatttatcgtgcgctccaacaaacccttgccgtcattttcccgtttattctggtcggtgcttgggctcaaatgtagacgcagagtgtgttttcacgaaatggcttttttgcagtcatttatcatcttgacaccgtcattccttactataaccagatccgcaccattttgatgtcgattcaaacagtgacactcgatctgatggcggttatggcggcgtttttcgttgccaaatttattgcccgatcttatggcaaagatgattctttggcagccttaacgagtgtcggggcatttatgattcttaatttggattcacgacgcaatggccaatcacctttccaaatgaataattttggttatcgtggtttgtttattgctatctttttcggcttgcttatcggttggctcttccgcttcacacgtgcggacctcgaagaaccaacgcatcggtatacaatcgctgccttggttgaccgtgggctgcgtggcacctggcttactgtcgtgatcctagtgatcagtgtggcgatcaattacagcctcagccgcatctcgacagaaggtttcatcgggcttttctacattccatttcagatacctgcctccagcctcagtcacgtgtcgattcgattggccctggtcaccaccattaatgccctcatgtggtgggctggtattgaaggtccgatcaatccgttaacagtgcaagccggtagcacgaccagcactgccaatctgaattatgcgcttgagcacaacaatttgttcaacgtgcccaacccgatcaccattggcaccatttaccatcccttcgcgagtttcggtggcgttgggatgaccttagccctcatcattgcgacactttgggttgccaaaacccggccattacgccgaatagctggcatgtcgcttttgccgagcttggccaacatcagctcaccgatcatgattggctggccggtcatgttaaaccctatttttcttgtgccgttcttgattgcaccgctagtcaatatgacgattgcatgggcagctatccgcttgcgtcttatgccgccgtcagtttatacgattccaacgacaacgcccggaccgttggcagccttcctaggcaccaatggtaattgggtatcgcttctcgtggctatcctctgcttagcaatcgcgattcttatctatatcccatttgtgcgactagcagaaacaattaatcttgaatcagcaaaagtcggtggtcatcatgattaaacactggcgaaaatggctgttgttactggtcagtgtcttggcggtaacggctatcatgctccccgctaccagctggatggaacaaaacgttaaatctgctcgcgttgttcacaactcccgtatgcaaccgattattttgattcctgggagttcagcgacagaagatcggttcaacaccttgatcacccagctaaacgcccaaacaacgggccatagtttgctgaaaattacggtcaaaacgaatgggacactaacttacagtggcaaaatcgcagcacgtgataccgagccgcacatcgttgtcgcattcgaaaacaataaagatggttataacaacatcaagaaacaggcggcgtggttcaacattgcctttaagcaattggcgaaaacttataatttcaatcgttttcgtggtattggtcacagtaatggcggcttgatcttcactctttttctcgaaaagtattacagcgattctgatgtgcggatgacacgactcatgaccattggaacgccgtacaaccttgaagaaagcaatcctgacaatcgaacacaaatgctgaacaatctcattactatccgcaacaagttgcctagcagcttgactgtctactcaattgctggtaccgaaaatctggacggcgatggcaccgtcccaatcgaaagtgtggaagctggtaaatatattttccaaaaccaggtcgcgcactacacccagatcaccgtttccggcgacgaagcgggtcacagctcactaccgcaaaatcgacagattgtgaacttgatcagtcaatacatggtcgctacaccgaaccaacagggcattcggccagggcaaggcggtagtggtcgaggcgttggacaagcaccaggcgataccggacagaatccttaaacgatcgtaagacaaaagggccgtccaacctcacttaactgatacagacaaaaaataaacaggcactgacgcatctgtcagtgcctgtttatttgtctttgtaccgatcttttgtcaccaataacaacaaaaagccaagccctaaatattgtggcttggctttttgacacttgttaactgttcccttatctaaggcacttgcatccccagataagttgcctgcacagccggatcggcaagcagctcttcgcctgtcccggtcagcttgaccgtgccgctggccaaaacgtaaccgcgatcggcgatggccaacgcttggcgtgcattttgctcaatcagcaacactgttgttccctgcgcgttgattttcgtgataatgtcaaaaatctcttgaatgaaaagcggcgccaagcccatcgaaggctcatcgagtaacagcaatttgggctttgccatcaaagctcgccccatggctaacatctgctgttcaccaccggaaagtgttgcggcatcttgatgttgccgctccttctacaccggaaaacgatcatagaccatcgttatttgttcgccagcagcttgcttatccttcagtccaaacgcacccatttgcaggttttcggctaccgtcaaaccaggaaaaatatgtcgaccttccggcacttgcgagatgccttgcttcacaattttggctgccgccatgccattgattttctgcccttcatagtcaatgataccggaacgtggtcgcaacaaaccggagattgttttcagaatcgtacttttaccagcaccatttgcgccaatcaaggcgacaatctcacctgtttgaacgctaaagctgacgtctttgacagcttgaatgccaccatagttcacaacgagatgtttaacctcaagcatggttttcacctcccagataagcactaatgacctgcgcgttagtttgaatctcattaggggttccagaagcaatcatggcgccatggtcgagtacataaattgaatcagccaatttcatcaccagcgacatgtcatgtttaatcaaaaccaccgtgatgccaaaatgctcacgaatccgagtaatcaaacgccccagatctgccgtttcttctggattcatcccggcagctggttcatccagaaacagcagttgcggcttcgtggccactgcccgcactatctccacccgccgttgcgtaccatatggcaaactagcagtcgattcatcggccacatcagcaagctcaaaaaaatctaacaattcgtcggctgcagttgctacggctgcctcctgttgataaaactgcggcaaccgcagcatcgtgccaatgaaactttcacgataaagatgtgtcctggccactaaaacattttctttgaccgtcatggcgccaaataagcgaatattttgaaaagttcgagcaacaccgagcttcgccacctgataggctttctttttcgtaatatcaactggtccatcagccgtatacaaggtaatcgtgccagacgacggcccagattcgccagtcaacatattgaacaatgttgttttcccagcgccatttggcccgatcaaggcaatcagtgtcccttgttcgatcgtcatcgtgacatccgcgacggcttttaaaccgccaaaaactttactgacgtgatcaattaccaattgttgcgtcatgatgctgctcctttccgagtctggcgcttgcgcttgaacgacaactcataacctaataagccagctggtttgaaaaccattagcaaaatgagtgccagcgcatagataaccattcgcaaagtgccaaagttctgcagcactgtatcgatgatgcccaacacaaccgccgcgacaaaagtgccagtgatactaccgaccccgcctaaaacgacgataatcagcaaagcaatcgaattcatgatgccaaaatctccgggagcaatcgtttgcaagtaactcgcatggagtgaaccgccaatggctgccgtggcagcgccgagcaggaaagctgccagtttccatttggtcggattgatgccaatcgactcagcggcaatgtcatcatcacgaatggccatcaccgcgcggcccgcccgactgtgaatgaagttcacaacgatcacagtagtgacacacattaagatatagaccgttggccacgaagccaaaggcggaatattaaacataccagcagggccattggtgattttcaaattattaataatgactcggataatctcggcggcgcccatcgtggcaatcgccaaatagtcacctcgcagccgcaacgtggggattccgacaatcaaagcggcaatgatcgcaacgatcatgccgaccagcatagcaagataaaacccaagcggcgttgagatgttttgtgtgatgatcgccgtggcataagcgccaatcgccatgaagccagcatgaccaagcgaaaactgaccggaaaatccgataataagattcaaaccgactgccaaaataatgttaatgccaattgtgaccagcgcattttcgataaacccgttaatgacgccggttaattcaccaatgtcgatcaagacaaagccagcaatcatcgtcgcgagccaaatgagcttactgcgcatatttttaaacataggctcacaccttctcccgttgacgtttgccgaataatccagcaggtaacacgaccagcatgatgatcaaaacaaggtaaaccgccgcatctttgtaggccgataagcccacagcgtgaacaccagtttctagcaagccaatcaagaagccccctacagccgctcctgggacagatccgatcccaccaacaaccgcggcgacaaacgctttgattcccggcaccattcccattaatggatcaatcgaattgtaatacaagccgatcatgacacccgctgcaccagccagtgctgatcctaatgcgaaggtgaaggaaatgacgtgatcgggattgatccccaccagttgcgcggcttctggatcaactgccaccgcccgcatcgccttgcccatcgttgtttgcttgataatgaactgcagcatcaccatcagtaccaaggatgtgaacaaaataagcagttgcacatttgaaacatcgaccctagtatctggtaggttttagtggtgatgacctgtggaaagttccgggcattagcaccgaatagaaacgacatgccattttctaggaaaaaggaaacgccaatggcagtgattaacgccgcaattcgcggtgaattccgcaacggacgatacgccaagtattcaatcaagacgcctgagagcgcagccatcaccatcgccgacaacaatgctgggacaaaactgaagtgcaggtaattaatcgcataatagccccaaaacgcgccgagcatatagatatcaccatgggcaaagttaatcagcttgatgatcccataaaccatggtataacctagcgcgagtaaagcgtaaatactgccaagtgagagtccattaatgatttgttgcatcaaggtttgcaaaatatgatctcctcataaaaagcttccgcagtcatttacttaacggtatagactttggcaattttgccttgtgtcagttgctcaaccgccagtggcttctcaggattatggtgactatcaatggtcgtggtgcctgtcacagcaggcatttttttgattttggccaaacccttggcaatgctggctgaatcggcagccttctgatcttcaatcgcttgcttgatcatgtaaaccgaatcgtaggcaagtgctgagaacgttggtgcttctgtttgatactgcttcttaaagctggtcataaagttcttcaccagcttgctgctgttagcactcagcatcgaaaatggcgtggtgtaataaatatcagttgcattcgcagcgccggcgatttgcgccaacttaggatcggccatgccatctgcaccaataaacggtaccttgatgcctgactgccgcgcttgcttgatgacgaggcctaattctgaataatagcccggtgcgtagatggcatcaattttcttgcttttgatcgttgtcagcatagcattgaaatctttatcacctgattgataataccgagtcgtcacgatattacctttaaacttcttcttgaatgccttagccaacccggttccgtaatcagttgagttgtcagcaataatcgccacgtttttggccttcaatgtatcgttggcaaatatcgccgcatggtctccttgaaaatcgttattgaagcaagcacggaaaacgtagggttgcacgctgccatttttctgaagtgtaaagtttggatccgtagcactgggactcaccattggtacggccgccttggtcacgtttggaatagaggctgttccgtcattggttgtcgccggtccaacgatcgcaaccactttgtcagtattcgccagctgtgcagctactgaagccgcgccgctcgttgacgatttgttgtcacgatagacggccgttatttttttcttagtatttacgaccttaataccacctgcagcgttaatctgtttcacggccaattcaatgccttgtttctgctgttcgccgtaaccagcaaccgcgccagacaactccatgttcacgccgattttaatcgtgttacctgccgtatttcctttgctcgtggcactctttgtcgcacagcctgccaatgccagcatcgaagctgcgatgacgccagcgctcataattgctttgacaatttgcttcttcatcttggttccccctcattatattgcttatgactatatctcattgattcttaacagaaaaaagcacccattcagacgaatgggtgctaatcgtacgccccatcgccaatgcgaaaacggggctcaacacgttgatcttaaacgatcaattcggtcgggtccctggcatcaacaacaaggctaaaagagcgtaatgacagttacgatttgtttttctttgcatacacatcaatgacatcaatacgccctcctagttaagattaatggttggttaaaatattaatatgattaccaaggaaagcctacttattttctcagaattttttattggtaatttgccgaatgtttattttgatgacaatcaaacgcctggcaataactttcttagaggaaatgcatgtctaagtcaaacctctattctaataaagttattagagcaaaaagagtttgtctctgtagtcagtctagttaaatcgcacataaaaaaaggacattcttacccttaaaggcaaaaacgtcctttttctgcagtacccaagttgacttggataggatctcgctggctccacaaccttgagatcgctgaccccacaaatccggcgggtggcttttaaccagtcagctgcagctttcagcacaagttgcgtgcttactcgacccatcgcataacatgattatatcactttttgggttttaaaacagctcgtttatacaacacttctgataacagctgcgccaacataaaaccgacagcaatggcaccagcgatcatgaccacccgactgacatactgcaaggccccgtccagatcgcctaagacagttgctcgtactgcttggtaagcaacagcgcctggcaccaagggtacaaatcccgggatgttgaagatgattaccggcattttcttatagcgtgcaaaaaagataccacacaagccaatgacaaaagctccgactaaattggccatcatccggccactaccgacttccatcaacaaccagtaggccaaccagcccatcatcccggcccaaccagcgaaatttaacgccttgcgcggcacgttgataatgatagcaaaagcgaccgttgccaaataactgaacaaaagttgaactaataaagcaaaccaccactgcaagatgccgccccctttatgtttttagaagaaccggaatatcatagcaataccaacaccgatggcacaagcgctcaaaatggcttccatccctcgggccataccggacagcaaatgtcccgccagcatatcgcgaatcgaattggtaatcgctacccccggtacaagcggcataatcgctccaataataataaagtccaggttgtgtcctaggcctaacctgaccccaagccacgcagttaagccaacgaccaatgcgcctagtaattcactaataaaccgaatgttggtcactgcattcactttgatatcaactagaaagcccaatgcaccgaccgcagctgccaaaggcatatcaagccagtcatactgttgagcaaataacaccatgagtgtcatgctgacaacggccgcgctcaccacctgcaaccaaatcgggaaaaaaggggtgttctgatccagtttgatcaatgccgcgtgcaattcatctagatcaatctgatcagccgcaaacgaacgagagagttgattcacgcgcgtcactttttccatatcaatcgatcgtttgctaatcggccgctcctgaatatacggctgattttcgatgctagcaaatataccggttggcgtcgtaaacaccaacgtttgtggctcaccagcattcacagcaattcgtcgcatcgtatcttcaacacgatacatttccgaaccgccttcaatcataatgcgtccagcaagcaagcatgttgccaatacttgattttggattgctgtatcctgacgctcaactgaatgtgtcatacctacgcctcaagtttctgttcaaaataccgtttaagtttgtctttagggtaaacacctgtcactttttcgcgcgcctctccttgctgataaatgactaaggtgggtactgacataatgcccatagtgctcggcaacgtatgatctttttcaacattataacgaaccactttaagcgctggcagttcttgctttagggccgttaacatcggatcaagcactttacaagggccgcaccacggtgcccaaaaatcgacgacaaccgtgccttcagctgtcaatgccttcaagttatctttcgttgcctcaattgccatgatgtgatccccttccatgcttgctcttgcaatttagcacgactgccacttacttatcaaggtataaaaaaagatccggtcaatgaccagatcctaacttagcgtggcagcttcctaccctcgcaggcagtttcccaccaactactctcggcgtgaaagtcatcactttttatttcttaaagtgacaacttttaaggctattgtacggattgcaacccatcagtttcatccagaggacaagcggcttcaagaaagtttgacggcaattggtaacggctacatgggcatgcgcgggaattttgaggaacagtactcgggggatcagctttcgggaacttatctcggtggtgtttggtttccggataaaactcgcgttggttggtggaaaaacggctatcctgcgtactttggcaaagcaatcaatgcacccagctttttgccaattcgcatcaaagtgaatgaacaaccggttgatttggccaaaaacagttttcgggatttctatttggcacttgatttacatcagggattgttaactcgtcagtttatctatgaaggggatcaggttgaggttcggtttgagtttcaacgatttttgagcaatgtggtgaaggaagcagccttgattaacgtgaaagcaactgtgcttagcggtaaggcaacgatcacatttgatgctggacttgaaggtcgtgtcgctaatgaagatagcaactatgatgagcgattttgggaagcgcaagctgaggatcccactcaaaaaaccattcaactgcaaaccaagccaaatccttacgatgtaccgcaattcaccgttctattgaagcaacagttgcgtgtcaatcgtcaaccggtcacaggcgttgtcacgactggcaagggctggctaaacgaacaaattgtggctgatgtggcagctggcgaaacttatcaactggaaaaggatgtcattgtggttactagccgcgatgttgcgccttctgatcagcagcaaacagccgcagctttgatgaccacattacaaacacacagtttttccgaacaactggctgcccatacgcagctttgggcgcaacgctgggagcaaagtgatgtggtcattgaaggcgatccggccgcacaacaaggcattcggtttaatattgcgcaattgtttatgacgtactatggcgaagataagcgccttaacattgggctaagggttttacaggtgaaaaatacggcggtgccacttactgggatactgaagcctatattgtaccaatgtatctggcagtgacgcccccagatgtgacgcgagcacttcttcaatatcgccacgatcaattacctggtgcgtatcataatgcacagcagcaaggactggccggtgctttgttcccaatggtgacctttaatggcatcgagtgtcacaacgagtgggagatcacatttgaagaaatccatcgtaatggtgcagttgcgttcgcgatttatcaatacacggcttataccggcgatgaaagttatgtcaacggtgatggtattgaggtcttggtggggattgcccgtttctgggctgaccgggtgcattttagcaaacgtgccaatcagtacatgattcacggggtaaccggtcctaatgaatatgaaaacaatgttaacaacaactggtataccaacaccatggcatcgtggacgttaagttacacgttagcgcgcctgcccaaggcgaatgctgacgtggtcgctaaacttgcggtgactgcagaagaaaaagctaagtggcaagatattattgatcggatgtactatcccgttgacgatgaattagggatctttgttcaacacgatacctttcttgataaagatttgcgacccgccagttcgattcctgctgaccagcggccgattaaccaacattggtcatgggatcggatcttaaggtcgccttttatcaaacaggctgacgtcttgcagggcatttattttctcaatgaccgcttcacccaagcacaaaaagaacgcaattttgatttctatgagccgatgacggttcacgagagttcattaagtgcgtccatccatgccatcctagcagctgaattagggaaaacggaaaaggccgtggcgttatatgcgcgaactgcgcgtctagatctggacaattataataacgacactgatgacgggcttcacattacgtccatgagcggcagttggttatcaatcgtccaaggctttgcggggatgcgctatgatcacgaccggttacgattcaagccatttttgccaaaagaatggcaccgcttcagctttaaaatcaattatcgtggccgtttgctggcagtggacgtgagtgaggaggtcaacgtgatcctgttagccggcccgtcaattgatattgaagtgaatggtgagctgcagcacttggaaaagggggatgaccatgcttaaaggcttcatttttgatcttgacggggtggtcaccgattcagctaagtatcatttagccgcctggggggagttggcaaaacaattagggattaccctgccagctacggcaaatgaggctttacgtggccgttcccgaatggactcgttagcgatcatcctcgattacggtgatcaacagaagcaatataccgaagttgagaaagaaaacttagcagatgaaaaaaatcgacgttatcttcaattgattgccaatatgacgccagccgatattctgccgggtatcagtcaacttttatcggacgccaaggcaaggcatttaaaattggcaatcgcatctgcttcaaaaaatgcaccgaccattttgcgtcaattgaagttatttgatcaatttgatgcgattgttgatccagctagtctgcatcgcgggaagccagatcctgaaattttcatcaaagcgcagaacttgttgcaattgcaagcagatgaagtggtgagttttgaagatgcatctgctggtattgcagcaattaatgctgctggtcagttttcggtgggtatcggtgatgccaaggcgctcgcagctgctgattatttcgtggcaaacacaggcttattgcgactcaaatcaatcacgacagccttcacaaaatggcaaaacgcgttgaataacaaaggagatggatgatgtcatggttgagattgatttgaactatctttataagaagtacccgaatgccgcacaagattctgtcaaagatttcgatctgcacattaagaataaggagttcattgtctttgtcgggccgtctggctgcggcaagtcaacaacgcttcgcatggtcgcgggccttgaggatatttccaaagggacgttaatgattgatcatcaggtaatgaacgatgtggcaccgaaagatcgcgacatcgccatggttttccaaaactatgccctttacccgcatatgacggttttcgacaacatggcgtttggtttaaagctgcggaagtatagcaaggatgcaatccaagaacgggtggcagctgcggccgatattcttggtctgacagagtttctggcccgtaaaccagcagacttgtctggcggtcagcggcaacgggtggcattggggcgagctattgtcagagatgcaccgatttttctaatggatgagccgctttccaatctggatgctaaattacgtgtttccatgcgtgcggaaatcgccaagttgcatcaacgccttgaaaccaccacgatttatgtgacccatgatcaaactgaagcgatgacgatggccgatcgagttgtggtgatgtctgttggccagattcagcaaatcgggacgcccgcggaaatctatgaatatccgcgtaaccaatttgtggctggttttatcggttcgccagcgatgaatttctttgatgtgacgtatcgtgatggtgtcatcagcgatggcaagggtcttcgcctcagtgtaccagaagggcgcgcaaaagttctggaggatcaaggctataacggtaagcaactggtttttggcattcgtcccgaagacattcacagcgaagaagcctttttggaaacctggccggaagcggtgatcgcatcgcaagtggtggtttctgaacttctcggtgcgaccagtcagttatatcaaaaaattgatgaaaccgaatttgtcgccatcgtgaattctcgagattttcacagcccaggagataccgtcaacatgggatttgatttgaacaaagcgcatttttttgataaagagtcgacggatgctattcgggctgatgcagaccgcactgtcaaggtataaacgcctgaataaatgagggagggaagtatgacacagtggtggcaacgcgccgtgatctatcaggtctatccgcagagttttcaggatagcaatggtgacggtattggcgatcttaaaggtctgattcagcgtttagactacctgcaaaaactcggcattgacgccatctggttgagtccagtgtatcagtcgcctggtcaagacaatggttatgacatctcagattatcaagccattaatccacaatttggcaccatggctgatttggaggcgttgattcgccaagcaaaagcacgcgatattcgcatcatcatggacttggtggtgaatcatacatcggacgaacatcggtggtttaaagtgtcgcgccagtcgcgcgctaatccatatcgtgactattacatatggcgcgatggttcggccacaggtggcccgcctaacgccatgaaatcaacattttccggttcggcatggcggcgtgatgaagccaccggtcaatattacttacatctttttggtgataagcagccagacttaaactgggcaaatcctcaagttagacaagccatctacaagatgatgaatttctggatcagcaaaggtatcggcggttttcgaatggatgttattgacttgattggcaaggagccggatcgcggcattcgagaaaatggtcctaagctgcatccataccttcaagaaatgaatcgcgcgacatttggcgatacggatttgctgacagttggcgagacctggggtgcaacccccagcatcgcccaacaatatgcagatcccaaaagacacgagttatcgatggttttccagtttgaaatgatgcaacttgatcagcaaaatgatgacaagtgggcattgagaccacttgacccagcggctttaaaacaggttttaatcaagtggcagacggcatttgattatacaaaagggtggaacagtcttttctggaataatcatgatttgccgcgaattgtgtcacgctggggtaacgatcaacgttatcgggttaaaagcgccaaaatgtttgccattttactgcatcttttgcgcggtacgccatatgtgtaccaaggtgaagaaatcggcatgaccaacgcacccgtggcaagcatagttgatgttcaagacattgaaagcgctaacatatatcgtgaacagatggcactggggcaatcagaaaaaacgattttaaccgccattaatgcaaaaggtcgggataatgcccgcacgccgatgcagtggcgtgatgaccccaacgctggcttcacaacaagtcagccatggctgcgggtcaatccaaactaccacaccatcaatgtggcggcggccttagacgatcccgattcgattttttatacttaccaacagctaattcgattacgccacgaaaatgatgtgatcgtcaatggccggtttgaagccattcaaaatcttgccccggcggtcatggcatattatcgcgttcttggtgatactcgttggcttgttgtggtcaacttatcggaaaagcggcaaccattagatcttaacgatcagctagaaaaaaccatcgtgacaaatgatgcaccattgcaatcattaacagaccaaactttacaaccatatcaggcattcgccgcgattgtgcggcatgtgtaagctaccagtaccgtttagtttattttagggggaacgattatgaagttttggaagaagatacttattggaagcgccacacttgtcaccgtcaccttgctagcagcctgcagcagcaagtcgacaagttcaaccagtactgatgctaagaaggtatcagggagtgtgaagctctgggtcgataccacccaagtgccttattacaaaaaaattgtggccaatttcaacaaaaaatatccagatgtcaaagttaaggtgacgcagagtccaaatggttcagcgaatgccaagacagatgtcggcaaagatcctgccaaggcagctgatgttttcgaagtgccaaatgatcagctgggttcaatggctgaggccggttatatcaatccgctttctccagatgccaccaaagctgtgaaaaacaataatgtcgccgtagcatccgaaggggtaacgtggaaaggcaagatgtttgcttatccgtttgcggaacaggcccagacgatttactataacaagtcaaagttaaccgcggatgatgtgaaaacctgggatggcctgacagcaaaaggcgtcttggccactgacttcacgaatgcttacaatttttatccggttttcttgtctgccggtacgcagctttatgggaagacaggcgaaaccgtcaaagggacggacatcaattcggctaaaggcgagcaagccatggcctggtttgcccaacaaaagagcaacaaaggcgtgatgcaaacttctaatgcgctgaatcaattgaagtccgggaaggcggccgctatccttgatggcccgtggaattctgcgaacatcaaaaagattttaggtaagaattttgctgttgcgccttatccaaccatcaaacttgatggcaaggacgttcaaatgcaagcatttttgggcattgcaacctttgctgtcaactcacatgcttccggatcaaaccaaaaagctgcagccactttagcgtcattcatcaccaataaagaatcacagttgattgtgtatgatcattctggtcagattccggttgataaaactgcccaaaagagcagcaaagttgccagtgatccagtcgctggtgcagtgatgacaatggctaagactggcaattcaaccctgatgccaaaaatgccgcaaatggcgaccttctggaatgatgcggcgccactgatcaatggtgcctacaccggttcaatccctgcaagtcaatacagcacgaaactcgatacgttcgttaaaaatatctctaaagcgaactaatcaacgttgaggcacaagcagaaggttggacgctaagctgtccaaccttttcgtttgataaggagaaggtatgtttagaagaaaaaatcatttacctcctgaggcgacgtatcgagaagtctggaaaaagggggatgcagcaactaaggcatcggtcttcctaatgggaatcagtcaactcaaaaaccgccagtgggtcaagggaacggcttatttagtcagtgaagtggttttcctgctttggttgatgtttagtggcacgagtgcgcttaggatgttaagcaatctcggggcagtcaaaaccaaacaggttgtgtttgatcaagctcaaggggtttatatcacgaaactgccagataattcggtgctgattttgctttttggcatcatggcattgattctgatggttgcgatggtcggcctatatattgctaatttacggtcggttcgtaaattatatgtgctgcatcgtgagcaacatcatgtgcccaccaatggtgaagaactagcatctctgttagacacccgtctgcacacaacgctattgatgctgccgatacttgggatcattgcatttacggttttaccgacaatttacatgatctcaatggccttcacgaattatgatgcgcaccatccaattgggttctcatggagcgggttacaggcgtttggcaacgtcttaagcggagatttggccggtactttctttccggtcttaggttggacactgatttgggcggtttgtgctactgtgacgacttttttcttcggtgttttgctcgctttgctgatcgaatcaaaaggtatcaagcataaagctttttggcgaactattttcgtgattgtctacgctgtcccgcaatttgtatccttattgatgatggcgcagttcttagatttacaggggccattgaacaatatcttactcggctggcatttgattgaacatccgattaactttatcggggcatccgccagtccgctggttgcgcgcgtaacggtgatcgttgttaacatgtggattgggattcccgtttccatgctggtttcaacagcaattatccagaacttgcctgaggatcaaattgaagccgcgcgaattgatggtgccaatgctttccagatttttcgtgccatcacttttccacaaattttgtttgtgatgtcaccagccttgatccaacaattcattggtaacctcaacaacttcaatgttatctatttactgactggcggcttgccgatgaataataattacaacggcgccggttcaactgatttactggttacctggctgtataatttaacctttgggcaaacgcagcgatacaatgcttctgcggtgctggggattctgatcttcatcatcagcgcaaccgtttcattaattgcttatcgtcggacaaatgcatttaaggagggctgatcaagatgacgtcatacaaaacacaacgccggctgtccttgatttttcgctatacattgctgagtattttagcggttgtctggttgattcccatcatttggattgttcttgccagtttttccttcaatgatacaggatttgtgtcgaccttttggccgggaaaattcacactcagtaattacactggcatttttacaagtgaccagtttccgtttgttaactggattatcaacacgcttttcgtttcggttgtctcaacgattctatcaacgttcgtgacgattattgtggcatacgcgttatcgcggttacgctttcggttacgaaagccgtttctgcaaatcgcgctgatactcgggatgtttcccggattcatggccatgattgctttgtattacattcttaaaggattgaatatgctgaatttcggcggtttaatcttggtttacgtcggcggtgccgggttaggtttctatattgccaaaggtttttttgatacgattccgcgggcaattgatgaagccgccgaaattgacggggcgactaagtggcaagtattcacccatattgggctgcccatgtcacggccaattgtcgtgtacactgctttaatggcatttattggaccatggattgattttattttctcgggcattattctttcgtcttctggtaatgccaaaaattatacgattgcttatgggctatacaacatgctgcacagcacaaaaggcgcctcgaccacgtattttacacagtttatcgcttttgtgtcatcattgcgattccgattaccatcttgttcgttattatgcagaagttttatgtcaacggtattactgctggggctgataaaggttgatgtggcagtcaaggaagatcgtcctcttaaataggacgattttttttgctacaaaaagtcaaaatgttttgacatttagaaaactagtattatactgaagatgtcaaaagggtttgacatcaaagggagtgattatcatgaagaaaatggatgagatggaacttaaatttagagatcagtcgattagatatgcatttgccttcatgtttacggccttagcactttataatatttcccaaatgctgatatcgtccaaattaaactttggaactgttgtccttggtattacaatcgtgattcaggttggcagttttgaatggctcaagcatcgggcggataaaacagataaagaaccaagtaaagttttgatgggagtcattatccttattgcggttcttttaactttgggtgtcattggattgatgttccatggaaaataatatccatgcactcagaacgcaccaacaattgactcaacaggaattggctgatgcggtgaatgtaacccgccaaacgattaatgctatcgagaataataaatacgagccaacgctttctttagctttcgcacttgcagaacgcttagagacgactgtggatcaactgtttcaacattagagaagctgaaaattatttaaggctacaaaaagacgagtgactttttccgatcaccgcatgtatgcggcggaaaagtcactcgtctttcgctgtattatagatcatcggtcatattttaaagattccagtgccaaggcggagcaatcggaggccagatggggctcagccgtgcaaacaacacagcgaccggactttgtcgctgatgttgttaggcgactttgagatcgcggcttttgcgagctcaaagcgccgtcaccgctctagctatgcgtcgccaccccatctggccggagattgcggagtttggaaagtcatcactttttatttcttaaagtgacaacttttaaggctattgtacggatactatgaaatacctcattgaattcaaacgatgttggcaccagtcgaacggtcagggtatccacctgatgtgtccgggcaaatgaccacatgtggggtttcttacccacggtcacacgcaaagtttcttttaaggttaattagtcattatgagggaataggaggtgaaccttggaaaaatcgccactcaagatcggtattttgaatgtcatgcatgataaggctgacaccaaaactcggctacagcatgttttgacgcacactgacataccggtcgatttgcatttttactaccccatgacccattacgccggacggacggtgccggaagcggtcagttcaatcctcgatccgctggacattcatgaggtggcgaagatggatgggttcatcatcaccggttcgccgattgaaaccttggaatttgatcaagtgcattacatcgccgaagttcgaaccttgttgaaaacgttaagtcagcatgtccctaatcagctctatctttgctggggtgggatggttgcattgaattacttttttggcatcagcaagctaatcttgccgcataaactttttggcgtttatccgcaaaccattcttgagccgcacccacttttgaagggactcaaaaatgacttcaagtcgccgcatgcacgctatgccgaaatggatgtccgcggtattcatgccgatccgcggctcacgattaacgcgacaacgacgaaaggcaaactcttcatggtgaccgaaccgactgatacgcaaactttcgtcttttcacacatcgaatacgatcggtggggattggattcagaatacaagcgtgaagtcgctgctcatccagagatcgactatgttcgcgctaaacattattatcatcacaaaaatgattacgatcatcccaagttcaattggaagaaaacgcaacgaacgatttttgacaattggattcaacatgtcgcggatcatcgcaatgacaatcattaggaaaatcaatcaactaatatggaggcttttaatatggtgacagcagcagataatattaccggtttgattggcaacacccctttgcttaagctaaatcgtgtcgtcccagaagatgcagcagatgtttatgtgaagcttgaattctttaatcccggcggttctgtcaaagaccgaattgccttggccatgattgaagatgccgaatacaagggcgttttgaagccaggcggcaccattgttgaaccaacatctggcaacactggcatcggcttggctttggtcgccgcggctaaaggctaccacctgatcatcacgatgccagaaacgatgagtgttgaacgtcgtgcgttaatgcggggctatggcgccgaattgattctgacaccaggggcggatggcatgccgggtgcgattaaaaaagctcaggcactcagcaaggaaaatggttacttcttgccgatgcagttccaaaatccggctaatccggatgtgcacgagcgcaccacaggtcaagaaatcatccggtcttttgatggcggcaccccagacgccttcgttgctggcgtcggcacaggcggcacgttgaccggggttggccgggcgttgcggaaaatcaacgcacaagtgcaaatttatgcacttgaagcagctgagtcaccaatgctcaaagaagggcacggcggcaagcataagatccaaggtatctccgctggcttcatcccagacgttttggataccaacctataccaagacattattgaagtcaccagcgaccaagccatcgacatggctcgtcacgttagccatgaagaaggcttcttgccaggtatctctgccggcgccaatattttcggtgccattgaaattgctaagaaacttggcaaaggtaagagtgtggtaacagtcgcgccggataatggtgaacggtacttgtcaacggacctgtttaagttcgaagattaaaggtacaattttacatcttgcattgatgaaatagaacatgaaatgaaagtggctcggtatctgacaaaggtcagctatcgggccacttttatatggataaaaattatatggaccatatgataaactaattaaatgcaagtatgcatcaactgatgatcatgggcatcagtccgtgattctttctttactttagtcatgatgatcaagacgggttcctttgaaaatgacggcttgaatttttggctctttctgcaacagtcgccatgtatagaccagactagctgtggctgacatgatcatgatgttccatgtgcttgaggaaaagttcttccatacgaaaagatctttttcaatctcctcactaagttccgataaaacatccacaggccatcctgatagcaacgcaaacccaagaccataaataaagatcacgatccagcctaccaaatattgccatccgtggcgaatttcaatgataggaaggccattgacatcatgtttttgagaaacgtggatttttaaaccagttgtttgaaaccagcccagaatggcaccaatcaagatggttaccgcaagtgccaaaaaggtaggccgcttgtgagaaactaataatataccggtcactaaggtataagcgggtatgataactaatgttaaccgtgagattctttcgaaacgaaagacatgacgagtgaagaaaaacaatgcagcaatgagtagtattatttgtgacataggggggcctcttattcaggattataaaggtagaacttaattttcaaagtttactgctttgaagatttcgaagcaataggacgatgcaaattattcgagaatggctataatgggaattataagtctccatggtgcaacggatagcataatggtcctcgaaaccacagatccgggttcgaatcccggtggaggcattctttctggcagattgattgataagcgctcgcaaggagtttgtcacatgaaaacagtgttgctcgcaacgatccatcacccaaacatctccttaccacaactcaaacaaatcactgccgcaaccaccaaaatcttttcggctgtgtatgtcacgattagtactgtgacttcgcctgaaatcacccagctattaactgaagagacagactttcactgccaagtcatcacaccgcatggcgcggccgatgctaggcgcaaggttcttgatttttgtttgcaggatgtcgactatcaggcaaatttgttttactgcgattttgataaggtgttgacggcaatgctgaccgcgcggcagacgttgaaaatatttgtcgctcagctgcagttgactagcgggtattgcattattggccgaaatgctgaagtcatggcgagttatcctgcaacatggcgagaaactgaagccattacgaataaagccgcggccgtattttttgctttacctaatctggatatcacggcgggatgttgtgcctttagccaaaatgccgctagatatattgtggcgaattcgcatgaacggttgacagatacagaatggccggtgatttgtaaggcggcggggttgccaattttagcggcgcgtgtcggctttttaccatttaatgagcagttaaacgctggccgcgatgatcatcattggcatggttatacagcgcggttggcgctcgcactgcaagctttgcagtcgctggagcaaggggacgtgatggcaaacaaaaacttgccgatcaaatctatacaaataggctggccattcaatcttaaaggctaactggaagagcttctctgttaaaaaacgtcccgacacaaaaaattgttgcaagcatccttgcttgcaacgattttttggtgtctcattttttctctgcagccgtcaatgcctgcgccagatcatcaatcaaatcctgctgatcttccaacccaatcgcaattcggacatgttgcggtgtcaggcctgaggtggaccgtttttcttcgggcagtttgaaccatggtaatttgactaaactggagacggtgccgagcgagtcggcgaagtcgaagaccttggtgctgttgacgaacttgatggagtcaatgttgtcggcgagtttgatggataggaggccgctggcaccggtggtttcttgttgggctaaggcatagccggggtcgcttttgaggccggggtaataaacatgcgccacgtcgggatgttgttcaagaaattcagcaaccgcctgggcattgctggtttcgcgatccagccggacagcgagcgtggcgatgccgcgacagacaagactacagtcgagcggtgcaagaatcgcgccgatggtattttgcaagaagccaatcttttcactgatttccggactggctgagaccactaagccagcgatgaggtcgccgtggccgccgatgtatttcgtggcgctatgcaggacgatgtcggcaccgagatcaagtggccgttgataataaggggtgaggaacgtgttatcgacgattgtgagcaggtcgtgggctttggcaagagtgctaatagccttgacgctgctgactttgagcagtggattggagaacgtctcgaagaaaatcgctttggtctcaggccgaatggctgcttcaactgccgttagatcgcgcgggtcaaccggtgtgaaggtcaggccatgttgagcaaaatactgattgagcaaccgatctgttccgctgtatagtgaatcaccgataataaagtggctgccatccgggaaaatcgcgagaaccgtcgcaatcgctgcgactccgctggaaaaggcaaaccctgcatcgccattctcgagagtagcgatttgacgttcaagatagtcgcgggttggattgctgctgcgggcatagtcccaatcgctagtgccaccatcaggcgcaaagcggtacatggcgctttgataaactggcggtacgatcgcaccagctttatctggttgcaattgtggaccatgaactagtttggtattgaaatgggtcatatgcccgacctcctcatatgattggttgacaacttatgtcgcgtcacggcctacatatagtcgcgacttttagccaatagttaatgggtaacgcaaagcgattatttagtggttaaatcagcgccaaagtatttctcagacaatttctttaaagtgccatcgcttctaagttcctgaatgcctttggataaggctttctgcaagttaggcgatttcttactgatcattccagccacttcgtcaggcttcacatcgctatctttaagtgtctggctctttaaaccggttgtggaattgctcttagcgtaggcataccaggcggcggtggcgttgatggtgccatctgcgcgattttccttaaccagattgagcgaaacagtgaagtcgccagaaggcgtaatgttggcaccgtattttttagctagggcagcatttggggtgccagtgccttcaacaaaagtcttgcctttgatgtcgttcaaacccttaatcgaggtttcatcgctgcgagtgatcaaagcatatcgggagtacatgtacggtgtggtgaagttgtaaactttcttacgctggggtgtttcactgatgttattgagcacgaggtcgaacttttgacttccaaggccagcgatcagggaatcccattgggtaggaacaaacttggctttgacgccgactttcttggctagagccttgccaagatcgacttcgaagccttgcagcttgccatctttgcgataagagaagggcgcataagtgccttcgaggccgatggtcaactcatttttattgataagttcgctcgtgaccgtgcttgttttactgctgtcagctttactgctagagcaagctgtcaaaacgaacgcggaaagggcaacaattggtaataagacccacaactttttctttaacattagaatcttccttccataatggtgtttttagttacagctgcgttgtctgcacattgctggtatagcgtgacgtgactttttcaagatagcgctgtccccaagttaagacggtgcagacaacggcataaagcaaagcgaccagtgaatacatcaatagtggctgatagttctcagcagcgatctgctgactcacctgaaacatttcgacgatagtgatcgaagccgccagtgaggtgtccttgacgagactgataaaactgtttgatagtggcgggacagccgtgcgtagtgcttgcggaatgataatttcacgcagaaccaagcgccgcggcaagccgactgagtaggcagcctcccattgaccgtgatcaatcgacagcagcgccgctcgaattgtttcagcacaataagcccccgtgttcaacgaaaacgtgatgatgcccgcaatcacaggatcgagtttgataccgtgaggaaaaatgcccggaatgatcagacttggtagtccaaagaagacaatgaacaactgcaccagcaacggggttgaacggaaaagccaaacataaaatgaagcgaagccttttgcaaaggtgatccaaaagccttttcgtaccgagatgcgcgtcagtgccgtgatcaatgcaatgatgaggccaatcgcgaatgaaactagcgcgattgggatcgtgtatttgattcccgcagccgccatttgtggaacggcatcggcaacaattttccacatactttttcctccttgaatcgactcacacaggcgtgataggttgattgaagtgggttgcgcgcgtccttgatcgtgctcagaaatgcgatcacaggcgtagaaacctgcgcataaacgtgcctgtgatcgctctacaaaaaaatccgcccaagtctattgtgacaatagacaaggacggattttccgcgttaccaccttgattaaccgatcgaaatcgattctctctaagtacttcgcaagtttgcgttataccctgactcagtaacgggagtgcccgtcagttgcttgcaagatgtgttcgcaactgaatgcttcaaaagaccatcttcgccagtgcccgatcattgtctttcaccaaatgacaactcgctgcggaccttcgactggttactcatcttttcgcctgtgtgatattgacatcacattaggctaaaaaacgattgttgtcaatagtgagtgtagaaggtttctaaccgcggccgcttacgctcttttaaacgcgtgcacaggcgcagaaacctgcacataaggacctcacccatttccttcccagaaattgcaaatatcaagaattgatgatgacgacgatgacggttcttcagcaggcctctctgctgcctttactggggcagtagtctgttgtcgtttagttttatttactttactttcctttactttacttttattgccatcatcttcttgtggctttgctatatctttgctattctcacttgatggctttgctatagctttgccattccatcgtttagctgccccttttttgccagcggccgcacgcttatttgaaacttcgtctttgattaacattcgtttgttgaatgattcggagtagaagcactcaccgttatcggcgaaggcaaataacccaaagttctcaacgatgtccttgattaaggatgcgtccacacgaaggtcaaaggctatcatgttgtaatctttgacactcatatattcgctgtcgtctcttagacgttccaaaagcataaagtacacgccataaccttcggctccgtatttcatacgaaccttcaagattttggcatcattgcgtgcgttgctgtcatgagggaaataactattcatgtttttccctccagtcaagaaacgctttttctgacttgtccttcttttgacggttacaacgccggcacgcggttgcaagattagacatttcatttgttccaccgcgagatattggaacaatatgatctacctcaagttttccacctacccggccacaataaacgcacgtataagcatcgcgtttaaaaacctttttccggatttgttgccacagcttcacattgacgttgtataggcgtttagctacaaactgctcataaaactcttgccattcagcattcaaatcgttttcatatacaactctctgttttgcggcaaaactgataaatcgttctctgcatggggaagacagccttgcaacccttgcgtttttctccaagtctcgccttactcctaattcgagaactgactcataccattttcttttcaatgccaagcgatcacctcctattcaataagatcgtaaagactaatgatctgttggagatgcttggtagcacgacagtattcgcagtgctcacatcgatggggtttttcctgtccgtttttaactgcttcaatccgtggctgaagttccttcaccttttccaaccaataatcgagcaagtcttgcggaattgagacagcagccttatcaggtggatcttgcttcgaaactgcgataatcaccggcaccgcctgcaccccgtactgctgtcggactagctcttggtaaacggccatctggagcgaatagttataagcttcaataaatgagccgtaacgccgttcatcaggcaaatagaagcgcttgttgatgtccattgtcgtctttagatcggcaaagtatttgcgatttgttggaagacaatcaagtttgcctttccacatcacaccaccaatctcgccacgtacaatgacttccttctttccctgatagaactctttgaacatcgggtccgttcggagcgttttaatcatggcatcagccatttggtattccttcttaagctggccttttgtggcaccacgtgttgagatgatctctggatgctgtgctttgaattttctgtgagcataacggctttgaaagtagctatgaagatagttaccgacaagtaaggccgttgggtctcgcttaggtctccattcacctttcatttcagccagtgcttcagcctcgcaagccatgaactttttgaaccacgtcggtgactcgtactgccaatccatgcgattgctgtagtagttcctacttgttagcttggccttggaagagatttgcgacttctttgtctgtgactggttgatgttcagatcgttctgcttgttctgcttgttctggctctcttggttcgtcctgatcggcatctgcaacatgctttttatcctccttcggtttgctatcaatcaaatcatcaaagttaggtgttacatctctcggctccgagttatcgtattcatcagcggcggtgtcgtttacggctccaagcaacagatcattgtctgagcttgagttgatgaaaaacttggcagcacgattaagcaccgtgcgtttagccatttcttcagggaattcttgttgtaccttcttggtcttcgcatggctccagctttgatcaatctgtttttttgtcatgatggtgaaattctcggtgccgttgttgtcaacaatcaccgcaaaagcaccggcaattggattatcttggttttcaatgcgtggctcgaagactttcacaaccgtgcgtcccctatcagaaccaatttgaaagttgtcgccttctcgaacaacttcagcccaaacgtctttgacgttgtcaagccttttcaagattgctaagcttccgaaatatgagcgcatcagtgttaagtctttgccataaggaataaaatagacctggttcttcgcagggcttaaaccctgaataaccatattgagcaacgcctttgcctgtgattgtgggcttgttttgtctaaaagcgacgggcccttgctattatcagatagtgttagccaagccgagttcagggcattactgggactgtaattggccggaagcttcaatccctcattcttctgcatttgagtgatacggttgttcacgcttgctacaatttcattagccatgttcaaattcctcctagtagtcggcggcaatcgctacaccgctgagttcgtgcaaaatatactttcgaatttcggcaggatcatctttgatcgtgtcgccttctgggccaacgttcgcgatgatttcatcgcctgagtaaatcggatcacccttccaatcagtgcggactttttttatatccatttcacttcgccgccttccgtgataaactaggagtgaaaataattttgcttagattcttgcttcccgtggttgcagccatgggatttttttgtgcgcatttgttgagcatccgttgactaagttcgaacatccaaagccaaccgctatctccgtggctcttgtaaatcacgttctcggcttgatcatgaatgtcttgccaatatgccttcgtatcacgcatagttcttcctcctaacgtgtccattgtttccagcctcctactgctgtggcgccgatcatgatgccagccagagctacaagcagatacttccaaaaaactgatgttggatcgaacagcaccgacataatcgcttctagcatttgttacacctcggtatatgtttccatgaatttatctacggcaccttcataccagcgcatttggcgcttatcgcttttcttggctccatcattgcctgcgtagtaacggggcatttttggattaaaagcaattcgtttgaaggcatccgtttttgtgtctaaatgaagtttcttaccaagttcctcttgcgtgagtcctttcttaggccgcagcttttcgatttcagtagcaactatgcttttgatgatggggacgactgccttcacagtttcctgaataagcagatgtaaaagttcttggctttcatctaacttcaccgctacatccatgctttcaccttctctacaggtctgatttgagacttcaatgaaccaataaggctttccaggctttcaactagtgattcacctgaatcgatgtatgatctgatcttgctcacatcagttggcgtgaagtgatcacgtcctttagacattgctggttctgctcgttctctagcctcttcaaatttcttttgggccattttttcgtatagataaacaaccagcggattatcagtatcgagatcatcagcaaagactcttaatccggtttgatattcgatcaccgcttttagaaagcgatcattgccaattgcaagtgccatgggaatcagcttatcgtctggtatgcctcttgcttcccaattgctgacagcggcttgcgtaacgtgcattttcgcagccaagttcttacgagttaggccctcttcttgaaggcctcttgaaaattcctgaaagatgttaattgccataaccacacctcctttaaatgtgtaccgccgatatagtagtttcacggcgatttatgcgattattaagctgtagcaaggtaatcaatcatttcgttccttgcacgttccctttcagcactgattgccatttcgagcatgtcatcgtccatggtttcccagaatttcggacagaaacataagagaattgatttatccgaaaggagtcctcaaaatgacctattcacgcaatcgctacgaccaagattttaagaaaaatgcggtacgtttgagttttaactcttccaaaccagttaaaatcattgcctccgaacttggtgttcctgaaagtgccctgtatcgttggcggaagctatataccgaagatggaaagcaaacgccgcttgcttctttagaagctgagaaccgtgccttaaaacgtgaaaatgccgaattagcattggagcgtgatatgttaaaaaaagccgccgcctactttgccagtctccagaagtaacccccagcgataagtatgcttttatgttgagggaaacctctgtttctgtggtaaggtgggcgcgtttgttagacgtatcaacgagtggttattatgcttggcggagagctttgccaaagcgaaacgccaaagaaaggcaatatcgtcaacgaatcaaacacttttttgatcaaggacagggcacttacgggcccaaacgcatctgcggtttattgcgtaaaaatggtaataaagcttcctatcaccgagttgcccgtctgatggctgatggcggtctgtattcaacgctacgttgtcgtcatccgaagagtttgaccgatagccgccttgctcgtcaaggtgattatcccaatctagtgaaacaccaatcttttaagccgtttgaagccttatcaagtgacattacacagacgacaacatcagaaggaaaagcttacatttgccaaataagggatttgaacagcaacctagtgttagctcatcaaatatccaatcatatggacacggatttagtcttagcgacacttaaacaagcccaccaaaggtgggctttgccagaaacgtgtatttttcatagtgaccgtggtagccaatacacggccaaagcagtgacaaagttggtcaaccaatatcattggcaacgtagcttctcagcattgggaaaaccgggtgataacgcttggagcgaaagcttctttgccatcatgaagaaagagctcatttatcagatacaatttaaagatatcaatgatctgagagcgcaagtcttcgcttacatcgagaccttttacaaccgcgtaagggtacaagcacgcttagactatcttgcaccagtagcatggctttccttgtatgaccaagcttcacaaaaagtcgcttagcaaactgtccgaaaaagtgttgacttccctcaggttatgctgacaaatttgtccaaaaattcggattaaatttgcaacctaccatataaataaataggttccaaaacaaatagccggcaatctaattgccggctatttgtttagatttgttcttttatgttgtatccaagagaaatattattgatagcgacttcgactttgcaaagtcatgttgctggcctaaaagtttgtagcaacgaggatgaggaggaggctgatgttataaattaatttgccaaccttttaaagattttcttgactactgaaagcgtttgaatataataaatagtgaacagaaacaaacattaattaacaggagttgagagaatggctaagacggttgagaatgacctttttgatgcagagttagcatttgtcgaggatggtgatgatcaggatacagtctttaagcaagtttccgatcaattactagtagccggtgccgttaaaccggacttttatgaacatctaagcgagcgggaaaagaactatccgacaggcatcgatatgagcgttgtgaacgctgaatatccgaatgtagcgattccgcatacagaaggcgaattcgtcaatgttagaaaaattgttccgatccgcctcaaaaagccgatcgaatttgccaatatgattgcgccagatcaaaaactcaaagttagctttctgttcatgattttgaataatgatcccgagggccaggccaacgtcttggcacagatcatggattttctgacaacatcttctgctgaaacattagctaaattattcggagcagacgatgcggcaacaatttacaacgttttggcaaccagttttaaaaaataaggaggaagtttgttatgacagtcaagattttggcagcttgtggtgcgggtgttaattctagtcaccagatcaaagatgcaattgaaaaggaatttaagaagcgcggctatagcgttcaggcagatgccgtgatggtcaaggatgttaatgaagacatgatgaagaattatgacattttcactccaattgcaaagaccgatttaggctttacaccgacaattccagttattaacgcaggtcccatcttgtatcggatgccagccatggcgaaacctgtttacgacaaaattgaaggcgttatcaagaaggaaaatctgaaatagtctcatggtctgatggcgatgaaccgtcagatacatataaggagtgagaaaattcatgcaaaccattattgatttggccaatgcggtcttcaagccagttattgatttaggggcagcaccgattatgctgatcgtgctgaccttaattgcttgggcggttggcgttaacttctttcatgcgttggaaggcggcatcaaacttgcgattgcgattaccgcgatcgggagtgttatcggtttattgacaaccacctaccagccggcgttaaatgctttcgttaagtctacagggatcaatctttcaattactgacttaggttgggcgccactcgcaacaattacttggggttcgccgtatacattattcttcttagcaattctggtcatcgtcaacttgattttgttattcttaaatcggacaaatacgttggatgttgatatttttgatatctggcacttatcatttactggtttactggctatttatttcggggctaacctctttattgctaccattttggtcatcttcatcggtattttgaagattatcaactctgatctcatgaaaccaactttcaacgacttactggacgattgggaaaatccaatgacaaccacgcatttaaactacatgatgaatccagtcatcatggtgtttgataagttgtttgacaaactgttcccatggttagataaatatgattttgatgctgcaaaattgaacgaaaagattggtttctggggcagtcgttttgccattgggatttatcttgggatctttattggtttgatctcccaccagagcgttaagtcaattgcgacactggcctttatggctgctacctgcttggagctgtttagtattatcggttcttggttcattgctgctgttgaaccgctgtcacaaggtgttactgattttgccaacaagcgtcttggcggacgtatgttaaatatcggccttgactggccattcttagccggccgtgctgaaatttgggccgccgctaacgttttggcaccaatcatgttacttgaagcattgatattgcctggcaaccgcattctgcctttaggtgggatcattgccatgggtgttaccccagccctgctggttgtgactcgcggtaagattattcggatgatcgttatcggtgcgattgaactgccgctcttcctttgggcaggcactctctcggcaccatttatcacacacacagcgcgtgcattgcacgcacctggtattccggcaacagggctcatctcttcctcaactaaggaaggtccaatcgaacaattcatcgctgtgcttgttggtaaagcttctaaaggcgaaatgatgatggtgctttacgctgccctagcactgattgcatacaccgcattattcttctggtatcgtcatgaaatgatgaagcggaatcagaagtactctgatgaaggtaaagaagttgctgacgacgttaagttcgttgcaacgcatggtgctgcaggatccgcggactaaaattcttaaatcttttaacttacaatttcatcatgagatgcataaagagcctccatcgtttttgatggggctctttttgtttcatcaatggaaaatagacgttattactttttgagaaacaagtagaaggacattttaaagaggcacaaaaaaaatcgcgatggccttcgcaactttacgtgatgattgaataaaaatggctgaattgatttaccggcttgcccgattctcacgacgctttttacgatcaaagacatggtccattttgagtagctgatagagggcatagcaggcggtgaccatcactaatacttgtgtcaatgagtttttaaaaataccgtttatgattgctacgaatgtcacaagggccaaccacagtaagtaagtttttctacgtgccgtcatcagattacctccattggcttttgaataactctattataccgcagataaagcgctaacactagtcaaaaaagaactaaaattaacaatatcgaacaggcaacacagctcgtattattgaggctaaataaggttgcgggttaataggcatcacttgcattgaagtggtaaagcacggagaactaaaagcaaagaaaaataaaaaagctcccactgcatccacaaaacgcaatcggggcttctgtttacttgaaaaacataaagctgttacagtctaataaatcgaattacagtcttgctccattctcaatggggggactaaccacgttctttcgatgaagggcgtgagtgcgatgtcaacgtgggctggtggacacgttaaagtgacagggcacattttggatgctgtctgagttgttaacataggcgcattcggccactgtaacttagtctaaatgcttcacctgaacgagttcgccggtgacgccaacttgaataccttgcttgatcttgtctgtccgacttgcatggacgacttgaaacttattttgcttaacgattagcttgttatcagtgtgatagtcggctggcaatggttggttgctgccgcgcacaagcatcacgataaacttgaagccgctggcatgtgcttcgcaagggctgtaatgaagggtgtcactgaagaattcaacaaccgttccagccgggacgaagaaaagcttcgcgtctttttcggcattgaattggtcgtcgtgcatctgcccgcgcttaccgatcaccatgacaacatcggtgaagaaaacgttcacttcactgccttgatggaattcaaccgcagtcaaagcttccgcgtggccagcacattctcccgcttcaattggcaagccggcgtaaacatcacgaccaatttgctgcaccacaggaatcttttccatgtcgggatttgacgggacgtagagattggcttcactaggggcggggatggtgacatgctgatccatgaaatttttgagctcactgacgtcatactgtgcgtaagtgacgccatagtcggcaaacgccgtctcatctaagctatggatcgttttatcttgattaagggttctgagctgatcaatggttgacatagatggacttctttctgaatgttaataggattcgatggtgactttggcaaaatactcatcaaacttagctggattgacgaagccggtttctgcttccatggtgttcaacatcccggttgtcatcgccgttttcatgatgtcttcatccgatttgccatcatgaatgcccatggctaagccagccaatgttgagtcgccggagcccacaggattaacgaccttaatctttggaatggcagcgtgatagaacttatccaaatgttttacgaaggcaccagccgcacctagggacacgactatccaatcgacaccatcaaaaatcgggtccatcagatcgtgtttcaaggccgtgtagtcggttttgtcaacatcacggttgagcaggccgccaagttcttcttcgtttggcttaatcagcaacggtttcacaggtgcttctaaagcggattttaaagtggcacctgatgtatccagaagcactttgacgtttttttgacctgcatgggcaatcatctgggtgtaataatcagccggtaatccttgcggcatggaaccggagatggtgatcaaatcacttttgtctaacaggctgtcaaaatggctaagaaatttctcggcatcttcggcagcaattgttggtccggcttccagaatttcagtctgttcgccgccatcatgtaacatagcaatcgaactgcgggtttcggcatcaatcgggaagaagtcatggtcaataccgtcacgatcaagctgattttccaaccacttgccaaaatagccgccaataaagccagttgctgtgatctcgtgatttaacatatgaatgacgcgagatacatttaatcccttaccgccagcagttttccgcaccgttttcacccgattgacggtgtcgattttgagatgttcgagcgggtaggagacgtcaatggatgggtttaaggtcactgttaaaatcataagtattttcctccaaaaatgtgatgatgagctgggtcggatacaaacctaatcacgggagacgttataaaagccgattccctgaggagtcggcttttatcgtcttcacgcgaattaggcgtgttcgaccttgtccgtccaaggagttgccgtttcagctaagaccttgtttaagcgatcgatgtttgctttgccttcggtttccagccatgctttaccagcagcttcgccttcagcagcaaatggtttcacgcctggtttccaagttgcccggccgcagagaacaccgttgaaggttgaacctgcttgctttgcaaatttcagttcttcgaggaacaattcgtttgaaacgccggcagacaggaaaatgaatggcaggtcggtggcgtcggattgggctttgtaatacttggcagcctcctccttggtgtaaaccggggtcacgccttcatctgtgaagccttcgacaaacttctgatcaactggaacctcgacttttagaacagagacattgtactgtggtttgctgaattccttggtgatcttgatcaccttatctggctttacctttgcccatgcagtcgtcccagtttcattgagggtgccatcgtaggaaaccagttccaagaacaatggcaaatcgttagcctttgcttcggcaccaacgcgttcaacgaaagcatacttgcgatcattgatggcgtcaggttcgtctggatcgatataaagcaagaatttaacggcatcgccgccttcattcttaatgcgcaacgcactttgatcatcaatcagatctggaaaacggccaggttcggtagcatcataaccggtcttttcatatgaaagcagcaggccagcttgaggggcacgaactttagcggctggcagaccatattccggatccagcagaatggaactagcgtatttggttaattcctcagaaacagcctttttgaaatcaacaatggtggtttcatccgctggcttgttggccgctgctgcaagcatctttttcaaggaaccgcgttgatcaatggccagagcagagatgacgttgttgtcatcggacaattgttgcaaatgtttgtattggccagcagtaagggtgacagtcatgtagaaattcctcctaagaaatagtgtcgaagtgataattagtcgtggtagacgccttcagcccacttttcgagttcagtatcgaagaagtgtggattgtctttttgttctggatttggcttagcaatgttgtcaattttatcgatgatcttcttgttctcaggggtttctttataggtggcatccagataagctttgacaatatcttggatcatatggataccaactgtggcaccaccgatgcccaatacattggcgtttaattgttcacgtgcataaacagccgaggtcacgtcatcacacatagctgcccggatgccgtcgtttttgtcagcggcggttgaaataccgataccagtaccgcacatcacgatgcctaagtcagcgcggccgtcagcaacatcttcggcaactttcttaccataaataggatagtgggtacgatgggtgtcataggcaccttcatcaatgacggtatagcccatatcttttaacatgttcgaaatttcaattttctgcatcgtgacgatgtgatcgttaccaatagcaataatcataagtgtgaagcttcctttcttcttttaggctgagggcaaggggattaaatcattttttcaagcatgtcgaggcggatttggtgacggccacctgcatattcggtgtccagataacgttggataatcaccagtgcccggtcataacctgtgatgccagtgccaatggcaattgccttggcaccgttgtgttcagcggtcatatgggcggtgttttcttcttcaacaaccgcggtgaccatgcccttgactttatttgaggccattgctgagcccacaccgtaacggtcaaacatgatggctttatgcgcatcgccgctcaacagttcctttgtaacagccaaagatgaatcaacaaagtcttcagcaggttctggggtcatatccttaacccgatactgatgatcctctaaatactttttaacttgttccttcattgcgaatccatctttgtctgcgccaataatgacatccatgttcttattctcctttatttgttttatctgtgatgacatgtgtgaacgtgttgtaatgttgaagatcatcgcgactgatgcccggatcggtaatcaagccatctgtctgatcaagatcatagaagctatagaagtcttgccgatttaacttgaaatgatctgcgaccacaagtttcatgcccgcattgtctaaggcaatacgttgtgtctggccttcttcggggctagcattgctgatatgattgtccgcaataccgttgacactgataaatgctttcgtggtggtgagatgtgctagcatttcgtttgctaagctgccgataaatgcgccagatcgagcccgaagccgtccgccaattagttgcagtgaaaagaaatccgcgcgatcctgaaaactttgaaaaacagggagactattggtgatgatgcgcacatctggttttttgagatattgtgcaatcatttcgttcgtggtcccagggccgatatagatcgtgtcgcctggtatgatcagtgcggcaattgttgcggcgatttttcgcttttcattcacatgaatcgatcgcttttcatttcgggataattcagtcagcggcttatagttggtactttgggcgccgccatgaatgcggactaattctttttggtcggcaagctcttccaaatcccgtcgcaccgtcatcgttgaaacaccaaggctttccccgatttcgttgacagttacaatacccttgcggtcaactaaattacgtattgtcagtaagcgctcgtcttttaacatatcctcacctcgcacgtgtgttcattgttgtttgattttgtttcttattacattgttcaagttaccaccgagttcaatattcgtcaagcctataaatacgatgtctattaagatatcatttgccttgatgataaaagatagagatcacaagaaaacggtttacaatgaacaaacggatataatgcagcatttaaccaaacagaaaacaacatacacacagaaatctgctttcacgaacgttttcacaaaaatgctcatgctcggtgacctgtgtcggatggctttttagctggtgtagatgagaaattcatggcataaattcaaaaaataagttttaaaaaaaaccgccaatagttgcatgtgcgcacgcaccctttggcggtttttggttggaaattgtggataaacgtcattttaacgtagtatataataggaacaacacgtcaagctaaggttggcaaagtcagcaaatcacttgcctgttgtagcaccgcaacccgaggcattacttcattacttggcggcgtggtccaacctgcaagtgcaaaagcaaccttggcgtcggcagctgcctgtgcatcagtcggtgtatcaccaatgtagatcgttgatgctggctcactgcccaaacgttcacgtgcgagggtgatgggatcgccaaagggtttgttgcgtttggcctcgccagcaatcacgatcgcgtcgaagtaaggactaaaatgaaactttttgtcttcttcaatgaactgcgtcttgtcttttgacgtcactaggccaagcttgtaggtttgtttgagctgattgagcgcatgctgcatacccggaaaccaagcaatgtcggtgaggaattccttcgaatcttctcgccattgttcatggacttcaggaatttctgcggcactgaatccgagttccgcgaggctgtcaacgcccgcacgcccattggtccaggttaattcatgaatggggacctctcggccatggcggcgtaatgttttttgtaagccatacaaatatgcctctacattgtcgagcagcgtaccatcgatgtcgaagataaaagtgttcatgatattcctcccaataaagataattgtagcaagtaagcgataacaaggaaaggcataacgatgagattcttacacacagccgattggcatattggtaaaaaactaaatgattttgatttgcttgaggatcaacaagctgtgtttgagcagctggtggaaacggctgagacgcataaagttgatgccattgtcattgcgggggatctctatgaccgcgccttgccaagcgaagctgctgtttccgttctggataacatgttgattaagttgaatcgtgaccacggctatccgttgttggtcatttcaggcaaccatgactcggcggtacgcctgcgcacaggtcgggcatggtatgccgctactaaaatgtttgttaatacccaagtagccgaagcttttacacccattgagttggatggcgtgcaattctttttgctgccgtattttgaaccctttgctgttcgtgactattttcaagataagacaatcacgaatgtggctcaggcaattcgcccgattgtcgcgaaaatgaagactttatttaagccagatatgcgtcatattctggttagtcattttttcgctgctggaagtgaccatagtgcttcggaaacgaaagttaatgttggtggactggacgcggtaccgctggatgatttggcagcatttgattatgtggcactagggcatctgcacaaccatcatgctttgcatggtgaaccaaagattcaatatagcggtgctttgttaaaatacgcggtcagcgaggccaatcaagaaaaaggggtctatattgtcgatactaagaccatggatcgtgagtttgtgccgttgaagcctaagcacgatttaatcgagttaaaagctagttatgccgacttgacggctccagcatactatcagcagcaggatcgagacgcctatattgggattgatttgaccgatacgcaagtaattccgaatgtcatggcgcaattacgccagatttatccgcggattattagcctgcgccgtgagaacggtgtgaatgccatcaagcctttgcaagagcggcagcgtgatttggatccgatgagtttgctgcagactttttttaaagatatgacacaagatgatttgtcggccgcccagattaagtgggcgaaggcagggttgacgacggctaaaaaggagcaggcataatgcaacttaaacaattacacatgcaattttttggcccgtatgcagatgcagtcgttgattttgacgattttcgcaccagtcccttattcttgatcagcgggccaaccggcagtggtaaaaccacgatttttgatgctttgatttatgccttgtatggtgaaacgtcaggtgagcgtgacggtgggcaaatgcgctcaaattttgcaggtaacagcgatttaacaaaggtgacactcacctttgatcatgatggcaaacattatttaatcgagcgccaaccgccgcaattgcaaagtaaaaaacgcggcgatggactaaccgaagtcaaagctaaggtgttgctagctatctcctcagatgaaaaacaggtggctgagtaccgtaagaaaaatcaagttcaggaacagctagacgccgttttacaccttgatgcttcgcagtttcgacagattgttttgttgccacaaggcgattttcgccggttcttagatgctgatagcaatgcgaaagaagatctactgcgtgacttgttcgggactcagttgattcaacgttggcaaaccgctatgttggcgcagatgaaggccaagggagcagccattcaggaccaagagcggatgttagacgttttgatgtcgcagtttgacttcgagacggctcctgacgagcatgctacgatggtggataagctgtcattgatgagagcaacggtggcgagtcaagcgaaagttgtgacagcaagacaagcgaccgcggcgcaaagtcaccaacgatatcaggaagcacaaatggcactgcaacaggggcaacaattggcgcaggcttttacagagcgagaacaagccgccacagctttagcaaaactggcggagcaaaaacaaacccatcagaagcaattaaaacaaattgaacaattgacatgggtacagcaacatgaaaatgctgctcaacgtgttcaaaaggctggacaagatcttaaagcggcaattgtgcagtctgaacaaacgcaagcagctttaacgacgaccgaacagaaattttctctggacaagcaagctttagcacgcttgcaggccaaatcagaccagattgaggcccaaaagaaacaactgaatagtttacaggctgttcagcaacagttgacagccatcgccgaacaaaataaacaggtgattaaacaagcagcgattgttgatgaggctgagcttgcgttgacgcacgcacaacagcagttgacagacacccaaaccgttaaaacacagcagcaaacaagtctggataacttgggcttggatgagctgataaccacggtcaatactcagcgcaacttattggctgccttagtgccacaggctgctaattatcaggaagcccaagctgatgttgcacagttgtctatggccatcaaaaaaacccaagttacgctggagcaagccgaaacgcaggtagcagccacaacctcgcatttgaacaagcttcagcagactcagattcgccaacaaattgcacatttggctgctaagctcgagcctgacagcccatgtcctgtttgcggcagtactagccatccgcatccggcgcttgtggttgacgaaccattggtgagcgaagcagcgttgaaacaagccgatcaggaacggcaaaaggctgccgcaagaaaaactatggtcgagacacaattggcgaatcttgaaacccaactgaaaactgcgaaggccaaaattgcacaggcaaggcaggcttttactgagcattggcaagaacaggccaaactgattgcaggcgttgcggataaaactggtattttacaacaattaacggcgttgaaaacactggcggcaactaacgagcaccagttaacggaagcgcaaacggagcacgctgctttgcaagttgcgctaaaaaagagtgacaaggccatcactaccggtacgacaaaagttcagcaatgcgaagctagtttgaacacggctagaattgatgcggctgaagcgcaaagtgcgttgaagaccatgcaaaggaacctgcccgcggaagcgacggatttggcgacggtcgctgctcaagctacaaccctgcagacaaccattacaacgtatcaggctcaacttcaggaggcgcaggcaagggtcaatgctttggatcggcaattagccgggttgcaagcagacgagaaacacgccgcggcacaagtgactgctttgaccaaggaacaggcggaagcaaaagcaacctttacgatagcagtcacgcagtattttggtgctgatggcaagcaacggttcgccgagttgcaactgcgggtatcacaattaccgctattgaacgaacaggttcagacttatgagcatacacagctcaagcaacaaacgttattagatgccgccaataaaactattggtacccaagcacagccacagcttgatcagcttgaggccgaagcaacagcagcggaaacgacagcaacaaacgaccaaacggctttgattaagattagtcaggcgcatgatgctgctgaaaaattggccaaacaagcggccactatctttacggccaatcaaacggcgcttgcagcctatgcggatttacaaacactggccactgtgatgaatggcaatggtcccaagaaactcagtctggagcgatacgttttgcaggcttatttgcaagaaattctgaatgtggccaatagccgtctgcaggttttgtccaataaccggtatcaatttgttttgcataccagcttggggacgcagaagatccactctgggttggaaattgatgtttacgatgatcaggttggtgagaaacgagctgtgcagacgctatcaggcggtgaaagcttcatcgctgcccttagcttggcgctggctttaggtgaagtgattcagcaggaaagcggcgggattaatattgatgcattgtttgttgatgaaggcttcggcagccttgatgccaatagtcttgatgtggcgatgaatgcgttagaatcattagaaggcgaatcgcggctaattggcatcatttcacatgtgaccgagctgcgggataatattcccgatcagttgcaagttgagccagcaggtacgggccgcagtcgcttaaagatccttcactcggcttagcacttttaaattgagtgtgccaagtctacgtgaaagtggtataacagagattgtaagggtcaatcctacgaactcacaccaaaaagaggcgacatcacatggcatcattgagcaaagaacagaaaaaagctttgatcgctaaagtcgaaaaggagcgccaagaccatcccgaaaagaagtcaaagaagtctggcttcgaaacgattgacgaagaagcagaacgccttgaaagcgaaaattaatgttagttgagtcgctggtcctgaacagttaactgttcagggcttttttttgcagagcgcaaaccggcccgcttagaaaccgaagcataagtggccccgaacctaaacggtagggctttggtcgtttaggttcggggtccttatgcgtaggtttctgggccggtttgcgcgtttcggagttcagcaatatcaggcagggctttggtcgtttaggttcgaggtccttatgcggaggtttctgggccagtttgcgcgtttcggagttcagcaatatcagacaggtctttggtcgtttaggttcgaggtccttatgcttcggtttctggatcggtttgcgcgtttcggagttcagcaatatcaggcagggctttggtcgttttaggttcgaggtccttatgcttcggtttctgggtcggtttgcgcgttttcaaagatctatagcccaatattcagtttcgggacagccagatctgcaacttttgcgccccagtgacagtaactgtctatgatggcaagaacggtatttatcgccattaagctagcgcttttacccatgacgccgcatactagtcgtgtctattgagcagttgccgcaatactaagacttttttaataatggtctacaaagaaattaaaagctataacgcatgtgagagtatgcaaagaagccgattaatcagcttctttcaaaaaatattagcaattagcgttcacaagtgctagtttgtggtataactataggtggagcgagggagaaggaacaagagcttcagagcaaatgtgtttctcccgaatcgccaaagtctctatattgaaaggaagctatctgttatggctaatgaagttttgaatcgtcgtaataatgagttgatgaacaatgtgaatgatccgttctttgacaacttggcgcgccggttcttcggcccggtatctgactggatggattgggcaacacctgccatcaccagcacggccgtcaacggattactgactgatgttaaggagaccaaggacgcttacgaagttcatgtggatgtacctgggattgataagaacaacatcaagatgaactaccacgatggtgttttgagtattaacgttcataaggacgatatcaccgaccacgctgataagaacggcaacgtcatgatgtccgaacgtaactacggcacaatgagtcggagctatcaactaccaaacgttgatgcaagcaacatcaaggcagcctatcaggatggtgtcctcaatatcactatgcctaagctgactgaatctaaggagtctggtcacaacattgaaattcaataatgttcgtcatcagttgacccaagatttacggactgcattgcaagcatgaatagaagcggcacttctgccgttagtgggcagaacccatgagtaagcaaacaaaaagcgatgagaattgccgcagttgcagtgatcattgagtcgttaaagtcaccccagcgatacgtatggtcgttggggtgatttttttgtagagcgcgaaaaggcgcgattagaaaccggaacataagtggcctcgaacctaaatgacagggctttggtcgtttaggttcgaggtccttatgtgcaggtttctgcgccttttcgcacgtttcagagagccacaatatcattgctaagctttagccatttagattcaagctccttatgcgcaggtttctaggtcagtttgcgcgcttcggcgagccacaatatcatgacaggcctttggtcgtttaggttcgaggtccttatgcacaggcttctcgaccttgctcgcgcgtttcagcttgcaacaaggattcccactcaccaactaaagcagttcaatatttcccgtttttcaagtccatggtaagctagtggttatgatgacaaacaaattaatgaactggccgccggaaaaagtggcggcttttcaaaaggccttattgaattggtatgatcaacatgcgcgtcaattgccgtggcgcgaggatcatgatccttatcatgtcatggttagtgagctcatgctgcagcaaacgcaagtgcagacggtgattccttattatgaacggtttatgaatcaattcccgaccgtgggagccttagcgaaggcgccagaagcagaggttctgaaggcgtgggagggcttgggttattattcccgcgcacgccgtctgcaacaggcagccaagcagattgttgccgattatggcggcgtttggccgcagacctcagaaacactgcagacattgtctggcatcgggccttacacagccggagcgattgcgtcaattagtttcggggaacctgtacctgccattgacggtaacgcttttcgagttttcgctcggttgtttaaagtggatgcggatattgcccggccacaaacgcgtcagctcttttttgacttgattcagccactgatgccaaaagatcgacctggtgattttaatcaggccgtcatggatcttggctcaagttacatgtcggcgaatcacccagaccctgcacattctccggtgcgagattttgatgccagttatcgagatggggtggtttcggcttatccggttaaaacgaaaaagccacggccggtgttgcatcgttactttgcgttagtcattcgctcggagaaaggctatttacttgaacagcggccaagtactggcttgctggctgatttgtggatgtttccgctcgttgacatggcagatcttgaaagtaccatgatgagtgcgcagttagatgaggtcagcacgttgtttgtggcatcgtcagggatgcagctgacgtttgcggatcttggcgcgaaaacggttaagcatacttttacgcatcagcaatggcaattgacgttgattggggtcgagactgcggcgagcgatctcagctttttaccagcacggtgggtgaaagcggatcattttagtgagctggcgttgccgacggtgcagaagaagttgaatgcagcgctggggatgaattagaaattggtattgaatgagtggcttagtgattttgaaacatgttcatcagctcagaaactgggccgtctcacccgctggctgaaacgtgcgaacaggcgcagctcggctatgcccagttaaccgttccgcttcacgccctgagtcaattgcttacatttcgccgttgagcgggttatactgagtgcaaatttgattggagaggtgagcgttttgacagttaatgtaacaagagatatcgcttacggtgacgcagcattaaagaagcttgatttttatgaaccagagaagtcaaatggggcggcgatcctcgacattcacggtggcggttggtttcgcggtgagaagaataaagaaggcgagatggctgaaaggtttgccgcacttggttatacggtggcggttcctaattaccggcttgcacctgaagccttcttcccagcagctcgtgatgatgttttagcagccttttcatggttgcgtgagcatactaaagggttgcaacttggcgtttttgggtccagtgctggtggttcgctgtcagttgacgttgggttagccgaaggggtaccgacagtttcttggtcgggcatctttgacattcgtcagtggttcgcagatcatccagcagtcgttgcccagccggatacgaaaaccgattttgtgaaaacggcaagtgcgaaaattgatcaaggtggtcgtaatgatccattttacaaatggttcattttgaattatgttgattcagatgaaacaaagttccctgaagttgaaccgtttgaccgtttgaccgctcaggctggacctttgtatctggctaattcgcaggaagagattattccgattagcggcatctatcaattggcacatgccgctgaaaagcttggcttacctgtaaccttgcagtcgattccgggcggtcagcatgctgaaggctatcttgatgaagcgtggcagggcacggttgcgttctttgcccagtatttgttgaaaggataatcgtggaaacattagtcgttgtgagtcatcctgaaattgaaaaaagcgacactcagcagtttctaaaggcgagtgccgcttctttgtcgcaagtcgtgtggcatcatttagatagtcggctaccctttgatgtgacggcggagcagcaagcaatcacgtctgctgatcgccttatttttcagtttccgctttattggtatatggcgccggcaagcttacatcagtggctgacagatgtttggctgaaacagtttgtttatgatgcgcgaggtggattgctacacggcaaatcacttggttttgtcgtgacattcagtcaatcggcgaccgcctatcagcttggcggtagcgttggtttcagcatcagccaatttttgacaccatacgcggccttggcggctaaaaccggcttgacgttattgccgcctttgacaattgcccaatttgccaatcaaacggattttgagcatcaacaattattggtgcgttatcagcaatatttgacgcttgaccatcctgaccgaccagatgaacaagcacagtggtttattgatcgattgagtggcaacgctgatacacaattgttggcggatcaattagcagcgcagacggatgacattgatcgcttacgtttgacattacacgaattaaaggcaggcgagtcggaatgacaacagatgaacaatggctagtgaacgctgctgcagtgcaggaaaaacaggcaacatcttatgaaaatgccgccttttttagggcactacaagcattcgtcacccagcaggcaaaacgtcgtgaaagtcttgaaggtgaaatcgatggccgcagttggaatcacgaacaatggtgaaagttcagtctgacgacggaggggaaataactcaccgtatgctatggttaagttagcaaaacaaaggagcctaaaaaatgcaaacaatgtttgatcgtcttcaacgttggtcatggctgcgcggtttgctgatgattttaatcggtgcctggattttaatcgcaccgcgccaagtctatcgcagttttctctggatcgtagctgcagtcttgattattgcggcaattccaaagctgattgacggcttttcagcccgcaaagcatcaggcacttacggtacatcgctttttacagggggcttttacctgttattggcgctgatggtgccggtcatcgttcggccactgatgagtctcgggccattgctgctgggcattgtcttgatgatttatggtgtcaataaaattttaagtgctcgaaatcgaaaacagtttgtgaacgtctcggtttggccgaccgtcatttatggtgtggtgttgcttatcatgggcttcattatggccttgaatccgtttagaactgtcatgatggtcttctcattctttggtggcttactcgttgtcatgggcattttgcaactctttacgcgaccacgtgcctaatcactaaaaaaagcattcgacatctaaaaggtggggaatgctttttttctttgcctagatcttttgctggctgataggcagaataattgtattccaccgagtagatggctacactctgtgcaaaaggatctgacaacgcttaacatgcgtgcttagaaactggcctatacgcgatttaaggctgaagtcgtcgcctttttgggctggagaacacgttgaaggaggaaaaaatgatgcacaagtttgattggcgggaagttgaacgtgacgagtattcgcggtctgaggaacctagttttgtgaagttgacaacgcgcagctatatcacagcgatgggggtggcaccagatcgggtgacggatcaagccttcacgtcactggcagcagcggtcacccaaattgctgagcggatcagcgaaggagcagatgctggcattgatattccgaactttaaagcttaccatccctatccattgcaggcggtttggtcagggggcgataaaatcagtaagcgccacatttttcgactgtggttgaagcaaccgttgtttattcatgaagaccagtttgaggctgcactgacacagctgcattttgaaccagccattgcccagcagcttcacttagaacagttggcagaagggtttgaaattcaaagctttaattcaacaccactgacggatgaagcacctgcgattgcgcgtattcaaacagtgatcaatcgcgaccatctcgttcctaaatttgatgatcggcatcgcgaggtttatttggaaggctatcaaggagaagtgccagtactttaccgggtgccgcttgacgaaaacttcggtgaagttggcgatgagcaggttgcatataattaatccgaatcgatgacgccatgaaaaagcgatcagctctttttaaaatgagctgatcgcttttgttgtcttaattagaattgtgggtagacaatcttattggcccagtgattgatcgggccgtactgatgaccgactgcaattggatgaccaatggcttgattggtgaaacgcttagcaatgcgaatggcttcctcaactgagttgcctttgccaatttctgcggtgatgacggcggaaagcgtgtcacctgtgccgttaacccggtcggttgcatgataaggttcgcttaaccagaatgacttgccgttttccagcaaaacaaaatcacgcacagttggttgcgtaggatcatcatgggcaccttttaaaacaatgttcttggcaccggagtcttgtagttgatgtgcggccgcttcagtctgagcgtcggtgtcgagtttcataccggtcagatgctcggcctcgtaatgattgggggtgaccaccgttgctagggggatcagttcatttttgacagcatcataagcgtcttgttctagcaacatcgcgccgtgtttagtgataataacgggatcgacaactaaggcaccgaaatcatattgctgccagtttttgataatattttgcaccagtgcgcgatcggcaagcatgcccgttttagcagcgcgaatatgcaaatcagcagcgagtgacttgaactgggcatcaatgaacggtaatggcatgaccatactatcctgaatcccgtaagaattgcctgcaacagccgcggttaaaatggtagcaccataaacgccgcgcatgaagaaactatgcaaatcggcttggacaccggcactgccgtcactgtccgtaccaccgattgtcatcacttgtggaaactcattagccacgtgattccctcctcgtaaacgtgttcactggtgcagaagccggcacatcaggatctgaagcacactggccaaagctcagccaatgcgcttgaggtcatacttcggattctaaccgcatcagtttacgttcttcctgataaaagactgtcatgacttgccaatactgttactaattaaacgcccgtttttgcggcaagacagctttaagccattcgccgataaatggatactgatggttaagttcgatgatctgcgtttctggatcaggatacttcagataaaccatattattagccggattgatcatcactgtaaagatcttttgatttggtagtggcaattcgtaaacgccagctttggcaccttgtcgcatgaggatagcgttgttggatgcaatgacgaataattcatccaatgctggtgaattactgcctgccgaaacacgaataatgagcttgagacggtgattgaccaattcttgcggcacagtagttgatgcccactcaaagcggtcatttttgacttcttcagagccaagatcttgccagtcgtggccatcttcgtctaggacttgatacccaagtacttttgcatcctgatctaatgacgtaccaatgctaaagtcgcctgctttgatgactgccttttttgcaacgagtggtttgaggttatcaaaccgcgtcttgaaacttagtccgttaacgggttgcaagacagtttcatcaacagtggtgaagcgatagccgccttgattgagcgctttggctaaggcagacagtgccttaacggtttcggcatcgtaggtcatggcattgctgtcagcagcggtgatctgcaaaagtgtcggtaggttgaccgcttttaatttcgcatcgtcactcaagggatccacaatcgttaacaatgtgttgttgtcgtcctgcgtcgtctgaatcaccgcaatttcgctgtggtgagcatctgccgttgtatcctgcagccacaatgtctgcaaaaatggggtagggattgacgtcaagttttgcaatgcctgatataatttattgcccaagagattcgtgtagcttgccaataaggcggtcaatgcctcatcatttgattcccacaatggcgagtttgctaaacgatcggcttcttgctgatatgctgtgccaatttgttggcgtgcctgagcaacggtgagtggttttgtaatcagggcagccaaatgtgcatcattaagattaagcatgcgtgcgccctccttcaagctttaatgactgcatgaaatcatccttcaagttagctaagatattttcaaattcagcgactgagctgtaagtccccatcactgcttggaattcatagcgcgtgatggctgcggaaacttcgagttcacgtttgcgcttgtcgaaaatatcatcggcggtaagcttttccttgtcgaactgtgctttcagtcgcgaggcatctcctgaaggttgtgaaggtgatgcttggtcatcatcactcggatcaataaagtttttcaacaagccgcggaaaccgctgttgccttgggttgcttggccgcgctctggggcgttttcggcttccaagttgtcgatttgggtgtgcaatgaatcaacgtcacggtaaacctctttgcgcatcgcatccaactggcgatctagataatggtcgggatcgtcagaaaaagcttcgagttgtggtaggatgcggcgctgttcgtcagctgactgcgtgatggctcgcaagatgacgttaatatggccaaactcgcgtcggtggtaccaattaccaaagtagacggttccttgatcattaacttcaaaaaaggggatgtgctggcgcagaaaatcaatgagaccgatctgcagaaaatcatgcagttccgcctgtgcgtttttgtcataagccaaaatataaccaggcgtttcttcgatgtctagccgcagattttcagcggttgcatccagtccctgataaaggcgataacgtgactttttatgccaagcatcggtaaaatcgttgaagaatttcttttgataagtaaggctagcttcaattgacatttaatatcctctcacattctatactaatgatttaagtgtaccgcataactggcaatataaggaagttttcttgtctttttcaagcccagaaggcagattcagccgtaaatgctggatacatgctagaatatggacgagaggtcgttgcttcctataaacgcgctcgtcaacccagcaagttgcatgtaggcggattgacctgcgctcaacatgaaatgaggtaggcaaaatgaaaattgctgttttgggtgctactggtcgcgcgggcagtgccattgtcgctgaagctcggcgacgcggacatgaggtgctggcagttgtgcgtgatccgcagaaggccgctgatcggcttggtgcaacggttgccacgttggtgaaggaaccgttggtattgactgaagacgacttggatagcgttgatgcagtggtagatgctttgagtgtgccgtggggttcaggccgtggttatttacatctggactttgccacgcacttagttagtctgttgcgcaacagcgatacactggctgtctttattttgggaagtgctagcttggcgatgccgggtgcggatcaccccatgattcttgactttccagaaagtgccgcaagtcaaccatggtatgatggcgccctttaccaatattacgaatatcagtttttacaaatgaacgcgaatgtgaactggattggcatttcaccaagcgaagcctttccaagtggaccagcaacgagttatgttgccggcaaggatacattgctggtgggcgaagatggacaaagccacattacgaccggcaacatggccttggcaattctggatcagttggaacatccaacagcaattcgagatcgaatcgttgtccgcgatgcggattagctgcttgtgcagcgattaaaaaaggcgactttgcaacttcctgaggcgatgttaggaagatcaaagttgccttttgccatttttgcttggtggactattaaagatggtaagcgagcctgctttcgctgaaacgggtaaattagcccagaaatctgcacataaggacattgaacctaaacaaccaaaactccgccaattttgcaggccctcgcaaacgcgttcgcagaaacctgctttcgcgctacacaaaaaaacccgcgtattgggggtacgcggggtttcctgtcaacaccattgggggtggtgccgacttctttttactttggaggagtaaaaatgaaaaaaagttgggttggggtagtagtaagaagggggtaaacttccttgctacatagaaaagaataatctgtaattgtgaattttttatgacgttctggaagaaaaattttgaatgtggttttttaatgttctttgctactttttgatattgtgagcaaatgttattgaattttaaattgtcaaaatgtcaattagttgaaaatatgtttatataaattgacaaaagctgttgtgattgaagtcttgatctttcgggcgaaacttaaatgaatgaattgtgaccgttttaagcgttaatatcgttatcttaaggtataataagtgttccaaaaaaacatggcaaaaattttgccggaaaagaggtaattttgatgggggtggtagtatctaactttcatctggcgaagctcacagctgaagaaaaagtgaaactaacttctggaaaagatttctggacctctgagcatcttgccgataaaggtataccaagttttcggatgagtgatggtccccatgggctgcggtatcaggcactggcagcggatcatctcggaatcaatgatagtgtccctagtaccagttttccaacggctagtgctagcgcagctgcgtgggatcctgatctcattcaagcaatgggtaaggcgattggattagaagcgcaaagcttaggtgtcgatatggtacttggtcccggcgttaatatgaaacgcaatccactttgcggtcggaactttgagtattttagtgaagatccattcttggccggaaaacttggcgctgcgtggattaatggtatccagtcgcaaggtattgctgcatgtctcaaacattttgcagcgaataatcaggaaaatgaccggctttcatctgattcgctggtggatccgaccgccttgcatgaaatctatcttgaggcttttcgtattgctgtcacagaaagccacccagaagcggtcatgtgttcttacaacaaaataaatggcacctatgcaagtgataatctgtatttgatgacccaagtgttgcggcaacaatttgggtttggcggggcagtgatcacagattggggagcgttgaatgataaggttgcggcgcttaatgccggtacggatttagaaatgccaggcgacgatcatttatttgatggtgaggcgctgcaggcttatcaacaaggcacactgaaattggccagcttagatcgagcggtgactaagattgccgaaattgcccgcaaacaacggcccaaatttcagggatcgcgagagcaattactgcaagcaaatggacaattggcgcaaaaaattgcggaaagtgcgattgttctgctgaaaaatgaggccgccatgttaccattacaggctactgatacagtcgcggtcattggtgagctggctaaagctacacgcttccaaggggcagggtcttcgcatattaatgcttccgagatcgtttcagttttggatggccttaagcaaaaaaaggtgtcatttgattatgcgactggctatcgacttgacgatcaggatgattcgcaggcgactgccgaggcattagccttggcacgcaaccatgacaaagtcgtttttgttgctgggctgcccgacaattatgagtcggagggctttgatcgccaaaatatggctttaccaaaagttcaagacgatttattgcaagcagtgaccgcagttaatccaaatgtgattgtcctgttagttgccggtgccccggttgagcttccgtgggtggaccaagtcaaagctatcgttaacctgtcacttggcggtgaacgtatcggggccgcagctgccaacgttttgacaggtgctgtcaatccaagcggcaagctagctgaaagttatccgctaaaataccaagacgtgccctcagcggatgtctatgataaaaaccctcggtcggtgccgtatgttgaaagcacatatgttggctaccgttattacgacaaagcaaaagtgccagtcgcctttccatttggttttggtttgagttacacatcgtttgccttgaaaaacattcagctctcaagtgatcacgtaaccgatgatcagccactgaccattagcctgcaagtgaccaacactggaaaggttgatggtgcggaagtggtccaggtctatgttcaagaacaacaaccacgaccattacgaccggaaaaatcattaaaggcattcaaaaaggtttttgtcaaagctggacaaaccgttaatgttgctctcgagctgaaggcacaagcctttaaggagtggcgtgaacagacacaaacatgggccttgcctgaagctcaaaaggcgattgctgttggtaccagtgtcactaatattgacgctgttttaccggttagcttcacaggggaaacttttaataactttgcaacgattccaaattggtatacaacactttccgggaaacctagtgttcaagattttgaacagttgacagaccagaaagtaccggcaccacatgaatttgtaccaggcgaattcactcgactcaatacgccgcgagaaatgaagaaacactcattgttgctgcggctagtggcttggatcacggtcaaaattcgaactaaagattatatcgacaagcaaggacccgaggcgaagttccagcaggcaatcgtattggacacgccactcattcgcttggcgcaacaggccagcggtgcattaaagttaagcatggttgatcgactcgtagctgcggccaaccatcagtatgtgaaaatgatttttagataacagtcgtattgtaaaatcattaaaattttttcttgacgaatgacaattggattcggtatgctgattctcgtaccaaacagatagcgtgtcagcagacgtgatttctgcgactgcgaacgcgtgtttaaaggagtgttgaccatgaacttagtacggcaaacacaacttaataactttttcggcggctttttcggatagcggtttgcagtgagatgcaaaccgcgcaagcagtggtttgcatccataaggccgtcacattaaatgtgcacacaacgccgcatggatgaacaattatccatgcggcttttatataccgaaaaatctcggggccagtcgcatggtgaaaatcagcggctggtcctttttgcatcatacgactatgttgaccgttccggatggctgaattgtcactcgtcactcatcgataacgcgctcgccagcgcagcaaccgcgctggctcgcgctcacaggaggaatttttatgaaaaagcatcgactacttgttatcgctactgcagcactggttggcatgacgttgattggctgcggcaagaaaagtaacgccgccagttccaaaaccgttaagatcggtattttgcagttgattgatcaaagtgccttgactgaggctaggaaaggctttgtggccgagttggccaaagccgggtacagtggtaatcgcgtcaaaattgattacgtcaatgcccaaggcgaccaagctaatctgaaaacgatgagtgatcgcttggcaagtgataagaatgatgtgaaccttgcgattgcaactcctgccgcgcaagcactccaacaaactgacaaaacgacaccgatgttattcaccgccatcacagatcctaagtcagccggattggtcaccaatcccgcaaaaccagataaaaatgcaaccggcgtgacagatttagttgcggtagccaaacaaattgacctgcttcatcaaactttcccagaagcaaaaactgtcggcctcatgtataacgctggcgaaccaaattcggtttatcagaacaaacaagccaaagctcggctgaaacaaatcggtttgcgttaccaagttcgtacagcggcgacaactaacgatgtgcaacaggccgccgagagtttagccaaaagcgtcgatgccctttatttaccggccgataacgttatggctgccgctatgccgaccattggcaaagttgccaaggctcagcaaataccagtcgtcccagccgcttcgaccatggttcaagacggcggcacgatcaccaaaggcatcaactaccgcgaccttggtaagcagacggccaaaatggctattaagctcctaaaaggcaaaactgttaaaacattaccagttgagaaaccggcaaaagtcgaaacggttcgcaatgaagccatgttaaaagccgtcaaacaaacggttaaattaccagaataactgctatagtaacgttctttgacattcttccccatacaaaaactgaaatagccgaatgtaagttttttgtttgtgttgacaagatgagaatatgagtatacgctttgagacaagtcagagagaacatctctgcatgaaggagtgttgatcatggatcgagtcaaaacaacacaacttaatcattcttattattacggctatttcggataatggtttgtatctcatggatacaagccaatcaggtttgtatccatgatggccgtaagtgtttaacttgcaattaaccgccacatggacgaattcatccatgtggccttttctttttccgggaaaaaacaatggccagccacatggacgaaaaatccagtggctggctatttttgtaagagcgcgagtcagcccgggtagaaaccggagtgtaagcggtcttggttgtgatagtcgtattttgaccactgcgaccaaggtccttacatgtaggtttctgggccagtgagcgcgtttgcacaaagtgtgaagcaccatcaccttaacccgtacatcccaggaggaagaaaaatgaagatcaaacgaatggccgctattgcggcagcagcagtgactattatggttttagccggttgtggtaaatcaaccagtgcagcggctgacaagagtcaggttaaaatcggcattttacagttgattgaccagcaagcgttgaccgcggcccgcaaaggattcactgaagaactggccaaagccggttacaaaggcaagaagatcaagttggactacgtgaatgcccaaggcgatcaatctaatcttcagacgatgagccagcgcttgcaacgtgataaaaacgatctcaacttggcgatcgctacaccggctgcccaagccctacagaaggcagacagcaagaccccattgttgttcacggcgatcacggatccaaaagcggctggtcttgtgaccacagcaaccaagccagacaaaaacgctacaggcgttacggacatggtagatgtcgctggacagatcaactttttacagaaagcctttcctaaagcaaaaaaagtcggcttattgtttaacgccgccgaagaaaattctcaggttcagatcaaacttgccaaggcagctattaaaaaactaggtttgactgcggttgaaaaaactgccgcgaccaccaatgatgttgaacaaagtgccactgcactgatgaaacaaagtgatgttgtgtacattccaaccgataacacgatggcggcctcaatgccgaccattggcaaaatcagcacgaaagaaaacattccagtcgtcaccgctgacgcgacaatggtgaaattagccggggtggcgacagtagggattaattacgaagatctaggccggcagactggcaaactggctgttcaaattttgaaggggaagaaagtcagcgatctgcctgatgaaaaaccggctaaaactcgattggtcactgatccgacccggatgaaacaatttggcttgacagaggctgccttgaagcaagctgaataatcgatttcgtgtcataacgcgctggcagtcgcagcacccaggctggctcgcgcttctaccataacgcgctcaccagcccagaagcctgcgtgtaaggacctcggtcgcaatggtcaaagagcgaccatcacgcccaaggccgcttacactccgctttctacccgggctgactcgcgctcacttaacaaaggagcttttcattatggacatcgtgacatcaagtattgcccaaggattactatggtcggtcatggcgattggcgtgtacctgactttccgaatattagacattgctgacatgacggctgaaggcagttttcccttgggcgctgcgattactgctcatgcaattgtcacggggatggggccggttgcggcgacgctcatgggctttgccggtggcgctgcagctggtgcagtttcaggttttttaaccaccaagttgcatattccagacttgctcactggtattttgaccatgaccgggttgtattcggtgaacctcttcatcatgggcaaggctaatatcagtttgattgggactgttaagacggttttcaatctggttgacagtggtgatgccacgaccaccggcatcatcatcggtgccattgtagtcgccattgtgataggtattctggtattctttttccataccgagatgggcttagctgctgcggcagtcggcaacaaccagaacatggcggcggccaacgggatcaacaatgatgcgatgaaaattatcatctacatgctgagcaatggccttattgctttatcgggcagtctcatggcgcaaaccaatggctatgcggatttgtcgatggggattgggaccatcgtcattgctttggcagccattattatttcggaaattctattgcgcggcgtaccgttgtgggcccggttgttgatgattattgtcggcgccgtgatctaccgcctgattattgcggttgtgctggatcttggtgtcgacccgaactacctgcgtttcttctacgccttgatgttaacgatcttcctgtcattgccgttactgaaaaagaaattacaactcacgacaattcgtcacggtaatcggcgtcaagctcgcatcgttcaggcacagatgcaagcagcaaaaaccgattcgatgcgtacacatgctggtgatcagcaaaaggaggtttagccatggccgtacttgaagtgcatggactgcatcagtattttgaacaaggaaccgtgaacgagaatcacgcgctgaaaggcattgatctcagtcttgaacgcggggagttcgtcgcgattattggtggcaacggcgcaggtaaatcaacgttgctgaacagtatcgctggtacgctcccggttagtcaggggcagattttgatcaacggtaaggacgtgacttatcaaaatgttgctaagcgggcgaaggtaattgctcgagtctttcaggatccgcgttccggcaccgcttcgttgctgacaatcgaacagaatttggcattggccgaaaaacgcggctcttggcgtaacttttgggccagtggggtcaaacggagtgatcgccaacattttaaggaaaaattggcgacccttggattgggccttgagaatcgcctgggtgccgaaatgggcttgctttctggcggtcaacgacaggcagtaactttgctgatggctactttaaaagaaccggcgttgttattgcttgatgaacacacagcagcgcttgatccgcagacaagcgctaccgtcatggctttgactgataaaatggtgcgcgcgcaacatacgacaactttgatgatcacacacaacatggccagtgcactgaaatatggtgatcgcttaatcatgctggatcatggtgaaattgctgttgatgtccgtggcgaggaaaaacagcacctgaccgtcgaagacttattgacgatgtttaaagaacgcagtggacaagagtttgccgatgatgctgttttgttgagttaaagctggcctaaaagaagttaatgaatagattctctatgagaaaacaaaagacgactgatttccgccattggaaaatcagtcgtcttttggtggctatcagttgtgcttcaaccgtgtttggttgaagcacaactttgatggttaaaacatcaagcatgtccgaaattagtggttaattcataactgctgccagcaaatacagatactcagcagctggcacttttccattagcccatgtccacaatcgtccgggttgtgtggtggttaaagtgtttcgtcaaggtttgtggcaagtcagctagtttgaccgtatcaacaggcattggcgccaatttgtccaatgtctgccatgcggctgctcgggccgcagcaggggcattgacggaatccacaccgagcaaactaacattgcgcaaaatgaaggggaagacggtcagcggcaaggcagttcctgcagcattgccacataacgcgattgcgccgccataacacatacttggcagcaaactggttgtgaacgatccaccgagcggatcaatggcaaagtcaaagcgttgcttactcaaagcctttcccttgggcagctcgtcaagtgctaatgttgccgtggcgccaagtgacataacctgtttttgctgatctggtgtccgcacaataccgattcgattcgtgaagcctgcttgctctaataagcgcatagcaacactgccgacaccgcccgttacaccaccaacaagaatctgcggtgcatgctcaggtgtcatgccgtgcgcggtcaaagtagcgacacataaggcagcggtcaaccccgccgtgccaaaactcatggcgccggcaagtgtcatggctgatggcagcgagattgcccaagaagccggaatgcgggcatattcagcgtaaccaccgccttgactgacccctagaccatgaccggtggccaacacttgatcgcctactttaaaattggcatcttgactagctaccacagtcccacttaaatcaatcccgagaatctgtggataatctcgaataatttgattctgcggttgataggcaagcgcatctttgtagttaatatctgaataagcgaccttgatcaataaatcgcctgctggtaagtcatcttcgtgcagggtttgaaaagttgccttttgcccatcgtgaaccaatgcttgaaatgtttgcatagaacaagcctccttggatggtattcttccacctattgttggtggtgaattgccatgctcattagttaactaaagcatatcagataacgatgatatcgcaaaaccaacgttattctgccgaatctgataaggtggcctgacgccatggcgctaattcgtgccgatgttgacggcgcttgtaagtttcaacaaccaacattggcagccagatggcaccgaggacgatggcccattgtccggctgttagtggcgctagctgaaaaatttgttgcaatggcgcaatggttgctaaggcaacgatgactgtcatcgtcagtaaaaggctaccagtcaggatcggattgacagtcatcgctgaccagttaagccgaccacgggttttgatggggaaaatgtccagcatcgaaccgatggctaatgtcagaaatagcatggtcatgccgatacctggcacatcggggctgaccacgaaacggccaacgaagtagatgccaagaatcaagccaacataggtggtcgtccgcacggccacacgtttgccgaggccattgctgaaaatactggctgcttttggaatgggtttcaagtgcatcatgccaggttcagccaactctcggctaaggaagaagccgggaataccatcagcaaggacgttgacgatgagtagctgctcaggtgtcatcacagcaccccagccaacgaggacggccagtagcatcgtgaaaatttgggcaaaattaaccgaaatcagaaattcaacggcttttaaaatattttgatagacggttcgaccttgtgcgacagcatcgataatcgtagcaaagttatcgtcggtcaaaaccatatcggcagcatttttggccacatctgtaccagtgatgcccatggcaatgccgacgtcggcagctttgagcgctggcgcatcattgacgccgtcgccggtcatggcgaccaccgcatcttgtttttgccaagctttgacgattcgaattttatcactcggggtagtccgcgcgaacacgcggatatcagcaatattggccgccagatcctcgtcgctcatttggctgaggtcatggccggtgatcgcttgttggccgctttcaaggatgccaatgtctttagcaatggctttggccgtaccgagatgatccccagtgatcataaccgttgtaatgccggcctgtttagcagcgcgaatggcagcgggcacttcagggcgcggcggatcaatgataccaatcaatcccaacggttgtacggcggttagctgtgcttcccaggtttccccagggtcggtttcaaattgttgatagccagccgccagtacccgcaatgcttgtgccgtcatttggtcatggattgcggtggcagtttgctcccagttttcaggcgcaaagttaattcggtcaactgctcctttaataatcgctagatagtggccatccggcgtgcgatgcaaagtcgccatggttttcttgtcagatgaaaacggcgcttcagcaacacgcggataggtttgctcagcctcggtccgactcagatcgtaatgatcaagtagccgaacaattgccagttcagtcgcatcgccgatatctggttcatcagcagcagttaagtgtgcgttggttgcaagaccgagatacttgaaaaagcgggtgtcattggctgacaactttgttttggcgactttatgaatttctttgccataaggccagaaatgggtaactgtcatgcgattctgcgtgagggtcccggttttgtctgaggcaatcacgttcacgttcccaatggtttcaacagcggtgacttggcgaataatcgcgtgacgcttggccatcttctgaacgccatgagccaaactgagggtgacgatgacgggcaaggtttctggaactgcagcaatggcgaggctgacaccaagcatcaagctatctgtaaagccttcctgatgaagcacggttgctagcaaaatggtgatgataccgcccaagatagcaacgaaggatagccgcttgccaagtgtgtttaaccgtttggccaatggcgtcgtctgcttttttgtctgattgagcagtgcagcaatttttcccagttcggtgtccatgccggtagccgtcacaatcgcagttgccttgccgctggtaatggctgtgccagagaaaatataattggcagcatccccaagatcatcaggagcagtggccaaggcttctgccgttttggtcacgcccagactttcgccagttaaaattgcttcatccgcttcaagttcttggctttgaatgattctggcgtctgcaggaaccgcatcgccggccttgaggagaatcaaatcgcccggaacaagctcggcggcctgaatggtttgcgtcttgccttcacgaacaacggtgacggtttgaatcgtcatggctttcaaagcagcgagtgctttttcagcgctgtgttcttggtacaaagcgatcacaacattgagaatgacgatggcgccaataacaatggttttggtccagtcactgtcagtcgtcaaggccagataggcagagagaccaacggcaaaaagcaaaattagcgaggtgatatcgctgaggtgatggccgatttgccggagcaagctaggctttttagccgcggtgagctgattgcggccattttgctgcaaacgtgcagctgcttctttagcagtcaggccggttttggtgttcgtcgttaattcagcggccagatcgcttggcgttaagcgcgtcaagtgcttggtcgttgttgtcatgagttcattcctttcaatttgtcagagacacgatcattacttacttataataaccgtaacataaaaatattggtgttgtaaaatttaaaatgagtttagacatgagcaccatcagctagttcaaacatatttgtggcatttagcttattcttttgtgctcaaaaaagccgctagcctgatgtcgtcattcaaacaacaggttagcggctttcttgattttaaatagtggcgcttgtggctagttttgtaatgcgtgataaggataacttgtttgctgcgtcgtttgggttttgaagccgtatgtgtcggcaacgatatagagcggtcgatggcggctttcagcgaacatcctcgcgatgtaggtgccgagcatgccaatggtgaaggtaataccagcgccaactagcaaggtgatgatcatgacccaggttaagctagtgaggtggcctagtgccaaactaagcccaaagagcgcgaccgcgatgatcaagaagaagccgcttagccagctagctaaagttaacggtactgtggaaaaactagtgatcccatccatagctaagtgaagcatttttctcagtggatagtgcgtttcaccggcttcccgttcttgacgatcgtactcaacggcaatttgtttgtagccgacccaagtgaccatcccgcgtacatatgggtcctgttcattcatctgcttgagaacattgacaacacgccgatccatcaaacggaagtcgccggtatcgacaggaatgctgatgctagtgacagccttgagtaagcgataaaacatttcggcagtcaacttcttaaaccacgtttcaccactgcgtttgcgccgcttaccgtaaacgacatcatagccttcacgccagcgggctaacatttctgggataacacgcggcggatcttgcagatcggcgtccatgaccaccactgcatcgccgctggcatagcgaatgccggcagtgattgctagctgatggccgaagttgcgggagaaatcgactaaccgaatcgccggatttttggccatggcggccctgatttgatcagcactgtcgtctgttgagccgtcattgacgaaaattaactcgtatcgttccggccgtgcacgaacgtaatttgccaaaaccgttaaagtttcgccgatgccagcactttcgttataaaccggcaacacaatcgaaatgaatggattcttttcttgtccctcaattttcaagtcaagtgcaacgatgataacgaattcttgatagtggtcttctagctatgcgtcgccaccccatctggccggagattgcggagtttggcacggcaaagaatctttagcctaacctattaagcattcgttttttcaagaacaaatgttgaccacgggcgaataagatccagaaagcctagatcatcagcactgacttggccaattttattgcgctgaccgtcatcggcaaatggcgttagcacaatttgaagctcgcctttgtaacggccataagcatcattcacaacaaggatatcgccgcgttcaaaggactggtgattgtcatgcggcgcaatgctttctttgccatacttcacccgcggttgtgtatcgcgcagtaagtaggctgaggcatcgccacggtagagatgcggcgcttcaaaggcaatcttcgcctcaattggcaacatccccggcagcatatcagcatgcaaaatcggatatggtgccacgaagttagcagccacctgttgcaactcagcttcactagcaaaggcattgccgatgatgacatcatcaatcaaaccggtcatgactaagtggctggtttggctggcgatgcttcgatggcgatcgctttccattgttggcagaccatcattgaccgcccatggaccgatcttgccggtttgcgaagagacaaacgccgctgtgtgcagcccataatcacgatattgctgagagtactcagcaaaaatctgatcacttaatcccgtaaaggcttgtggataaaagttatgacagccgagcaggttgtcacggtccggttcataggccatgatactagccaaataattggttccgcgactcatattcagctcaatcttcagcccgtatggattacgcgtcatgcgcgcttcttcagcaccggtgaaaccttcatctagtcgcagtccccaaacattgagctttttgaaaaagctcagatcgtcatagctgatctttagctctttgaacaaggccggattgatgtcgacaatcgtttggaagcccagtcgattagcataatcaatggtttggctgaaaacagagaacagatcctctccgtcatccccatacatctgcaataacgaggtgaagatgcgggtataaccatatttatgcgccatttcgagataggccctgttctgatcaaaactgctttgatccggatagagcgatattcctagtcgtttcattgaaaatcctttctaagccgtgtattgtgccgccatctggcgagacatctttttgaaccggtgcttacgctgccagttgagtaaaaagccggctgtgcgattgttagctttgcctttcgcggttttgccttcaatcgtttccgtgtaatgtaaagccgttttgttgtcaccagcgtcgcttagctgatagtcaaccgtatagtgatcacgatcagtatccagttcgtaagcataacgttggttggcaatggcatgggttatcgtgagtgtcccagtcatgccattagcccatttcttcttgtaagagaaaccattgagactgccagttaacacctcgcggccggtatgggccttgatgtcttcctgcgcggatcgaatgagttggccatacataaatgctacaggcaccttaaatgtcatttggatttccaagtgaaagccacctttctaaaaacgttgttcagcccaaaaccagcgtgatgggatgttagtcaagttcggtcggtttgatcttattggctgccttaacaaatggcacatagatcaggaaaccgatcaccatgttgattaattgtagcacggcagcacgccagtccatcgttgcaactaaggcattcaggaacggtggcattgaccaaacaatctgagccttaatcggtgaaaccaaaccgttaactacggcgccataggcaattgaaaccatcactaccggtgccaaaacaaacggaatgaagtaaatcggatcaagcacaattggcatcccgaacatgactggttcgttgacgttgaagaagcctggtgcaatcgataatttagcaaccgcccgctgatcatcacgttttgagaagatcagaatcgcaatcagaagtagtagagttgaaccagccccgccgatccaagcatacagatcaaaggagttccgggtccacaaatatggtaaggcttcaccttttgaaaaggcgttagtgttagcaatctgagccgtcagccagattccatcaaggattggtgccaagacgttcgtaccgtgaattccgaagaaccagaaaacctgaaccaagatcgtcattatcaacacggatccgtaaccttgactcagattcaacagcggttcctgcaagactttagcaatgaattcaattactgtagtgccatattgagtgaagatatagttgataataccgacagcatacatagcaacagcagcagggacaatcccagtaaacgcattagcaactgctggcggtacggaatcaggcattttgatggtgatgtgtttcttcatcagccagatatagatggtagcagcaatggcccccatcagcatgacggtgaagaaaccatatgcgccaaagaacttaccaaaattgaagaagccccacatgctgacatccttgccggtaactgctgccccagcatcggtcagtgacttgatcgctgctttacccaagccggttttaaccgtcatggtgaagttttgcggcaagctcatgatgaaggtgccaagcgtcacgatccccgccgtgactggttcgaccttatactgaactgccagttggtacccaaaagtgaacgagaagatcaggcctaaaattgccaatgtccctgtccagacaacggcgttaataccgatcagccattgcatggaattaacaaagcccgtccagccaaactggttcgggatatcacgaatcaaagcgttcagcaccgtcgagacagcaccagccatcatggccggcatgatggcaataaaagcatcacgcaacgcaacaagccaacgaattgagccgattctggcagcgattgggacaacatgtttattgagccaattaataagtccgttcatttttataacactcctttttaagtgggcgcgagcaggcacggcgtgaaatcaagacgtagctagctttgacggtcatgatctgcttttgatcattgtttttaagctgacagcgtcagattccggcaactgcaaacgcgcgagctattaatttgaactgaggtccccgcctcattggtccaaatcaatgttggtcgtgtggtaatacagtgtgagacctggataaacaaaataagttcgagaaaagttgaagactttgccgctggctagatagttaatcccttccagacataaaagatcgccttttccggatgtggtcatcaggtcagcatattcagccggcagcggccgagactgaatataattttcggttgtgcttccaaccatgtcataggtgttgcgcaaataggtaaagattgaccccgcagcaatttctgccgagagatgcggcacaatgacttgtggaaagtatgattcttccaagtcgtacaactggccttttaaatagcgcagacgcacaacttgataaaccggatcgccaactgctacgttgccgcggcgggccaatgccgcagttgctggtatcaaagcaaatttgacgactttcgatttaagcggaccgcctttgaccatcgcggtttgatcaaacccgattgacatattcaagacggcgcttgattgctccgaatgatcaatgacgtagtagccactgccctgcactctgcgcacgagtccatgggcaaaaatgacatccagcgccttacgaatagtgttgcggctggcttgatagcgattcatcagcacttgctcggtcggcaacttcactggatacttaccagccagaatatcttgaatcaattgctctgcaatatcgtgatacatttatgaccccctccaaaggtgtggttttgaaaacgcttgtaaaatttgtacctacgaattataatagcacaagaaacagaaaacgattacatttttttaaaaaggagccgaaaaaaatggcagagaaaaagattatgttggtctgcaccgctggtatgtcaacaagtatgctggttgcacgcatgcaaaaagccgccgaaaaagatggtattgaggtcaatatttttgcaaccgccgcttccgatgcagacaacaaattagctgaggaaaaaccagatgttctgatgttaggacctcaagtccgctatcttgaaggtcaattcaaaaaggatctcgatattccggttgatgtgattaacatgcaggattacggcttgatgaacggcgaaaaagtcctcaaggcgtccttgaaggcaattgcagatggtaaacaaggagaagaagcataatgagtgaagaagatcagaacctcgaaactgtcatgggcttgatcatgaatggtggcaacgccaagagttctgcctttgaagctattcacgcagccaaagcaggcgattttgaaaaggccgacgaaaagcttaaagagtccgaccacttcctgaccgaagcccacaacgttcaaacaggcatgttaaccgctgaagcccaaggcgatcatgccgaggttaccttgttaatggttcacagtcaggatcatctgatgaatgccatcaccttccgcgatttagctggtgaaatggttgatttgtacaaacgattaagcgagaaagaagcctaggcaaacaaataagccttcgccatgcgatgacgcatgaaggcttatttgcagtggccattgtgaataaacggctgttatgaaatcccaaataatcgcaccaaaaaggcgactcagcaaatgagccgcctttttaatactatatgttatttttgctggcgacctgcctgccattcttcccgcagaatgccatacttaacagagtcccagtaacgatcttgataataacgaacttgtcggacacgcgcttcctcctgcatgccaactgctttagccaaaccgatcatccgatcattgcctgaccaggtggtgatacctaaatgcggcaagttgacgagtccgaagatgcgatcaatccactgatccagcgcatcttgcccataaccttttccccaatcagccgagtcatagataacgatgccaagatccagccaccgctgcagatcgccatcttcataatgggcagagacgagcccaatcaaaacgccgtttgaccaaatgccgttgataaatggattggcaacccattgaaaaccagtttgattggcctgattttcctgcagttcttgtagtgtcggtacttcttggttaaaatacggtccgtcccactgatgccattcagcctttggatcagaaaaagccaccttccacagtgtttctagatcttcagattgaaaatgttttagcgtcactgtcatgcgttcaccgctcctttgatgtttgttaacaacataccacaattattgcccaggaaataatgcaatcgtcaactatgttaatgtcagtatagcggtaaacgattcgagttaatcttagataaggagtgaatctcatagtggcagattatattaaagatatccggacaaaggttggtcatgcgcccttgattatggctggcgtgattggcatcttaaccgatcaggctggtcgcgttctactccaacaacgcagcgattttaccggtgaatggggcttgattagcgggacgatcgaatacggcgaaacccctgcccagacgatgatgcgtgaattcaaagaagaaaccaatctgaaggttgaagttgtccggttgcttggcgttaatggcaatctcaccctcacctatccaaatggcgatgttgcccaatggctgtgcccggtgtttcttgtgaaacaattaagtggtgtgttaaatagtgacaacagtgagactgaagccttaaaattttgggatccagcagccgctcctgacctgtttaatcaacaacatcgggaagtcttggcgcactttatcgcaaatgaaacggggtattttgattgaatcgattgatcattctgcgtggcaattcaggcagtggtaaaaccaccaccgcaaccgccttgcgtacccaactggccaatacgctgctagtatctcaagacgtcgtgcgccgtgacatgctcgccgaaaaagacaaaccgggcaatcccacaattgaactaattgaaacgattgctcgctttggattgcagcatcagcgaactgtcatccttgaggggattctgtcggcagcacgctatggcgacatgttgaaaacactcattgcagaagctgatcaaagtctggtttactactatgacctctcgtttgatgagactttgcgccgccatgcccatcgcgcaaaagccaaggaattcggagccgacgtcatgcgtgactggtatttgccccatgatcgtttaaatgtgccgactgagcagctcatttctgccgattggtcgcaaaccatggtcgtcaaccacatcttgaccgatctggctggattgaacaatacagaatctgttaaacctattcactgacaaaagacaccaactcgcgggctcttttccaaactgatttgatagcgtcttcttgtccttaacggcgggcaaaatcagcattggcataatcgggcaaaatattattgttttcatgggtttcggactagaatgggttcgtaaaggttagttcattattagtaatggctataacgcgctcgcagtcgcagaagcctgcacatacggaccttgaaccagaatggccaagttcgagccattctggttcaagcccacttatgctccggcttttaagcgctcctgctcacgctcactaaaaggagtgatttttgatgacaagttatccacgccgtgacccggttactgaccggctgctcaccccggaaaattctgctttgattctgattgactaccaaccgacacaaattgaatccatcggttccatgaaccatcatgctttgatccaaaatgttgtgatgacggccaaattggctaaaacgtacaatgtgccaattgttctctctactgttaacgttaaaagcggacgcaataaagacaccatccccgatttgaaaaaagccctcggcgatataccaagtattgatcgctcttcgattaatgcttggcaagacaaagagtttgtcgaagcagtcaaggcaactggccgtaagaacttggttatcgcggccttatggacagaagcctgcctaaccttcccaacaattgatgccttggctgaaggctatcatgtttatcctgtcgtggatgctgttggcggtacctcacaaattgctcatgaaactgctttacgccgcgttgaacaagcaggtgcacaattgaccacaaatgcccaactggcttgcgaatggcagcgcgattggaaccgaaccgacactgtaccggattttgttaaactgctgctgggtgcaggcgactttatcaatttaggcgactagctttttaacaatatgacatgaacggggctgattaaagcagccccgtttcgtttcttatcgcttatgatgtgtacctgcccatgacatcgcatgatgccatgaacaggtaccttattttattggtgagcgtgagccagagcggttagtcaccggagcgtaagcggcctctggcgtgatggccggtctttggccattgcgactgaggtccttacacgcagatgactgctctggcaaacgcgttatggttagggggattcaacatgcaacgttctgaaacggcaccaaaacgttggtggctactggtcgcgctgggcttttttgccttcatgaccaatctcgacggttcaattgtgaatattgccgtgccaattatggccaaggatctaaaagttccggccagtcagatggaatggacggtttcgctgtatttaatcgttttaagtgcgctgctattgccctttgataaacttggcgaccgcatcggtaagcagcggatttttaaatggggcaccggtacatttgtcttaggttccttgatggctgggattaatctcggctttaattttttgatgttagcccggatgatccaggcacttggcggggcgatgactttggcgaatacgtacgggatcgtcacctcgactttcgcacttgctgaacgtggccgggcaatgggggttgtgagtaccttcgtcgcattgggtggtgtcgctggtccaagtctaggcggtttgattttggcccatttcagttggccaatgatttttctcatcaacgttcctatcggtttaatcgcattgggtgtctccttgtggtctatgaacaatggcatcccacaacgcggtacgtacgatggttgcgggatgattttgcaggcaacagcgattgcaagcgatttttggggactgaatcttgctcagcaaagcggttttgacgatccagttgtccttagcacccttgcattggcagtcgttgctctcatcgcttttatcgtctttgagcaacggcaacaaacaccattgcttcctttgcgtattttccgtgtccgtattttcacactcggtgtggtcactgtcttcttcatctttatggtgcagtttttcagcacagtgctgatgccgttctaccttgaagatgctcgtggcctgacaccaggtacggctggcacgctattatcactttatccactgatgatggtcttcttcgccccgtttggcggttggctggccgataaatggaacgtcccggcagttgctttgctcggcagcatttttatagctgtcggcagtcttatcggtgccacgttgaaattaaacgcaccgttgaccatttacatcatcagtacactccttgtcggcatcggcagcggtctttttcaatctccaattggcgatgttgtcatgtcagttgttccgaaaaatcagcttggcatcgctggcagtttcaatgcgctcgcacgcaatcttgggatggtcagcggcacggcggttgcgacaacagtgctctttggcacgatgagtcaacttgctggcagccgcgtaacgaactatccaacagcacatcccgaattctttatcagcggtttacaagttgccatgattgtcgctgctgtgctcgctatcctcggagccatcgccatcggcctgacaatcaaaccgtggcaggcacacgaaaaaaactagtgtcagttttcatgacagttcatccgtcagaacacctcattttccaatgaaagcagacgattgtttcgccggtaaatcaacgttcgtgcaacaagtccacttttcccttcggctcaaaaagtgctagcataaaagtattgtgtccgcttgcacagcgtcagcagacgtgcttaggaagcataacctgaatggccgagttttgactatttatgactggcatgcttacatgtaggttgctgcgactgtgggcgtattctaatgacggaggaaaacagccatgaaaaagaaccacacctcgacagcctggttgacttggggcatcatgctggtcggtgccaatctgcggctgcccatcacgatgatcccaccgttgctgccgacaattaagcaaacactcggcctgcctgcatccatggctggtatgctaacaaccattccattgctcatgttcgcgctggcctcaccgttaatcgccaaaatgggtaatcgtcgtggtaatgagtggagcttgctggtagcgctggttatcttgttggctggtagcctgctgcgaatcattcccagcttgacagctttaattgctggtactttgctcatcggatttggtatttctggcggtaacgtccttttaccggcaatcatcaaggaccaatttccccactctatcggtgctaaaaccagtctttataccgtgacgatgggacttattgcgtccctcggtactggactcgcaggattgctaaatcagcaattcaacatgcagatcacgctggcagctttttcgttagtcggcgtctttggattactcgtctggacgttggctttccgcacactaccaaagaaagcagcccggcaaggcgtccagcgcaaaaatatcgccgtttcgcgatccatgctagcgtggtggatcgctttattcttcggcctgcaaagctttctctactattctttgctgacttggctgccaagtctttggcaagcggccggtttctcccaaatcgcggcaggtaatctggctaccatttttcagctgagcgggatgccggcaacattatccatcccattcattgctgagaagcgccatggcctcttatatagtgtctggggcatcatgctaggctttgtactaggtgctttgggtattcttatccctggggcgaactttggcttaaacgttgtctacgcgctgctcatgggcgttgcttctggggccgcttttgccatctgcattgtctttttccagaagaaaaccgccgatgcttatgaaacagctagtctctctggctttgctcaaagtgtcggctacttagtggctgcttaaaaattctataattcaggcagttaagctaatatatgtctagctatgcgtcgccaccccatctggccggagattgcggagtttggcacggcagcggaccggtttaacctagccacttttcttccactattcgtaagctagcaaatcacagagcttagacaagaattgcggctaaatttctccctatgattgttcatcttcacttaactcatcaaagtcatagtacaaatctctttcaggaagcaccacagcagcatttgtttgggtatccaaggcttcggcttcgcgttccggatggaagctatgccatggcacaatggttcgaggattgacttctttcgccaaagtaattaaatcctcacggctagcatgacccgaggcattcatgaactgcaaggggatgtgatgcgcttctagccagtctttgagttgcgcaaaccgcgggtcgtaatcgcctagtggctcgccgttactgtggatgtaggtcgtgatgggcatgtcagtcagtcgttccagatggtcaaaactattttgcaggacatagtgttggggatcacgggcaatgtccgtcagactgattgtttgaccaagaatagcatcgggtttttgatcggtcatggtggtcagcacagccgcgtcatcaggttcccacaccaattgacggccggcagtgtgtgcactggcctgaaaacccgccagacgctcgtaattgcggatgtaaggattgatgacgacaagcgtcggactttccgccagcactgtctgaaattgcttctgcaggctcatttcggtcaatgggatgctgggatgatcctgatcttcgactggtgcagccgtatcaaaagagaagctggtgccttccaacataaacaagcttagcttttcttggttaaatcgctgggcccaggcatgaacccgttcagcatgcgggccatttaaccggacatcaccggaatgggcatagcgtcgtgagccgtcatcgactaggagcgccatgacgcctggctcgtcgtgatcactgtggaagcctgttacggtgaggtcaccaatggttatgggctgttcataggcaagcggatgcagatttgcaactggcttttcgatgcctagtttgattaacagttgatagagcttataggatggttccgaaagataaatcggaatcggtttctttaaatattgcaatgcacccatgtggtcaatgtgcagatgtgagataaagatggcctcatgtgtgtaaacgtctggttgatcaaaaaatagttccggcacatgcggcaatttaccattatcgatggcagagctgactgtttcgttgctgagatcagcagccacgccgaattccatgataacgcggctggttttagttgcgaattcgacgatgttgccgccgatggtgtttaacccatttaaaaagcgaattgttgtcacagtgttacctccaattgtttcaatatcattttgagaacactaaagcgtaccccgccggctaccgaaaagcaaacaaaaaccgaatcagcacatagctgattcggcaaagatcaaggcggagcaaacaattacttgtttgtcttgatgatggtttcagtttggccctgaagtgtcttcaaagcctgatctggtttttcatgcttagtcagcatcgcatcaaccgcattaagaagatcgttacgatattctgagaagccgatgaaagcggtggattggaagccaaagcccaaagaatcaaccgcagcttggctagttgggttagcactcagatatttcttaaagtcagcagatttaacagcggacttacgcagtggcacataaccagtcaattgggcccacttggaagtttccttctcagaaagcaggtacttcatgaatgcccaagcgcctttttgcttatcgctagatgcggacttgaagaggacgatatcattaccggcaagttcggttgcctttttgcctttgtagctcggtagcggcattgtgccccacttgaagtcttttggtgcattttgcttcatgttggtgatcccggcacttgaaccagcataaaagagtgttttaccagcggtgaagttcttatcgccgtaaatgtcttcgccggcggtcttggcttcgccgctgttaaccatgtccataatgaagttagcagcagttaaggttttcttgctatccaagttagctttcagcggatcagctgaaactaacggattgccagcctgacgtgccagaccttcaaattccatatcaaaactcttatcgaaaccaatagcggcaataccgtctgccttcagcttatcggcatcttttttgatgtcttcccagctggttggcttggcaatattgtatttcttcatcagtgcttcattgtagaaaagaatacgtgtggacttggagaatggcacgctgtaatacttgccttgatacttggagctggacaagaaggctgggtagatatccttcaagtcgctgctgctcatcttgtcgtcgcctttgagcatgtattgatcaagcggggaaataaaaccatttttcacgtagtcaggaacagtggtgtaagttgtttgggcaatggttggcaggttgcgagattttgctgcagccatgatcttttgttgcaaggcggtgtagttaccttgcgcggtgccgacaactttatactgtttctgactcttattgaaatcattgatgatttgatcaagagccttttggtaaggaccgttcatgccgtgccaaaaagtgatcgtcacccgtttgcccgaatcactcttggtacttgaactcgatttgctgttgctgttactgccgcaagccgtcaaaacagcgacaagaacgacagtgaacattgcaagtaatgcttttacccaagtttgctttttcattttggtagattatcctttcaatccagctttagaaatcccagcaataatgtacttctgcaagaagatatacaaaacaaccattggaatgatgacgaatgtggaagcggccatcagaagttgatattgcgtgccggcatcggtcgtgaaggcctgcaagccgactggcaaggtacgcatcttgtcagagttcgtaacgatcaatggccacatgaaggcattccatgagccaatcacctgaagaacggtgaccgcggtaatcgttgacttgctcattgggacaagcacttgccacaaatatttccaatcggacgcaccatcgattttagcagcgtagtagatctgattcggtgttgattggaaagtctgacgcaaggtaaaaacggtgaagaagctggccaaccacggcagaatcaaagcgccgtaatggtcaatttgccctaagtgtgacaaggtcacgaagttagggatgatcaacatttcacctggaatcatcatggttccgaggaaaataatgaacaagaggttcttgccgtaaaacttcaatcgagcgaaagcaaaagcggcaagaatactggtaaagagctgcccgaccgttgtgataacagtgacgatcgtgctattaatgaaatactgtccaaacggtgcttcgttccacgccttgacgtagttaccccattgtagaaccttagggatccagatcggtggaacggcaatcgtttccggtgccgttttaagcgatgtggagatcatccataagaaggggatcagcatggtgatcgcgcctaaaatgacaatcaggtaaagcagaattttactgatttttttagccatgtttttgcctcctccttagtaatgaacgtgcttgcgggaataccacaactgcacgagtgtcactagcaggatgaggaagaaaagcacaaccccagaggcagcagcaattggatacttgtactcggtataaaatttctggtacagatagtaaacaattgtcaaatcagctttacctggtccgggcgtgccttggaacaaggcgaagatttcatcgaacaccttgaagctgccgatgatcccgttaactgaaaccaagaaagtgattggtgatagcatcgggatcgtgatgttccaaaatcgctgacgcgcgttggcaccatcgatttcagcggcttcgtaatacccgtggtcaatgttgttgagaccgaccaagaaaagaatgatgttgaagcccaaacttttccaaatactcataatgatcagcgccagcagtgcataatgcggatcagtcagccagttaatgggatggataccaaaccagcccataaagtagttgatcagcccatagttactgtggaacatccaattccaaaccatcgcaatcgccacagtactggtgacaaacggcaggaaatagacggttctgaagaaaccggagatgatcttcacctggtttagcaataaggcaatgatcaaggataaaatgacagtgatcggaaccacgccgacaacaaaaaccagcgtattccgcacagccaagtgaaaatcaggatcattccaaagataaacaaagttatcaaagccccaagcactgaccttatcagtataaaaatcatacttcgtgtacaaactcatcagaaatgagttaataatcggccagatattgaaggtgatggtaatcaccagcattggcagcaaatacagcgctgctttggcggtcgattttaggcttgctttttcattcagcatgactttcaccaccaaaaatcaaggcgccggattggtcaaaaagaaagaaacccgacttggtgagatagaaatccagatctggttgattagctgcgacaccagccatttctgttgacaacaggtgctcgccgttataagtaatatcggctgtagcttcccgcccatatttagaactttgcgtgatcttgccatgaagcttggctaggacattgtcgccggcatcataagggatgatggcttcactacggatccctgcggtgactgcctgcttcaaaatatcttctgacacagcgctagctagatcagttgtcaacgcttgtgctggcaaggtgttgatcacaggctcaccgataaacttagcaacgaacaaattgttcggtcgctcgtatagtttttgcggggaactgaactgttgtatcgaaccatttgccaaaaccatgatgttatcagaaatgtgtaatgcttcatcttggtcatgggtcacgaaaatcgtggtaacaccggtttcgcgttgaattcggcgaatttcttcgcgcatctcaattcgaagccgggcgtcaaggtttgacaacggttcatctagcaacaataggctaggggacttggctaaggcacgtgcgatagcgacacgctgttgctggccgccagaaagtgcccctggtttcttatcaagctgatcctcaacatgaaccagtttggcaagatccttggctttggcgtgccgttcagccttgctgaccttggccattttcagtggaaaggcgatattgtccaacactgacaaatgcggatacagactgtagttctgaaataccatcccaactttacgcgctaaggcatcttttttagtcacatctgtatcaccaaaaaagatttgcccagcggtcggggacaacaacccggaaatgagattcagggtcgtggttttaccgccgccggaaggacccagcagggaaaccagcgtgccatcgggaatggtaaagttcagatccttcagggtatctgtcttgccatcgtaggacatcgtgacgtccttgaaagtaactttcaacccagtacgctccttcaaatagttttctgctcctcacctccgttcgtcggtctccagcaacaaaggctgtaagaacgcgcaaagagaaaatttggaacaagatattgtggttgcttcaccatgattagctacatctagagaaggcaaacacaactcttctcacattttaacccagattcactgaaaaatggactcattcgcccaaaaacattttgattatgtttaattgccatcacaacgcgaatgttcgccttttttgctataatagaaagcatgcaaaaggcgcaacttgaatcaactgctttcgctgctgatgagtgtcagcaaattggcggttcattcagcgccaataaaagaggagcgatttttttgataatacgtccaagcaaaccggacgatgcgccgcaagtagcaccgttgatcgatattgtgtttacggagatggaaattcctcagttaatgaaggttcctaagaagaccctgtattcggttttggaacaagcctttttactgccaacttaccggtacggttacccgcaaatgttggtggctgatcaggacggtcagattgaagggattgctgttggctatttgcatgagcaggaagcccatatcgacgatgctttaaaaccgttgttgcctaagctgggattggccccaaattcatcgcttttttcagacaccgaaacttatgccggcgagtggtatttagatacgctagcagtcgccgagacagcgcagggacatgggatcggaaccaaattattaaacgcagtcgatacggttgcccgtgctcggcacgctaaagtggttagtctgaacgtggatcagcagaatccgcgggctaaaaagttatatgagcgcaatggttttcttaaacacggcgagttgatgattggcagtcatcgatacgatcatatgctgcggccggttgtgggcgaggaagtttagtgttagtcaataggtaagcctaaagcccttagcccgccgaacgccgcaatctcctgcgacgcgcagccagagtggagacggcgtttcgagtccaaaaaccggtctcgaagttgcctaatcacatcggctccaaggtcaggttgtacggttgaacgccatctggtctacgagtgctccgccttggcaatagggtctctaaatagcaatgagaaataaagacgactggtattccatggaggaaaatcagtcgtctttatttgatagctaggaatgatggtcttagcttttcttttcgtttaatctgggaaatccagcccatattcataacgcttcagtggatcggccacacccacatggcgaaagcggtcgaggatagcagctaacaaaatggccgctggaatgtcgcggttattgggaatggtcaacttaacgattgctggtgcaatttcttcagcactgaagatcgttttgaccccatgaaacacttgataatggttattcaaaagattacccatggcgacccagttgagatctgagataaagatgaactgatgccagaccccaaacatttttttgacgctggcaaccttgcgattggcgatataaagatcatagcgcgggaaaacgctgaccgttttttgtcgaatggatccaagcggttcgccgcttaatgtattcagatcgaagccaccattaatcagtccgtgccggcccgttagaatgtaggccggcttgccgttatcggttttgaccacacttaaactactcgtgcttaaagcattgatatcaagatataacgccatcggccaacctcccttatggtgatcgtgaactggcgcggttagaaaccggagcataagcgggctcaagcgcgatgggcgggttttgcccattgtgcttgaggtccttatgagcaggtttctgcgtcagtgagcacgttatggtgatcgtgaaccggcgcggcgcccgtgtttaaaaaattaaaatcagcaaactatcgctgcgccaatgattattagaattgagcgtttgatttttccgccttattaatgcgaatggctttgcgaattgcctgagcaacgccgttttcgctattagtggcagtactgccccatgcgagcttggtgatttcggggatggcgttccccatcgccatgccatatttggccattttgatcatgctggcgtcattcaagttatcgccgattgtcatgacctcatccatggtaataccgcgttgcttagcgaaagcttcaacagcataacctttttgcgctttgatgttgttgacttcaatgttattcgcagagcttgaggtgacacttaatttaccggtggcttcaaaaaccttcgccggtgctttcaaaatatcgcgttgctcgccagtaaacgcaatgattttcatcacttggatagtagggtcggctagcagttctttatagtcactaacgtaattgatgttcatgatttccagccgtgcagctgcgagcgcaaccgccagtttgtaggttgtatctgggttgagatcaaccaacagatcggcaacattttgaatacgtttgacgcggctgtccgagaagacgcctttgttggtgatgatttcaaaatagatgtcgtccttttgcaaggtctcgacaatgaaatcgcttaggtcactagcaattggaatcgtgaccaccaattcgccagcctcatcaaaaaccatggcgccgttgagtgtaatgaatgctggtttgagatcttgggcggcaagtaacggtgtagcttcggtgacgccgcggccagttgcgaccataaattcgattccagcggcttgcgcgtcacgaatggcttgggcgttttcgtccgaaacttccattttgtcgtttaaaagtgtgccatccatgtctgatgcgataagtttgatcatatttactgttccctccggtttgtcatggtgcggttacgcctccaattctagcatgaaaaagcgtttcccggtagcaaacccgcggtgattcttgtacactatttgcggaggtgcacgtcttgaaaacattaatacataatgactggcagacggtgctggaaccggtatttgaaagtcctgagtatgctcaactgcatgcgttcttaaaagaagaatacgcgacaaaaacgatttaccctgaaatgcaccatatttttcaggcattcgaatggacacctttccatgatgtgaaggtggtcattctaggccaggacccttaccacaatccgcggcaggcggttggtgcgagctttgcggtggcacccggtgtcgctttgccgccgtctttgcaaaacatttataaagagttgcaaagcgatttaggctatccaccggtccatcatggttatttgaaggcatgggcggaccaaggcgttctattgttgaatgccgttttgacggtacaagccggcgaagcctattcccatcagaatcatggctgggaagagttgacagatgctgccattgctgccttgtctgcacgcggcggcgttgtgttcatcctgtgggggaacgcggccaaaaaaaaggcggccgtgattgatacgagcaaaaacgcgattattgcatcggcgcacccaagcccgttatctgcatctcgtggcttctttggcagtcgcctgttttcgcgcaccaatgcggcactagaaaaaatgggcgaggccccgattaattggcagttaccagaaacggtgaaggcgaattaacctgaattgactagccttaagtagctcagacacactgtttttccattgtcttcgactagtcatgacccgataaaaacggtatgatgaacaagaataaagcgcttttatggagggataagatttggacctatttgaaagtttaaaagacaagattaatggcaaaaatttacggattgtatttccggaaggcgaagatccgcgcgttttgggcgcagcagttcggctcgcagcagacgggttgatacaggccatcgtgctaggtaatcctgataagattcagacattggcagctgctaaaagctgggatctcagcaagttgacagttcgcgatccagccaacgatgacattcacgctaaaatggttgcggcctttgttgagcgtcgcaaaggcaaggcaaccccagaacaggccgaaaaaattgttcaggatgccaattattttggtacgatgctggtttacatgaaggaagcagacggtatggtttcaggcgcagttcattcaacggctgacacagtccggcctgctttgcaaattatcaagacgcgtcctggcgtgcatttggtcagtggtgcgttcattatgcagcgtggccgtgacgaacgctacttattcgcggataacgccatcaacattgatccagatgctgatcagctggctgaaattgcggttgagtcagctaaaaccgctgccttgtttgatatcgaaccaccgcgcgtcgccttgctgtcattctcaaccaaaggcagtgccaagggaccgcaagtagataaggtagttgaagccactaagaaagctcatgaactggcacctgatttggccttagatggtgagttacaatttgatgctgcttttgtcccaaccgttgccaagcaaaaagcccctgattccaaagtggctggggaagcgaatgttttcatttttcctgaattacaatccggtaatattggttataagattgcgcaacgattcggcgggtttgaagccattggcccaattttgcaaggtttgaatcagccagtttctgatttgagtcgtggggcaaatgaagaggatgtctataagttggccattattacagcggcccagaccttgctatgacaagtttgaaaaaagacttcactagtgaggcagcactgcaatcctttgcggcttcactgggaccgcagttgcaagcgggagacgttttgctgctggatggtgacttgggtgctggtaaaactagtttcaccaagggcttggcaaaaggcttaggcatcaccgattacgtcaaaagtccaacatttacaattattcgcgagtatcgtcatggccgattaccgctgtatcatatggatctgtatcgcttagaagacggtggggctgaggatctcggtcttgaagagtacttcgaaggtgatggggtgtctgtcgtggaatggccggattttttgggattaagtgaaccagagacctatctgatgattcattttcaaaaagatgacaatgaagatacaacgcggcatctcgaatttgtgccgtttggccaacactatgagaatttactcgaaagcctatgatagcaagcacgcaaagaacatttgcgtgcttttttgatttggtttggtaaagtggtgcagaacaaagaaaaggcggtgcgttatgaaatttggcgaacagttggccgctttgtttgttgggcttttcgttggcgaagtcacaatctgggcagttatccacacttttcgaagacaatggcgtgcatgagggtcacagaatttggtctggctactttcactaggacaataaatctgcttttgataacacgttatactttgataaccaaagtatgcatggtagactattgacaacgtgagaaagtgagctaattcataacgtgaacaggcacgttggcaagctgagatattggtcttaggcgtgatgaccagttgtttgtcattgcttctgaggctcttaccatagaggcttgagcatctgtgagcgcgttttaagtaaaggagtagtggccatgctagaagtcaaggatcttgtgaagaccttcggcacgatgacggcggttgatcaggagagcttcaccgttaaaccaggtgaaatcatggggttgatcggccaaaacggggcggggaagacgacaacatttcggatgattttgaattttttgacaccagactctggtgccatcacttggaatggtcatccgttaacagctaaagattatgacaacattggatatttaccagaagagcgcggtttatatccaaagatgcgggttcaagatcaaattatttattttgcgcgcttgcgtggtatgcgcacgtcagaaattaaagccaagattccagaatggatggaccgatttcaggttaaaggcaagcctaccgataaaatcaaagacttaagtaaggggaatcagcaaaaagttcaggtcattgccacaatgattcatatgccaaagctggttattctagatgagcctttttcgggatttgatccggttaactcaagcctattgatggctggcattcagatgctgaaagataatggtgctgcgattatctattccagccatgatatggctaacgttgaggctgtttccgatcatctggtgatgctgaaacagggacagatggtcttaaacggagcggttggtgagattcgcgaaagttttggtcggaccaaactattcattgagtcagggttgactgccgatgacttgcgtgaatttgacggggtaacgaaaatcaagcagcatggtcaagaatttgagttgaccttagccgatccggcagttggtcaccagatttttgctaaagcaacggaaaatggctacataccagagttccgtcaacaaccaccgacacttgatgaaatcttccgtttgaaagcaggtgaagctgatgcataagttttgggtggttatgagtcaggtctataagaaaaatgccagaagtggttcatggatttttctagtattgtcaccgctatttttccttgcgattgcttttggaattgttttttatatttccaaaacgcaagcacctgctcaggtcgcagttgtcagtgacgttggcgttgtgcgccaagcattgattaaacaaagtaccagtgatttacgctttaagccgtatacttctgctaaaaaagccaatgatgcactgaacaaagaagatcttgatggcattttaacggtgaatgccaaagatgacttcaagtcgcattatgttgctcgcgataacggtcagacagttgagacttcaacgctggtggcagcgctgagcggattgaaattgagcagcacggccgcagccataaagctgacaccagctcaggttaaggctttaacggcaccgccgacagtgacatcgaaaacggttgccattgaggatggcaagcaggtagccaaatccaatacggcacaacttatgaatcatggccttgcgctcgtttcaatggttttgattctgatggtcaccatggtgtatggttctattctggcacaggaaattgcaactgaaaaaggctcgcgaatcatggagatccttttgtcctctgtcagtgccacgacgcaattctttggcaagttggcgggtattttcgccttgttgctgacacaactggttatttggtagattgtaaaattaatccgaacgctgttcggacaaaaaagatcagcttcctctattcgcacacgtactacacagtccgctctggtgacagcttctggagcattgccagcaagtatggcatcagcatgtacatgttagccgctaacaatggcaagtcaatctatagcctgatttacccgggcgaaaacctgtatatcaagtaatgggttgccgttgaaaccgaaaaatttaaataaggtgagtatatgtctaaaaaaattgatcaagcacgagttattgagcaaagctatgtgagacgtgacttaatgagagccgtttcagagttgctggactccgcttcagacaagcattcaactgatgaacttatagatgctgttgcctccgttcagtctgtgacaatggccttggagcataaatcagccgtttgcggtcctcctggtctacgtggctgggacggagaagaatactgatatatcaggtagcaaaaaggccctctgctcgctaacgcgggtggagggcctttttggtgttggaagcgaagttttcaccggattatggtacggatgtggtacgagacactttaaatgcctttataccggcaaacatgacggttcaaaatgtatcgccgatgagaaggctcatcgcttacagtccgctatgattagctaaaaaagttaatttgcgggctatttttgggcgtcactttttcgattgcttcggtagtcttaaacgacaaggatttaactgatgatctcgcaaaaaataagccttgataacaaagatcgatgagggaaaatggctttaaagatgagaacgttttctaaaatgcacatcacactagcaaaatctggtacacttattgcaatgaaaaacatctgattgtgccctagcgtcattaactgacaaagggataaacggttttgcagtcgtcttggttacttgtttcagatacgatcactaagaggtgggcagcttgggaaagagaacttacaaaaatgaagagcgctgggtagacgttgtttgttgccttagcctttggttggcatcttttagtttgatggcagccgctacggtactggatgtcaatcgtccattcttcattattatgctgtcattaacggcctgcgccattggcgaaacggtgacgttggttaggaaaaagcgctgaggcggataataagattgtttaatgctatcacgcgtcacggtaaaatgggccattattagctgtgtcttttcagtgattatttttgtgacaaatcaaccaataaccgaccacgaaaaatacagttccaagtgttgcaattcctaaagcatcgagcaatatggaagcgataaagccattccgaatggcaaaccataaaactgcactgacaaacatcacgcaccatcctccaacaaaacttagaccaacaactttatttgtttgcatcaatttaatttccagtagtagtttaagttgccaatgagaatgctttctatcttatagcaaggataacatgaagttgaaaatgttggttacatttttcaacataggggcagtgatctttcagctttatggcgatttaatgcacgccacttcgcacacaataaaaagcgatccgcctattttgggacggatcgctttttgttcatattaaccgctattacctaatcaacaacatcgactttcttagcagccaatcggcgtcgattgagccacttgcgtccttcttcgatgaggaagagcggaattggaataatagccaagaagatccaatccgttggggcgagtgggccggtgtgaaagagttcctgtaagaatggggtatagctgagtagtgccaacaggaaaatttcaaagacgatcccgaaccaaacgagtttgttagcaaaaagaccggctttgaaaacagaagcattttcggttcggcagttcatcgctgcggcaatctgacagaagatgatggcggccaaggtcatgttagtcgccatgacgtaagtgttgccactggttgccagacccttcaacggccagccattgagatggttgacgaagaagtaggcaccgcttgaaatgattgaggcaatcaggccataccaagcaaacgccttccagagaacggttttactcatgaggtgggcatcgcgtgctcgcgttggcttgtccatgatgccaggttccgctttctcagagccaagacctaaggctggcatcatgtcggtgccaagatcgacggtcaaaatttgcatgacagtcaacgggagcggaatcgcaccacgtgagaacaggaataaggctgaaggtaccgcttcaggcaagttagaattcaagatgtagatcaggaatttctgaatgttactgtaaacggttcgaccttcttcaatggcggcaacaattgaggcaaagttgtcatcggttaggatcatatcagcggcatccttggcgacatcggtgccggtaacgcccatggcaacaccaatgtcggcttttttcaaggctggggcatcattgacaccatcgccggtagaagcaacgatctcgcccatttcttgcaaggttgagacgattttgtatttctgctctggggcgacccgtgcgaaaatgatttcgccagcaagtgccttttttaaatcttctttactcattgaatcgagttcgccaccggtgacaacccgcgctttgtcagaagtgaggccgattttgaccgcgacggacttagctgttaaggaagagtcgccggtaaccataataattttgatgctggcacggtgacatttcttgatggcttcgtaaatttccggacgtggcggatcggacatgattgctaagccaacaaaggtcaaattggtttcggccgtgtcgattgtgaggccgtcaagttgtttttctttatctgtttcttgaggcacctcacgataagcggtggcaatggaacgcaggccgagggaagcatatttgcggttggcatcgtcaatcgcttttttatcgtcttcagtcagtggccgaactttgccattttcttggatagtgtcacaatgcggcagcaagtcgctcagcgagcctttggtgcaaattgataaggtgtgatcgtcatgttgatgaatggtggtcatacgcttccgatctgaatcaaacggcagctctttcaggcgtggatacgtaatgctgtatgccttggtatcaatgccggacttttgggccaaaatgaccagtgaggcttcagtcggggtacctaggattttcggccgagcactgccttttgacggctcaacttcagtatcattattgaaggcaactaagcggatcagcaaatccagatcggcatcggtgccatatttaatgggtttcccgtccagttgaatctcgccattattcacgaagtcttggccagtaacggtgaaggaatgagcaggtgtccagatgtgatccacggtcatctgattttgggttaaggtgccggttttatctgaacagatcaccgtggtttcgcctaaggtttcaacactattcagatcttttaacaacgcatgctttttggccatgcgttgaacgccttgagccaaggacaatgtgactgttggcaacaagccttcagggatgaaggctacgatcatacccaaggcgaaaatgaagctttgagccacagggtagtggacaaagaagattgccgaaacgaagaataccagaccaagaccgatggcaatcagtgaaatctgtttggttaaacgatttagctctaattgtaagggactcagacttggtttttgttgttgcgttaacgccgcaattcgaccaaactcggtattcatccccgtggcaaatgccactgcagttgccgtgccagcgccaacagtagtgccagcataaacaaggtttgattccgcgaactcaccttgaccagcatcaaaggcaactttttttgattcaggtaccgattcaccagttagggcactttgatcgacttgaaccgaagtggccttaatcaagcgcgcatcaaccggaaccgcattgcctgcctgaagattgaaaacatccccaggtaccattttggttgcattaatttgttgcagtttgccatcgcgataaacttgcgtataagccggtagcattttcattaacgagtcagttgctttttgagcttcatgttcttgccaatagctgaaaacaccgttgataatattgactagccaaatggcaatccctaattcgagggtgcctgacaggatggcgacaaagccgctgacccacaacagaatggccatcacgcttgtgaaatttttgaggaaaatgagtaattgtgattgttgcttttcccgagtaatcacgttttccccatatttttctaggcggtcgtcggcctccttctgcgttaatccagttgacgttgtgtgcaaatccgtcatcagatccgggacgggatccgttgcaaacttgcgccgcgtctccttttcatttttcatgacttaagcacgtctccttcataaagatgtttagcttcattctaacgttctgagcggcggaaaacacccaaagtgctgtttttaagtaattaaacttttcggcttaggcgcggagaccgcgttctaagaattcaaccgcttcgtgaacggcagtttcgagatcaaaagcggattgttcaccgataatgagtggtaataggtaactaagcacggttccaaaaatggctcgtaggactcggttaaatggccaatccaccaattgtccgttagcctgataagttgcataaaggcgcgcggcttttcccgataactcgcggttgaattgctcagcgagctcttgtcctaaggtagcatcacgaagaacagtggctgctaaaacccgtagctgggcttgattagcaatggcaaactgcatacgatcatgaacaatgaacgttaaaaaagtgtgtaagtcgggcaaatcttgttcaccgacttcattaacaaactcggttaatacgtttggcattacttggcgaatcataggggctagtagcgcctgaagaatcccatctttcgtcttgaactgcttgtaaactgtgccttcgctgacctgtgccgtttcagcaatttctttagtgctagtgcgatcaaagccttgactagcaaataacgctaaactggcctttaaaacggcttgctgtttagcggatagattgcttttggcaagtgaagcggaaaacaaatcggtaatattacgtgtgtgcatcgcgagatcgcttcccttcaataaaaattgctcgactttatacttgccggtattttcgcatcgtgagtagatttaatccaagaaataataggaagaatccgaataaagccaacacatccggatagaggacggcaagcgactggcctttggcgataataccggttaaggcattagcaccatagtataaaggcatgatgtgagcgatgggttgcagccacccaagcatgtgatcaattggaattaatcccgtaaagaaaatttggggaataaccacaattggaatgaattgcagcatctgaaattcagtgttagcaaaggttgaaatcaacaagcccagtgccaaggcagtgaacgctattagtaaattgatcaaaaagatggcggggatgctgccaagaatttgaattttgaatacgatcaaggaataaccaacgattagcaatgtctgaataatggcgaaaataccataacctagtaggtaaccgctaatgatttcaccgcggcgaaccggcgttgccagtaaacggtataaggtgccagtggtccgctcgcgcaacaaagcgatgcccgaaatcaaaaagacaaagaagaagacaatgaatcccattaaaatcggcaacagggtgtcaaagtaagttgagtcggctgagccatatcggtaatgggttgttaacgtgtaaccgggtgtttttggctgatagggttctggaatctgggctgcgccgcgcgtggcctgtttgagagctgtcgcaagcttttgtaaggtggttgcttggatcttaagccctgtggctgcggcttgcatttttagtttgatagaagcggcttgcaaggtttgtttcagaatcgcgctttttccttgatcagcgttggccaacgtcagggtcagcttatcgccatcctgcgtgagcacaccggcataatcatgagccttgattaatgcgatgggttggtcatttttgacctgatgcaatcgaacgtgtttggtatcgatcgcctttgttagtgccgaatcaacagcatgaactgctaaatcagccttggtgtccgtattggattgaaaaagaaaaaagatcaacgtcatgataaataaaggcgcgataaacatcagggctaacgtgcgcttatcgcggagcatttcttttaaaatccgattaatcaacgcttcaatgcgcatcttgctgcctccctgcggctaaaaagaccgcttcaatcgagtccgtttgataatctgcctttaattgtgccggtgtcccttgggcaatggcagtcccgttgcgaatcatcaataacgtgtccgcttcttcggcatcagccatgacgtgggtcgttaaaataatggcgacaccttgatccgccagacgatgcaattcatgccagatctgttggcgcagctcagggtcaatgccaacggtcggttcatctaaaatcaacaactgcggttgactgatgagggcgatggcgagcgataatcggcgcttcatcccgcctgaataatccttaactggttgctttaaggccggttgcagattgacgacattggcagcataagccatttgtttggcaatctgcgcgtgtgggacgccttgcattttggcaaaaaatgtcaggttctcggcaccggtcaaactttcatataaagcatcagtctgagccatgaagccgattttcgcgagtaggggacgattcggcacggcttgccctaaaacgctgacttgtccggtgcgtgggcgcaacatacccataatggtactgactaaagtggttttgccagcaccgctaggaccgattaaagcaagaatttgaccatgatttaaggtcaagttgatgtccttaagcacgatctgtttaccatagccttgggtgagggcgctgacctgaacagcttgatttgtttgcatattatcgcgtcactttctcaataatatagtgagtgctcactcacttgccattatcgccaattttggggtaaaagcaactaaaagtttaaaagtcatcagccaaatcaatcggattgttgtcaaaaggatggcatctaaaagctgcttcaagctgtgttatagcgactgaaaccgcttatgctcccgtttctggccgcgtctgtgcacacctcgtggtataattattcagaagtttgattctaaaccataatggaggaacgcggatgcgcacctatctgacaaatttattaacttggcccaccttgatcaatctggttgacatcctcgtcgtctggtatgtcatttatcgtttgatcatgcttgttcgcggtacaaaagcggttcagcttctgaaaggcgtttttgtcattgctgcgatcaagattatttcttggttccttcagttgaagacggtcggttatttaactgatttggttattacttggagtgtgccagcactggttattatttttcagccggaaattcggcgtggccttgagcatctaggtcgcggttccttgatttttcggtcgaataataatcagcacgaagtcgaagtacggatggtcaaagaacttgataaggctattcaatatatgagcaagcgccggatcggggccttaatgacgatccagaagagtactgggctggaggattacattgagacaggtattcccttggatgctgatattagtggagagctgctgatcaacattttcataccgaatacgccgttgcatgatggggcggtgatcattcgggacaatcgaattgcggttgcggctgcatacttacctttatctgacagcaatctcattcctaaagaacttggtacgcgccatcgtgctgctgtcgggatcagtgaagtgaccgatgcgttgacgatcgttgtctctgaagaaactggggaagtgacgatcacaaataacaacaacctgattcgtaatttgacgcgtgatgactatatgaagtttctgacggcgcagttagtgccaaaagaagaggcgccgaatccgaacccagttgtcagtttcttttcgcgccggtttaagtcacgtaaaaagaaggagggcaagcaatgaatcgcttatgggataatccatgggttaatcggttgttggctctgcttctcgcgattgggctttttgcttatgtcaacgttgaaagcatcaacaataccagacaaagtgcaaatgatgatacaaccttggttaccaacaaaacccagaacgtgaaagtgccgttacaggtaaatgccaacacggacaagtattttattactggttatccgtcaaaagtttcagttgcattgacaggaacggcttcattagtcacgatgaccgccaacacccaaaattttcggatcattgctgatcttaccaaactcggtgttggcaagcatcgtgttcggttgaaggcagaaggtttgaataaggatttgagttattcgatttcgcctaaatccgtgaccgttgacattcaggttcgggacaataagacgatgccgattcaggttcgctataataaagccagtatcgcatccgggtatgcagctggtgagccaaagctgtcgacacgaacagtggatgtcactggcgcacgatccgtgattgactcgatcgcacaggttgtggcaaatgtctcgctgtcgcacaatacccggagcacggttgaccaagaggtgctgttacaggcgcttgatgagaacggcaatacgatgaatgttgtgttggcaccgcagactgttcatgtaaccttaccgatttctcaacctagcaagaaacttaccgtggagctaaaacaaactggtactgccgtgtcaggacgcacgtatgtcttgtcctctgacacaaaacaggttaccgtatacggagaccaaagtagtttggacaagttgagtaaattaaccgtggacgtcgatgtcagcggtattagcacgacgacaactcggacttacaacgtgactgatttgaatgatggcatttctgctgctagtccgaaatcacttaaagtgacggttggtgttggcaacactggtaatgatgataataataacaacaatggcggttcaacagcgagcgccagtacttcgagttcgagtgccgcaagcacctcgagtgccagtgaatcagactcaagtacatcaacaagcgacaataatggctgaaagaaatgaggaagaattaagatgacaaagtattttggtactgatggcgttcgtggtattgcaaacaaagaactaagtccggaaatggctttccggctagggcggacaggcggctatgttttgacgcagcacaaagaagatgcgagtcgacgcccattggttttggttgctcgcgatacacgaatctcagggcagatgttggctgatgctttaattgctggcttgctttctgttgggattgaagtgctggatttaggcgtgatcacaacgcctgctgttgcttatttaatcaagattcaaggcgccgatgctggtatccagatttcggcgtcgcataatccggttgccgataatggcatcaagttctttggagcggacggctacaaattgtctgacgatactgaagaagaaattgaagccttactggatgcgccagaagacaaacttccacggccggctgctgaaggattaggtacagtagacgattatcctgaaggcgcactcaagtacacccaatttcttgagcaaaccttggcagatgatctgagtggcattcatgtgtgcttggatggcgcaaatggtgcaacgagtgggttggttagtcgaatttttgctgatcttgagaccgattttgatacaatggcaatcagtccagatgggcttaatatcaatgctaacgttggttcaacgcatcctcaggcgttatcgaaatttgtcgtcgaaaaaggtgctgatgttggcctcgcgtttgacggtgacggtgatcgctgtatcgcagttgatgaacaaggcaatatcgttgatggcgacaagattatgttcattctcggtagttatatgaagtcacaaggccggctgaagcaggatactgtcgtcaccactgttatgagtaatcttgggttatataaggcattagaagcgaatggcatgaagtccgtgcaaacggccgtcggtgatcgccacgttgtcgaggccatgcgcaaagatggctataatattggcggcgaacagtctggccacgtcattttgtttgattatcacaataccggggatggcatgctaacaggcattcacttgttaaatgtcatgaagaaaaccggcaagaagttgtctgaattagccgcacctgttcaagactatccgcagaaactggttaatgtaaaagttgcggacaaggaaaattggcaagcttatccagaaatccaaagtgccattgataccgtcgaaaaagaaatggccggtgatggccgtgttctggttcgcccttcaggcactgaacctttgttgcgggtcatggccgaagccaaaaccgaagatttggtttcccgttatgtggatcaaatcgaggatgtggtgaagcaagaaatgggcagcaaggaagattagctgctgtctttatcaaaaatttaaactttattttaaccgagttgtcacgggtctcatcgacaactcggtttttttgtctggtgatagcattcgcaattggcacgctttgaaagcgcgttcataaaatttcaaaaccagtgtgcataagaattgggtaaattaatatagaccaatatatatgtttcaagtataccagtgaaaaaatggtgttgacatatagcctattaaaaactatagttagctttgcttttaacaataccaataaaaaaatctgtctaaaccaatttttagacaaaaatgaaaaggatgttgactatgtgtggaatcgttggcgttatcggtaaaaagaatgcaacgcagatcttgcttaagggattagagaagttggaataccgcggctatgattcagccggcatttacgtgaatgaccaagccggccatgatcatttaattaagcgtgtcgggcatatctccaatcttgaagaagcggttacgcctgatgttcaaggcgttatggggattggccatacgcgctgggcaaccaatggcggccctaccgaagccaacgcccatccgcatgtttccaatgacgaacggttttatctggtgcataacggcgttgtgaccaatgccaacgaactgaagcagcagtacttgcaagacattgaattacagagtgatacggataccgaagttgttgttcagctgattgccttgtttgcccgcgaaggtctgtctgctaaggaagcactgcgcaaaaccttgaaaatgatccaaggttcctatgctttctcgatggttgatcgccttgacccaacagtgctgtatgttgctaaaaacaagagtccattactgattggccgtggtaaaggctttaatgtggtggcttctgatgccttggcaatgcttagtgaaaccgatcagtttgttgaactgaaggatcaggaaatcgtgaccttgacggctgatgccattcacattgaaacgattgacggcaaagttgaggaacgtaagccattcaccgttaaagttgatgatggtgaagtttctaaaggtacgtacccattcttcatgcttaaagaaatcgacgaacagccaatcgtgatgcggcgtttggtcgaaaagtataccgatgatcatggcaacatcgttttgccagaagatttgctgaaagctttacagcaagctgatcgtttgtatatcgttgcggctggtaccagttatcatgccggtttagtcggtgcacctttgttcgaacaattggcaggtattccgacagaagtgcatgttgcttctgagtttgcctatcatcaaccactgttgtccaagcacccactgttcattttcctaacccaaagtggggaaactgctgatatccgtcaggtccttgtgtcagtcaaggagcgcggttatcagacattaacgatcacaaacgttgccagctcaacgcttgctcgtgaagcaacctttatgttgcagttgcatggcggcccagaaattgcggttgcttctaccaaagcttacacggcacaaatcgccgttgaagcgctcgtatcgaaagcagtcggcgaggctaaaggattgcaggctgctaaggacttcgatgtgatccatgaacttgggttggcagcaactggtcagcaggctttgattgaccaaaaggatcgcatccatgaactagcaactgacatgttcaagaccacgcgcaatgctttctacattggccgtggcgatgattactatgccagcatggaagcagcattgaaactcaaggaaatcagttatgttcaggcagaaggctttgcagctggtgaattgaagcatggtacgattgctttgattgaaaagaatacgccagtggttgcaatcatttctgatccggttacagcagcgcgcactcgcagcaatgcggacgaggtgcaagctcgcggtgccaaggtgcttcatatcgcaatggctagtcaagcccaagatggtgaccaaatcgttgtcgatgaaatcaatccattacttgcaccgcttttgacgattatcccggcacagctcttggcttactttactagtgcggatcgtggttacgatgttgaccgtccgcgtaatctggctaagtcagtgaccgttgaataatcgctaagaatttcatttagtgatcggtgtcattcatgtcaagatgtggattcaatccccagcttggtgtctgacgtcgtagcggatcgtgatccatgtatataaaaaagtgttgcatcacgggtatcctcgtgatgcaacacttttttaataagcacaaattaagtatttgtgcgctaagtgacacgctgcaaatcgggaagaactttatttcaagtaaccttcactcaaagtcataaactgttgcgcatctttggcggctaaatcaatgccttgctgccagaaatccggttgcgttaagtcaaccccgagatgttttttcgctagtgcttctgttgtcatattcgccgtatcccgcaacaaagcaatgtaatcatcttcaaaattatcagatgcttgggcctttgcgtaaataccgctagagaacagataaccaaaagtgtaagggaagttgtagaacggtgggttgtcgaagtagaaatgcagcttgtctgcccaatacatgggatcaaaagaacttagaccacctgcataggcctgttgttgcgcagtcgtcataagctctttcagtcgtggcacactgacaattcctttttcccgttcctgatagaaactgtcttcaaacaggaagcgagcatggatatttaacagcatcgccaatggattggccattttagcgtctaacaaattaagtttctcagccggtgaggttgctgctttgactgtggcatctgcaacgattaattctgcaaaagttgatgcagtttcggcaacattcattgcataatcttgacgcagtagcggcatatctttcaaaatactgctgtggaaagcatggcccaattcgtgggcaatggtggaaacaccagatgctgaaccatcgaaggtcatgaaaatacgactttctttgacatctgggacgctggtcatgtaaccgccagcgcgcttgcctggccgatcctcagcttcgatccagccattttcaaatgcctgtttggcaaaggcagccattttaggtgagaacttggcaaagttgctcacaataaattcggcggcctcatcgaaggtataggtctttggctgaaagtcgcccacgatgactggcgcccattggtcataccatggcattgttggcttgccagttaattcggccttgcgcgtgaggtaagcagcaaaaggctgtttgttggcgctgatggtgtgccacatttgatccagcgtggcacgttgcatgcgattgtattgcaacggcttgaaaagataatccggataatgatgcaaccgataattcgtaagccggaagccggcaatgtgattcagggtctcaccaaacagactggcatgatcgtcccacgtttgttcccaaacgttaaagacttgttcacgcgttttagtgtcaggatcgccttcgaatttattctgggtttggccggcactaagctctgtggttttgccatcttgtgtgattggaaacttaagactgctgctcaaggtggtgtaatgatcgctccagccagtaaaaccatcaactgccagatcattaatcatcgtttcggtttgatcatctaacagttcctttgcctgatcgcgcatctcttgcaagccaaaacgactagcgcttaaagctgatgtggtcgttagctgatcgaaagctgcttgtgacatggctgcgagttttttggccagcgggttgttaatgttttgaaaacgggtataaagagtcgtgagctgaccttgaacaggtccggttttcagattagctgtatcagcgctggcaatcatctcgacgaagctgctagtagtagcgaggcctttgccaatgtcttctagcagttgccaaagtgtgatgaaatcggtaaactcaggagcatcgtggtcaggggcccaagcggctacttttgactccagttgaggcaatttggccgtcacatcgctaattcggtcggcaagttgcggtgagtcgataccaccggggaaaatcgaatcgaggttccatttaattggataagacatattggcacttcctttcgaaatagctttattataccgtagatgagaaaagtctgagtgaaagcaggtagaagtttgtgacgtcttttaaaaaatattgggggttgtggctggcggcagtccttttgtttgtcttgttctttagttccagtatgacttacaaagagcaaacaacggtgccgttattggaacgcttgttacacaatgaaccgtttaagcaagccttaagtggtattcattttaattatgcgggtgaacagcaatcaattgctgaggtaggctattttaaatttgttgaatttttcattcgcaaaggtgcgcatgtcagcatctttttcctactaggtcttggtctgacacaaggcacgtttatgtatcagaaaaatcgttggctgcattggccgctgatggtcttaagttgtaccggtgttgcggcatttgacgagtttcatcaaatgctgacaggcgggcggacaccgcttttccaagatgtgatgctcgatactgctgctgcggctgtggccgtgaccttaatgtggttatggttatggcggcagaagcgtcattgaataaagtgccgatctttgctataattttagcgattcatatgctcctaaacttacgaaaagagggtttatcatgtcaggacattccaaatggcataacattcagggccgtaaaaatgctcaggattcgaaacgtggtaaaattttccagaaattatcacgtgaattatacatggcagcaaagcaaggtggtcctgaccccagtggtaatccttcccttcgtttagtcatggacaaagctaaagctgccaatatgccaaaagacaatattaagcgtgctttagataaagcaagtgatcgtgatgcggccaactatgacgaagtgacctatgaaggctatgggccaggtggtgtggcgattttggttgaagctttgaccgataatcgcaaccggacttccagtaccgtacgagtggcaatcacccgacacggtgggaacatggcagctgctggtgcggtttcatacatgtttgatcgaaaaggttatctggtgattagccgtgacgaccttgatgttgacgaagatcagatgctagaagatgcgcttgaagccggtgcagaagatatgcagacttcagatgaggcatttgaaatctacaccgatcctaaagaatttgctcaggttcgcgacgcgcttgaggaaaaagggtacaagtttgtccaaaatgaactgacaatggttccgcaaaacttgaccccgattccagaagataaagttgaacaattccaagctatgattgatcaattggaagacgacgatgatgtgcaggaagtttacacagccggcgactggccagacgattaatgcattgattgatagctagtgatcaagacgagggaaaatcctcgtcttttttttgcccaaaatagtaaagaggacggggtgatatatgacgctcgcgaactcttttaatacagggggaaaaacgatgcaatcggtgaatgagcttttgacaattgcgctggaaaagggtgctagcgatatttactatttgcctagtccgcaaggttatttgattcgcctatgggtaccgacgggcttggtaacaatcgccgagcgagacagcaaacgtgggcagcaagaaattaattacttgaaatttatggcgggcatgaatgttgccgaacatcgccgcgttcaattgggagccttttatcaaaaggaatcagcagcttttttacggttaagttcagtggctgactttcgcggtggtgaatcactggtagttcgcataatcaaaggcattccagatgctgcaggcgcgcgtcatctgttagatcgtctgttgggtattttactgcagaaacgcggcatgctgaccctagctgggccgactgggtcaggaaaaacgacattactctatcagttagcgacgcgtttggcggaatcacgaatggtcttgtcgatcgaggatccagttgagatcaatcagccgcaattcatacagttgcaagtcaatccggaggcagacatgacctatccgcaattactgaaggcggcgctgcgccatcgaccagacgtcttgctgattggagaaattcgtgatcgacaaacagcgcaaagtgcttgcgaagcggcgattagcggtcacattgtcctagcgaccgtgcatgcccgatcagcggcggatacacccttaaggctgagcagttttggcttgtcggatgagttagtagcggcggcattgacggcgagtgcggcgatcagtttgcagtatcggccaatgattcacccggtggcggaagtcgtggttttcaagcaagtaggacaagctgatcaggaggtggtttcgtgagcatgccgctggtgattcaggaacggttttgccgtcaaagcgctgcgttaattgctgctggttttagtttgccggatgtgtttgcttatttgcgtgtgagtttaccgaaataccggccaatttgggaacgaatcgaaacggatttggcttctggcatcggattgccagaagcagttggccatcaggcattagctcccatcctctttcaacaactgcaactagcacaggttcacggggatttggcaaaagcattggccgtggcgggtgattacttaggcttgcgagtgcggaatcgtcaacggattggtcaactattaatttacccacttgtgttactgggcatgcttgttaccttgcaagtggtcgttgtgtttggcgtgttgccagccttggcgttaccacaatcgcatttagtgcatacgcagttaatgaccatgggtgggggcttagccgctgggttgctaatatggcttggttggcatcgactgacgttggctcaacgcttgcaactcttacaacgattgcctggtgtccgtggcgtcatgcaagtgtactatcagtttcagttcacagccggagccgcccacttcttactggcaggtgctgagattgccgacttttgccgacacttgataaccgttggcggtccgttgggtgatttaggagcacgcattcaacaaaagattcaacaaggggctgagttggccgatgcgttacacgaagcctttgtgccacctgaagttgcccgtttattgacaatgggccagacacatcacttagtggcaaccggcttaaaactttttggtgaacctcaatttttaagtcaagtgcaacgatgataacgaattcttgatagtggtctagcccgtattgtcaatctaagtgcaacagtttctagtccaatcctataagtggtacacagcttagagttccggcatcagttccgccgcactccggtagcccaagatacgacgaggccggctgttgagtgcgtcctggaagctctgaatatcaatgatgtcgtaatggtggagtgagcgacctttcggaataaactctcgtagaaggccgttctggttctcatttgttccgcgctcccatggtgagtacggatgagcaaagtagacatcagttccttctactgaatctagttgtgcgaactcactgccgttatcaaaggtgatggtggtgaagtattccacaccgtaatcatcaatgatggactgaagtcccaccttacaggtacttgctttgtagttagcgagcttgatgatgatttcgaagcgactcgtccgctctgtcaaaaccagcaacgcaggttcgctatcaacgcgcttacctttcactaaatctccttcccaatggcccccttgccgacggtcttgaacttcaatgggtctttcatcaatcgaggtaccaagcttcgtcttattggtgcgggtatgggaatggcttcgtttaattcgcaagctgggtttgcgcggtaagtcgtgggtccgtagttcgaatctaccggcctcaatatcccggtaaaccgttggtgttgaaggaacaacctcgtctgcgtgttcccgtttgaaggtgtgcacgaagctgtccacactgtgtacgcgtggacgttgcttgatggcagcggcacaggcggcgtagaactcggggttcttctcaagcatcgtcttggggcgacaccgttcccgccgctgagcgtgcagataagctgccgtatcagcaaagtaaatcaacgctaccttatgcccgggaactcgctgtagaacggagccacgagtgatctcacgcgaaatagtactacgagagcggttgagttcgcgggcaatccgtgcttgggagaatccctgattgagcagagtttcaatgcgaacgcgatcagaatttgatagttgttggtaagccttagagatggtacgcttgatgttggtcatgatgtgcctttcttatgtgcttggtcgcttataagaataggtcatcatggcctttttggtctatttaattatgtgttgcacttagattgtaaacgcggggtacacgacatcatgtgtattgactgcaagtccttttacgcatcagttgaggccattcgacgtggcattcacccgttggcagctgatattgccgtgcttagcaagggcgattctcctggcggcctggtgttagctgcgagtcccaactgcaagaaacgttaccatgttggcttgagcacgcgccgctttcaattgcgggacgacatgcagattgaactggccgaaccacggatggcggattacattcgcaagaattacgggattaatcgtatttatcgccaatttactgacgatgcccattggtacccttattccattgatgaatcctttattgacgttacccactcacacaatctcttcggctccaatcaagaaattgctacccaaatacagaagaaggtgtttgatcagtttggtattatcacgaccgttgggattggtcagaatcctctactggcaaaactggccctcgataacgaagccaagaaggccgctccgtggcaagccacttggacttacgaccgggttcccgaaaccatatggcaactacatgacttagccgatttctggtcaattggcagccgtaccgcaaaaatgcttaacgcaataggcattcacaacctctatgatctttcacacaccgatcggctgctattacatcaacgcttcggcgttctcggcgatgccttgtatttccattcatggggtattgattactcggatttgactcgtcgctatttgccacgcgctgagaacaaaggctatggcaatagccaggtacttatgcgtgattacacgcaggcaagggagattgaagtcgtgcttagcgagattgctgatcaggttgctggccgacttcgtcaccatcaagtacaaggtgaagtggttagcgttgggattggttatgctgatgcagaagaagcgggcacctccggtttcggtgcgcaaatgaagattgatcccacaaatcgcactgacgatttgatccgcgccgctcgctatctcttccatagtaaatggaacggccatgccgtcagaaatgtttccgttcgtgttaatcgcatcttcgagcccgcaaagcccgcggtctcgaagtcgcctaacaacatcagcgacaaagcccagtcgctgtgttgtttgcacggctgagccccatctggcctacgattgcttcgccttggcactacggtctttaaaatcgcagtaaaataatccacgagaaactaaaaaggaacaatttttcccacaacaatcggaaaattgttcctttttattcgtttgactgagaattatgtctcaagctcttgttgcccaagaatcgagccataggtttagattcggttcaagtaccgtttcaagaactcttttgtttcaggttgctgtggatcgccgaagatctgatccggtgtgcctgcttcggcaataacgccattgttcatgaagacgacccgatcggacacttcgcgcgcgaaggccatttcgtgggtcacaatgatcatggttaaaccagtatgtgccaaagcagtcatcgtgtttaagacatcatcgaccatttccggatcaagtgcactggttggttcgtcgaagagcaacacttctggatccatcgcctcagcccgcgcgatggcgacacgttgttcttgaccgccagataattggtccggttttgcagcgatgaatggatccatcccgacctgcttcaacaagtcgagggcgtgcgctttagctgtggcagcgtcgcgctttaaaaccgtttgttgcggaaccatcacattttgcaacaccgtcatgttgttgaatagattgaaactctggaagaccatcccaactttggcgcgataagtgcttagtttctcttcatcgcttaaaatactttttccgtggaaaaggatatccccgccagttggggtttccaaaaggttgatatttcgcaaaagtgttgatttcccagagccgctacggccaatgatcgaaacgacttcaccggcattcacgtccagattgatgttggtcaaaacttcgtgattgccaaaggccttttttaaatttttgacttggattaaaggttcgtttgccatggattagccctcctttgccgtacgagtttttggggtttcgacctgcatctggttggtcatgacgttgtaatcttttggcccgtcgagatgtttttcaattaatcggaataggcgactgattgtgaaggtcatgatgagatagatggcgctgacaatcagataggtgtggaagaattggaagctttgtccggcaatagtctcaccactgaagaacaattcggagacagagataacggacagaacggacgtatccttgatgttgacaataaattcgttggtcacagctggcagtgagttgcgcacggcttgaggcaaaatgaccttcatcatggtttgcagatgggtcattcccagagcgttggcagcctcgaattgaccttcgtcaaccgagataattccaccacggataatttcggaaatataggccccagtgttgatcgaaacaatcaataaggcagcggtggtccggtccatgttcaaatgccaagcttgtgcggcaccataatatagcaccgcggcctgaacaatcattggcgtgccacggaaaacttcgatgtacaacgacagcagccagttgatcacggcgcgtaagccgcgctgaccgagttttttcggcttaggagttgtccggataatcccgactaacaacccgatgataaagccgacgattgtgccaacaagggaaatcagtaaggtcatgcctgtcccgcgtaacagcattggaccatattgtttcataatcgcgatgaaccagttgccattgctttcagttgatggctggttatcgacagcttcattcatcagctgtgctcgttctttacttgaaatcgtggcaagtagttcattgatttttgctttattcggatcattcttgcgcaagccaatcgccagattcgtgtcactggcatcggttttaaaaccctgaccttttgcaaaatggatatacatcaagttaggattagcacgctctgccgtgatcccttcaggcacttcggaaacataaccatcaatggttccggattccaaggccacacgcatagctggaaaatcgttcatagccggttccttgacgacacccttgatttgattgatcgcctgataatgataggtgctgagctgggcggtgattttagcacccttaaaatccgcaatgctcttggctttggcatacttgctgtctttgcgaacaaccatcgtcaagttggagatgtagtagggattactgaaatcgatggtcttgcgacgatcaggtgtcggtgacatgccggcgatgatggcatcgattttgcctgaagttagagctggtggcaatccgtcccaagatgttttgacgacgactacctttttgtgtaaggctttggcaaccttacgtgcaatctgcacatcgtagccgttagcgtattcctggctaccttgaatcttgacggcgttattagcgctggtggtttgcgtccagttgaatggcgcatagccagcctccatgccgactttaaacgtgccgctatcactagcagcattgaccggggtggcagcaaaactgcctagtaagaagcttaaggcgaaccccagcacgcctaaacgtgcaacccaatgctttttcataactgacatttctcccttcttgtagtgggaaatagagctggaaacaaaaaatcgaccttattgtgttgtgataccgcaataaaggtcgattccatcgattttagtcataaaccagaatcatagcgccccgaagcgagtgcttcgacagtccatgggttatgcacccatggcccaatgcgcacgatccgaatatcgtgcaacatttcggcggtggcacttacaactggttcaacatgatacggcactccccagttttcgttgcccaccgcaacctctatttcttggtggtgtatttaaatgtcaaaattgagtttagcggagtcagggatggatgtcaatttataatggcaaagcgtgagcaagtgcagtttctacgtctgctcacacgttttagatggcacagtagaaggattcgctcttctgatgcttgttgggcacgcttcgatagtctgagctggttttgtgaaaattcggagtagcgaccgccaaggctaaggcgctggtatggccgcgtccattgaattttcgctactgcctgatgtctatcagaaaaatgcgtaaaaaattcttgggactagcacccatgtttaggcagcgtttaaaaacaaaaatattcaaatttgaggtgcaataagtagtaagatattttgaaaaaatggcaaaacgtgttaagtttgtctaataaagttctcataaaagggtcgggtgctgatgccagaagaacatgtcaaaatcgggtcatatttgcgggctttacgtctcgaggaaaatgattcattagaagaaattgcagctgggattacgacagctgcaactttgtcgcggtttgaacgtggggagacgcaactgagtgcggcagttgttttaaaattattaacacggtttgatcaagacgttgaatccatccaacaaggataccgcgccttgaatcaggataactttttccagcaggtgaaccgggcgactgttgctgggaaaccggcgctactggcactggctaagcgacagtatcggttatggcgggaaacggggcttattttttaccgacttaatcagattaacatcatggcgcacaacgggttcagtgacccgagttttcaaacaacaccagccatgaagactgacgttatgcgttacttaaaacgaattaagcactggggactttatgagctggatctttttgcggcgacgttggtgcttttcgacagtaaacagttggttagtttagtggcagggatgttactggatatgccaaaaaccgagagtcaccggacgcgcgatcaatatttgtgggcgattctcacgaatagcatagcgttactgatccatcggcgtgagtttagtgaagcagttcgcttgctaaccattgcgaccagtatgccagtgccgccggatgatctctattcccgattgatgcttcggtatcagcagcaattattggtgtaccatcgcggtaagcatcgagcagcaacggcagcggttgagcaactgttagccagtttgcggttattagagtcaccattttttgctcaattgttaacaactagttggcagcggtttcttaaggaggagggggctgcgagatgacgattggtagacaatttaagttattacgtagggaacggggactgactttaaaaatggccgcgcatgggattttatcggtgtcaagtttgtcaaagtttgagaatggtacctcgcagttagctgctgatcgtttctttttgttgttggatcagttgaatttagattgggatgtgtttgcaaaacctcgttctagggataagcaaccttttttacaacgttatttggcggctgtgcgtcacgctgacgttcaggaattggccagcattttgcgtcaattgccactcgccaatgttaatcaacgcctgttgttgcatttgaccttacataatgacgcgccggaacgcttttcaattttaccgcatgagcaatcacaagcgcagtcattgctgatgacgacggctgactggtcgttactattacgactgattgctgtccaattggctaaaattattgacctggatgagctgagtcaactgatagctgctttttcaaatcagatacaacgtcctaacacgccgcaggatcattttaatcttgctaaccgcatgtttctagcggctgtgcttcgctatgtggcagcgggtaaattgactgaggcacgaaatgctttgaatcttatcgggcaagcaactgttggtgatctaggcattgagtttcagattgcttgtgtgaaacgattacttatgatttattcatccgacaaagtggtggcgttacaaggacggcaagagtttttgcaattaaaaaaaatgctggcgcaattgggggcaccagcatggacggcgacgtggcttcctacaattgaacggcttgcagcagcaaaagggtgtagccaagaagcttaaaggtccgcgccagcaatcatgcaggcaaaaatcggtactgagaaaagacactttccagtaccgatttttgacgccattagtgagaagattgccagaagcgtgtcttacaaatgctcaaaagttccacgtgaaacttcaactgccgataaataagtttaaaggaagaaagcacttttttccggattgttgacattttgatgaataaattctaatgaataacgcagctgttgttcttgtttaggctgatcaaggatgtgtgccaagctaatagcctgatggcacaactcccagccaatttcaggctgaccggcaatgacgtgataccaaccgcgtaaaaaaagtaacatagcggcgttggtcaaatcgtcactgtcatggaataaagtcttggcagtatcgagcgcttttttcgcatcggtgagctgccgatcattaataaaaacggagaaggccgcaaaaagtgtcctgattcgaatattgcgaatctggttaaaagcacgatacttttccgagcgtttgatggcaagtggcagttagttttgaatcgtggctgtcggtaaagcgaccataagatggcgaaaccaatagagttcaaagtagttccatatttcgaccgaataaagataactcacgactggctttgccaaagcctgaagctgggccatagcgtcagcgacacttttgaatggagatggttggtttaattgtttaacccgatcaatcatggttagccgaaaaagttgaatgctgatcagctcgaagcgggtttggcggttgtggtcttgggcataacgagcttgccattcctgctccttttttaggaaataagcatagtctgctggtgtcggttcctgagttgaaaagcgatcctgatagtcaagcacttcgacaaaggcgcgatgcgttaaggtgttgtacacaaaattaggatcattcgatgtcggcacaacgccggattgaagatcacggataaaaacaaattcttcgacagagatattaatgcgatacagcaaatgggttaaacgcgaaaagctgatattagacttgccttgctcaaatttactgataaaagcaatcgaattatggtcgtctgccacttgcgctaaggttagctgatgattatgtcgcaactgccgaaaaaccgcaccatctgtggcctttattttttctaccatagtggaatttcacctcaatccgattttaccctgcgtacactctagatacaaataagcagagcgtgaactggcgcgtttagaaaccggagcataagcgggcgcaaccttaaatggcagggttttggccatttaagattgcggcccttatgagcaggtttccgcggcagtgaacgcgttttgaaaactcataggcgtgtctagaaaccagtaagcacctttaggaggaagattgagatgcatgaatatcttaccaatcgcgggtatcgtgcgattttaaatgccagtttgttaagtggtattggtgatagcctctataatattgtgttcatcatttatgccgcaactatgccattcaaaagtctggcggtgacgttagccgccatggcaaccagcgtgccgaccatgctgtcgcttttaactgggagtctggcagatcggacacatgctaaaactcggcacattgtggcaacccgtctgggacaaatgttgttgttcctaagtttagcggtcatgattttactaccggccagttttccgctatttctatcattacttttaatcaatattgtttccgattcgttaggtcagtacggcaatggtttgacgctgccgctcttgcatcgcttgattccggcaaaagagcttaatactgctttaagtttccaaagtgcaacgagttcaaccgtgcaactggtttttcaagagcttggagccagtttgatcgtgttattgaatcacaattacgcactttttggcttgctcaatgcgttgacctttttactagccgctgtgacgcttgtcttccgaaaaaagcaattgaagcaagcagaaccgccagtgacaacgggcaagtcacagccagttatcggcaacatccgggcagttcttaagtttcttgctggcaatcaattcctattcgcggttattctcttcgcgatgttagtcaatacgcttggctcatccgttgacgggttgatgaatatcacgcttgtgcaggagccagacctatggctgcgcgactttggaaccaccgttgcaatcatcaatgttgtgttttttgtcggccttatctttggagctttatttgccaaggatggtttgcagcgtttgagcacgttcaaattgctaagtctgctgatggcggccatagtggggttaagcagcagttttttcctgctccattcgagcgtggcggcactggggttcagctttgtgacagcatatctgatgggcaaaatcaatccacgtttagccaccgtgatgatgcggcaagtgcctgaacagcagatgggtacgacagcaggggtggtcaacctggcagcattgatcggcatgccagtaggacaagtgattttcttcacgattgcgaaccttgctagtgctcatgttagttggatcgttatggcagggttggcgacaggattatttttggttttgatttggatgagcactaaaattttggacccagtctttaccgattccgatcaatattcgcaaaaggcttaatccaacataggcaaaattggtacttaccaatagaccaattcagcgaaatcgcttttcagaagtgcatagagaatgtatgcgcttctttttatgcacccttttcaagtgaaaatgcttgcatagctgtgcgaaagacgtcatactattctattgggaagccttgttttttagattattttcgtttattgcagatattattttcaaggcaaccacaaatttttaggaggcgtaaaaatggtcggaattattcttgctagtcacggccaattcgctgctggcatcaagcaatccggtcaaatgatcttcggtgagcaagaaaaagtcgaagccgtgaccttcatgcccgatgaaggtccagatgacttacacaagcacctcgaagatgcgatcgctaagttcgacccagacgatgaagtgcttttcttgatcgacttatggggcggctcaccatttaaccaagcgaactcgatttatgaggcgcataaggataaatgggcaatcgtgaccggactgaatttaccgatgctgattgaagcgtatggttcacgactttcgatggattctgcacaggatattgcagcacatctgctcgatgctggacgtgaaggtatcaagatcaagccagaatcactggacaaagtgacgaagccagctgcccaagcagcaccaactacttcgaatgctggtcagccaggctcacttgagtatgttctggcgcgggttgattctcggttgctacatggtcaggttgccacaacctggaccaagacaaccaacccgacacgcatcattgttgtctctgattcagttgctaaagacgacttgcgaaagaatctgattaaggaagctgcaccagcgggcgttaaggcgcatgttattcctatcgatcagatgattaagatcgctaaagacgataagcatttcggcggggaacgtgcattgctattatttgaaacacctgaggatgcacttcgagcaatcgaaggcggcgttccactcaaggaacttaacattggttccatgtcccattcagttggtaaggttcagccgaacaaggtgttggcctttgatcaaaaagatatcgatactttccatcaattagagaaagacggtatcaaatttgatgttcgaaaggtgcctgcagaccatcccgagaacatggatgcaattttgaagaaagctcaagaagaattgaatgcacagaagtaattttttttaatggaggaagaagacttatgactttaaactttattcaagtcattctggtcctcatcgtgtcattccttgctggtatggaaggtattttggatgaatttcatttccatcagccagttatcgcgtgcacgttgatcggacttgtgaccggcaatttggcaccttgcttgattctaggcggccaattggaaatgattgccttaggttgggccaacattggcgctgctgtcgcacctgatgccgctttggcatctgttgcatctgctattattctggttcttggcggtcagggcacaaaaggtatcagttcagcgatcgcgattgcggttccactggctgttgccggtttgttgctgaccactttggtacgtaccttggcaaccgcgattgttcactttatggatgcagctgctgaagaaggcagtttccggaagattgatatgtggcaatggattgcgatctgcatgcaaggcctgcgtattgccattccagctggcttgattctagccgttggtgctggtcctgttcgggcattgcttgaaagaatgcctgactggttgaccgctggccttggcattggcgggggcatggttgttgccgttgggtatgccatggttattaacatgatggcgacccgtgaagtatggccattctttgcgcttggttttgttttggcaacagttaaagagattaccctgatcggccttggtgccatcgggatctctctggcgttgatttacttggctctgtccaaaatgggcggcggctcaagcaaaggcggcagctcgaatagtggtgccggtgatcctgtcggcgacatcattgacaactactaagaaggaggttgacaaacatggctgaagaagttcatttaactaaaagcgaccgaatcaaggtttggtggcggtcaaccttcattcaaggttcttggaactacgaacgtatgcagaacggtggctgggcttataccctgattccggcactgaaacgtttgtatcataccaaggaagaccgttccgctgctttgaaacggcatctagaattctttaacacgcatccatatctggcatcaccaattattggtgttaccatggcactggaagaagaacgtgccaatggggcgccaattgatgacaaggcgattcagggtgtcaaagttgggatgatgggtccgctggctggtgtcggcgatccagtgttctggttcacggttaagccaattattggtgctttagctgcatcattggcaatggctggtaacatcatgggaccaatcttgtacttcgtgctttggaatgcaattcgtatggctttcctgtggtacacgcaggaatttggctacaaagctgggagcaagattaccgaagacctttccggtggtctgttgcaagaagttacgaagggtgccacgattcttgggatgtttatcttagggtcgttggttaaccgttgggtttctgtcaaattcacaccagtcgtatcagacgtacctaaccaaaagggtgcttacatcgactggagttcactaccaagtggatccaagggtattcagaaggctttggaattacaatctcaaggtctgtcactgaccaagaataaggtcttaacgctgcaagataacttggatagcttgattcctggtttgatgggcttactgctgaccttgttctgcatgtggttactgaagaagaaggtttctccaattgtgattatccttggcctgttcgttgtcggggttgtcttccacgttgtcggcttgatgtaatatcaaccgttaaaacgaacaaagaatcacggaagctcaggcgcaaagtctgggcttttgttttataatggagagcgtgaacaggagatttctgcaactgtaatcgcgtttggagaacagaccgagtcgtctccatcagtaaaaaatcgttcaagatgagtttaaaaggatggcggaaaatggttcaatcgatcaacacgaagtccgaattagtggtcgaaggcacggccttcatggggatgccgacatatggcaagatcatgatcggcgataaagggtttgaatttttcaacgaaaaaaacgtgcgcgatttctatcagatcccgtggaatgagattgatttggtcattgcgtcggtgatctttaaaggcaaatggattccacggtttgcaatcaaaacgaagaaaaatgggacatataccttcgcggcaagagatccgaaacgcgttttgcgcgccatcagaaatcatttcccggcagataaaattgtacaatcactgacgttttggcaggttatcaaacgggcgtttagacgcaaaaagtgagtggtgtctgctcaccatccgtttttcgataataaaaagaagcagctcgtttccacatgtgtgacatgctggaagcgggctgctttttggattgtgcgaagtctgtagcctagaacaatgcgcgattattcagtacggaattttttgaacaactcgtcaatagatgcatattcagcatcgcgtaaattgacgtctaaagctttagcattgcttgtagcttgttcaggtaggcgggcaccgggaatcacaaccgcaatggccggattcttcatgtaccaagccaagaaaacctgagccaaggttgcctgatgggcatcagcgatgccatcgacttctcgcaaagcggcaagaatggtcttgaactgatctgccgagaaacgtcgactaaacttgtcagcatcatcaaggccatacttaccagttaacaagccagatgcgagtggaaagtatgggacgaaactgatctggtgttcattcaaatacgggaacaggttttgctcagcatcgcgatgtaccaaactgtaattgtcttcaacgacatcaacctgattgtcttggttggcctctttgatttggtctaatgagaagttagaaacgccgatcgcccgaaccttgccggccttgcgggcattggcaatggcattgaccgcctccgctttgtcagttttgtcatcaggaaaatgaatatagaaaatatcaaggtaatcggttttaaggcgtaacaaagcatcatcaattgcctgcgttaaaaatttgggatcgttatttggtttgagatcattgtgcggatcctgtgctgccttggttgctagaataattttgctgcgatcatagccttgtgtggcttcaccgattaatttttccgactgccctaaaccatacatataagcggtatcgagcatgtcaatgccgtggtcaagcgcggctttcacgacggcgatgccatcttcgtcatgcagattagggaacaagttgtggccgccgactttattggtgcctaaacctagtttcccggttgtgaccgtacttttaccaattgtcgttgtcattgccattttgtgacctccttagccattcatgcttagtgtaaaaaaagtaatagaaacttgcaagcgctatctattcgcctttgatggaaaaatccgatggttcgcattgatgatcagccctgccacaaacatcagcagcgtgagcccgactgtcagccacaacaataaatcccacgaacctgtagccgtttggatgaagccatataatactggaccaaccgccgcaaataagtagtggctgttgaactaggccaccatatcttcgacccttgtagtaaatttatataaatttactacaagggtcgaagatatggtggcctagttcaacagccactagttacaacccgtgaatctgctatttgagaacggctcaccacttctttgattggaactaaagtcggggggatgctgatcttaaagggtatgaattcaagaatagagccatgagagctggcggagcggcgagggggctcagccgtgatattgttcttaaacgggtggttttcccgttttagaacaaggccagactttgaaatcgtgcgggctttgcgcgagttcaaagctgtgcccacagctctagcttcgcggtcgccagcccccctcgccgcgtagccaactcggacaattgagaacacgcgactcaaatagaactaatacaaatctttgagtttgtcgcgcgagtcactccgccctttctttttctcttgacactcagccgcaaaggatagtacactatcaaaggtgcttttttccagtttattcgggttgcccggacgtgctgactgggttaagagccgttgccgttcggttggccatttttttatcagaaaaaatgaaccgcctggatgtgtggacttataaaatgatgtaaattaaggaaggagaagcttaatgcctactattaatcaattagttcgccaaggtcgtaaatcaatttcaaccaagtcagactctcctgcgttgaacttcggttacaacagcaagaagaagagccttaccaataacccagcaccgcaaaaacgtggggtggcaactcgtgtcggtaccatgacaccgaagaagccaaactccgcattgcggaaatatgcccgtgttcgtctgtctaacttaattgaagtgacagcttacattccgggtattggccataacttgcaagaacatagtgttgtcttgatccgtggcggccgtgttaaggacttgccaggggttcgttatcacattgttcgtggtgcgcttgatacggctggtgttgacggccggatgcagggtcgctccaagtacggtgcaaagcgccctaagaagaagtaattcacgatcaacattaaagatcgctattaaaaatttttagatccgctatgtgcggtatagacagagcgtgagctggcgcggtagaaaccggagcataagtgggcttgggcgtgatggtcggtttttgaccattgcgaccaaggtccttatgtgcaggtttttgcgtcagcgagcgcgtttaagaggaggcaaagtgcatgccacgtaaaggcagtgtcgcaaaacgtgatgttttacctgatccagtttacaattcaaagctggtaactcgcttgatcaaccacttaatgattgatggtaagcgcgggaaggcatcaactattttatatgatgcatttgatatgattaagaaacaaaccgggaacgaaccattggacgtttttgaagaagcaatgaaaaacgttatgccggtcttggaagttaaagctcgccgtatcggtggttctaactatcaagtgccgatcgaagttcgtccggatcgtcggaccaccttgggcctacggtggatcgttcagtattcccgtcaacgcggtgaacatacgatggacgaacgcttggctaaagaaatcatggacgccgctaacaacaccggtgccgcagtgaagaagcgtgaagatacccataagatggcagatgccaaccgggcatttgcacattatcgttggtaagatgatttggctattatatccgcggcttggtatatagtagccattctttgtataaagccagttgaaacaagagaggagcaatacgccacatggccaacaaacgtgaatttccgttagaccgtacccgtaatatcgggatcatggctcacatcgatgccggtaaaacgaccacgactgaacggattttgtattataccggtaaaattcataaaatcggtgaaactcatgaaggagcttcacagatggactggatgccacaggaacaggaacgtgggatcaccatcaccagtgctgctactacggctttctggaaggatcaccgggtcaatatcattgacaccccaggacacgtggacttcacgattgaagttgaacgttccctgcgtgtgctggatggtgcgatcaccgttttggatgcccaatccggtgttgagccgcagaccgaaaacgtttggcgtcaagcaacgacatacggcgttccgcggttggttttcgtcaacaaaatggataagatcggtgccgacttcgattattcgatgacgacattgcatgatcggcttcaggctaacgctcacgccgttcagatgccgatcggtgccgaagataagttcgaaggggtcattgacctgatcgaaatgaaggccgatttgtatgacgaagatgaattgggtaccaagtgggacactgtagatgttccggatgactacaaggaagctgctcaaaaagcgcataacgacttgatcgaagccgttgctgacgttgacgacggcatcatggacaagtaccttgaaggtgaagagatttccaatgctgaattgaaggctgcgatccgtaaagcaaccatcaacttggaattctacccagttttggctggttctgctttcaagaacaaaggtgttcagatgttgttggatgctgtgatcgattacttgccatcaccacttgatgttcggccatatcatgcgaccgatcctgacactggtgatgcagttgaattgaccgctggcgacgacaagccgtttgctgccttggccttcaaggttgcgactgacccgttcgttggccgtctaacctacatccgggtttatagtgggacgcttgaagccggttcttacgtgctgaacgcaactaaagataaccgcgaacgtgttggtcgtctgttgcaaatgcacagtaatcaccgtgaagaaatccctgaagttttctctggtgatatcgcagctgctatcggtctcaagaacaccactactggtgattccttgactgatgttgaccacccgctgattcttgaatctctggatgtgcctgatccggttatccaagtttccatcgaacctgactctaaagaagaccaagataagctggatgtcggcttacaaaagctttctgaagaagatccaacattcaaagctgaaaccaaccctgaaactggcgaaacattaatcgccggcatgggcgaattgcatttggacatcatggttgatcgtctgaagcgtgaattcaaggttgctgctaaggttggtgaaccacaagttgcttatcgcgaaaccttcactaaagaaacttccgcgcaaggtaagttcgttcgtcagtctggtggtaaaggtcagtatggtgatgtttggattgaattcagtccaaacgaagaaggcaaaggctttgaatttgaaaatgccattgtcggtggtgttgttcctcgtgaatacatcccagctgttgagcaaggtctgaaggaagccatggccaatggtgtcctcgccggttatccattaatcgacgttaaggctaagctttatgatggttcttaccatgaagtcgattcttctgaagctgcctttaaagtggctgcttctatggcgttgaagaatgcctcgaagagtgccggcgcggttatccttgaaccgatcatgcacgttgaagtggttgcccctgaagaatatcttggcgatgttatgggacaaatcacggctcgtcgtggtcgcgttgaagggatggaagcccgcgggaatgcccaattggttaactccatggtgccgcttgccgaaatgttcggttatgcaaccaccttgcgtagtgctacccaaggccgtggtacgtttaccatgacctttgaccactacgaagctgttccaaagagcattcaagcagaaatcatcaagaaaaatggcggcggcgtcgcaaccaaagactagtctttgattgttaccagctgcatgaacgacgatgcctaaaaggcatcgtcgtttttttctaaaagtgcgccagaagtcaaaatccggaaataagcatgaaaatcgtgaacctgattgctgggcttgggaaaagattatagtatactgatgttattctataagcgttagggggcgaagcagcgtgtcgagtcaggagcgtattacgaccattttattgcgcttgctgcgaggcgatcaactcaataagcaagcgctcatgacggaattcaataaggatgaatcatcgattcgccgcgatattagcgtcatcaaacgtgcctttgacgatgtgttcagtgaaccggcaccatttattgctgcaagttctggggattatcgactcaagccaaacctgcacgccgctggccgcagtctggacgacgggcaactgttggcgattgccttgatactgacggctagccgcggcttgtcgtccgtagaaatgaagcaactaatggcacaattattaccagccggacccgagcacaaaggattggatcggcttaccaaaaatccagtttttgagtatcgtggtgtccccaaaatatcgttgactaatcggttggcccgattgagccaagctatcgttaatcacgaactgatcagctttgatcacgtgtatcacggcgaactgcggcactttgaccggcgactgccaaccggcttgttttttggcgatctcttcttctatcttattgttgatggcagcgatgaacaggcggatgatgatccagacgagggcaaattcgtccgatttcggctcgactatatgcgcaacattacctatcatcgtcagcagccaacccatgatcatgatgagcgattccgcggtggacgcttacagaaccacacgtggtatccgtatctaggcaaaccgatcaatttggaaattctctacagttatgatccgcagtttgtccttgatcgctttcccgaggccattgttgattggaaaaatgtccgtgatcggccgtttattaagaatccatacgcaagaaaggtttatcacattacgattccggttaacgatggttttggcgtccggatgtggctccaagggcaaggggatctcgtaaaagtcctggctcccaaacatattcgtgattatgtggtttgggtcttgcgtaaaagtttgaagaattatcaaaacgaagatgatactggcaagtatttatagcagttgtgcagccgggtttgcgaatgaatgcagactcggttttttgctgagtgcgaactaacccgatttctgggaaggcaagcgcatgatgacggcgtgatgtgaacacatattctcgtatgccttattataggagatcggcatcattaaacaggtaaaggtggccaaagttgactgccgacaaaaaggcagaatttttttggcaatgcttgataattgcataaggaaaaggtacggtgaatatgtaaataataatcattctaaaaatggaggtaatatcaagagctatattggccaacatttaccggcgtttaagttgaacgcctatcaacatggcgatttccatgaagtcagtgatactgatcttaagggcaagtgggcagtgatttgtttctaccctgcggatttttctttcgtttgcccgacagaacttggcgacttgcaagatcactatgaacggttccaagctgttggagctgaagtctattctgcttctgaggataccgagtttgtacatatggcatgggctgaggcgagtcccaccattaagaagattcaatacccaatgcttgccgatcctgcaggtaaactggcaacggcgttggatgttcgtgacgaagctagcggtcaagccttccgtgggacttttatcattgatcccgatggtgtgattcaggcctatgccgtcaataactttggcattggccgtaatgccgatgagattctacggactttgcaagcggcacaattcgttgctgctcacggcgatcaggtttgcccagctaactggcaaccgggcgctaagacactgacaccaggggcagacttggttggcaagatttaaaacggtgctttgatcagctaacagtcaatatatcagcccttggctaatcagcgacgcacgcaaaaaaggaaccgcaatgattttcgctgcggttcctttttgtgtgtataaattaatatagaagaaacgagaaaaaacgagaaaaaacaaagttaaaagtgttggtcaatatcaacgtttttaccatcctgcgactgtttgaaatcgccactgacaaacgaaaacaccgtgagtacaccagctaataccaaaatggccaaggttaaaagcagggtttcagtcccgcggtcatgcagcacgagcagttggcgtaagatggcggtcattgaaattaaaataaggtagcggataggaatgtgatgaccttcctcaatgtagcgaaccagcatgatcacaaattcaaagagcatgaagaagctggtaacttcctgaatgactttgccaaacaaagcagtcgaaagtggttgaaggatcagactaccgatatcgagaatgtagcgtagcataaaaattaccacgacaatggctaaaaaaccgagtagaatatctaaagttgagttgacgagctttttgtaatggtcaaatttcatcaactgcctcccttctttctatggttattcaaaagttaaggctttaatttgaatttagcacaagcagctgttcaaaggaataagtttgcttctgacatattttttgtaaaccgaaagaaaaccttgtaatggcgggggagattttgtatactatcaagagtgctgtttctcaaaggggacaactatgcacttggttccaaaggtgaaccagagtagcgcggatgtgagaggttgcgacacgcccggccgctttgccacggcagcgtgttggtaattttcacggagctagtctactaactgataatagacgaaggaggtcacacaatggcaaaacaaaagattcggatccggcttaaggcttatgaacaccggattctcgatcaatccgcagacaagatcgtggaaactgcaaagcgcacaggcgcaacaatttcaggcccgatccctctgccaacggaacgtacactttacacggttctacgttccccgcataagtacaaggattcacgtgaacaattcgaaatgcggacgcataaacgtctgatcgatattgttaacccaacaccgaagacagttgatgctttgatgaagctcgacttgccaagcggcgtcgatatcgaaattaaattataattcttagaaaataggaggtgtacccatggcacgtaaaggaatcttaggcaaaaaagttggcatgacgcaggtcttcaccgataacggcgaactcgtacccgttactgttgtcgacgtaactccaaacgttgtaatgcaggtcaagaccgttgaatctgacggttacgaagcagtacagctgggctacggcgatatgcgtgaagtcttgacgaataagccaagtgtcggtcacgccaaaaaggcagacacgacccctaagcgcttcgttcgcgaaatccgcgatgtagcgcttagtgattatgaaatcggcagtgaagttaaggctgacgaattcgcagcaggcgacattgtggacgtcactggtacttccaagggtcacggttatcaaggtaacattaagaaggatggccaatcccgcggtcctatggcgcacggttctcgttaccatcgtcgtccaggttcacttggggccatcattaacaaggtcttcaagggcaagaaattacctggtcggatgggtaaccacacccgcaccatgcaaaacctgcaagtcgttgccgctgacacagagcacaatgttctgttgatcaaaggtaatgtcccaggggcaaacaagtcctttgttacgatccgttctgctgttaaagcagctaaataatacgaagggaggacaataactaatggctaacgttactttatataagcaagatggctcagaaaacggcaaagttgaactcaacgatgccatctgggcagtcgaaccaaatgaaaacgtcgtgtttgacgcagtcgtgatgcagcgcgcttcccttcgtcaaggtactcacgccgttaaaaaccgttctgctgtttctggcggcggtcgcaagccttggcgccaaaagggtactggtcgtgcccgccaaggttcaatccgcagcccgcaatggcgtggcggtgggatcgtcttcggaccgaccccacgcagctatgcatacaagctgccaaagaaggttcgtcgtttggcaatcaaatccgtactttcacagaaggttctcgatagcgacttggtcgttgttgacggtttgaacttcgatgcacctaagacaaaagcttttgcaactgtcttggatggcttgaaggtcagcgacaaggcactggttgtgttggaagacggcaatgaagttgctgccaaagccgcacgtaacctgccgaacgtgaaagttgttcctgcagagggtatcaacgttttggacgttgttgactacaagaaattaatcttgacccaatctgcgctccaaaagattgaggaggtgcttgcataatggaagcacgcgatatcattttacgtccgatcgtcaccgagcaatcgatggctgaaatggataaccgtaaatacacattcgaagttgcactgcatgcaaccaagccgcaagttcgcaaggctgttgaagaaatcttcggtgtgaaggttgtcaacgtcaacatcgcgaacgttcgcggtaagaagaagcgtcaaggccgttacgaaggcatgacgcgtcgtcgtcgcaaggcattgattgccttgagcgccgattccaaagaaatcaagatcttcgctgacgaagataacgataaaaagtaacaaaaatccgttataggaggtaaaacacgtggcgattattaagtacaaaccaacaagcaacggccggcgcaacatgtccgggtctgattttgctgaaatcaccaagacaaagcctgaaaagactttgctggtcagccaaagtcatactgcaggacgtaatgcccatggtcacatcaccgtgcgtcatcgtggcggcggtcacaagcaattctaccgtgtgatcgacttcaaacgtaataaggatggcatggctgcaacagttaaagcaatcgaatacgatccaaatcggaccgcaaacattgcactgctgcattatgaagatggggttaagtcttacatcttggcacctaagggtctcaaggttggcgacaaggtttattctggtgaagatgtcgatatcaaagtcggcaactcattgcaattgaagaatattcctgccgggacaactatccataacatcgaactgaagccaggtaagggcgcgcaattagcacgttcagctggtgtttcagcccaattgttgggtaaagataatgataagtacgttaccgttaagttagcttcaggcgaagttcgtctgattttggctgaaaaccgtgccacaattggtgccgttggtaacgagcaacatgagctgatcagtattggtaaagctggccgcaagcgctggttgggcttccgtccgacagttcgtgggtcagttatgaaccctaacgatcacccgcatggtggtggtgaaggtaaagcaccaatcggccatccatctccaatgtcaccatggggcaagaagaccttgggtaagaagacccgggatcacaaggctaagtctgagaaattcatcgttcgtcaccgcagagcgaagtaaacacattgaagtgttacatcgattaaaggaggtcacaaaatgggtcgcagtcttaaaaaaggaccttttgccgacgctcatctcctgaagaagattgaagcgcaggcagataacgacaagaagaccgttattcgtacatggtcccgtcgttccaccatttttccaagtttcattggctacaccatcgccgtatatgatggtcgtaagcatgtcccagttttcgtgagtgaagacatggttggtcacaagttgggcgaattcgttcctacgcgtaccttccgcggtcataacaccgacgacaagaagacaacagcacgctagaaaggagcacaacattcatggctgatcaaattacgtctgcaacggcaacggccaagacagttcggattgctgctcgcaaagcgcgcctggtaatcgacttgattcgcggtcgcgatgttgctgaagcattggcaatcttagaattcacccctcgatccggttcaccgatcatcgagaaggtactcaagtctgccatcgctaatgcagaacataactatgacttagatgcacaaaacctttatgtaagcaaggcttacgtcaacgaaggcccgaccctcaagcggttccgtcctcgtgccaaggggagcgcatcaccaatcaacaaacggacaagccacgttaccgtggttgtatccgaaaaagaagcataaggagggataacgcgtgggtcaaaagattaatccaaccggtttccgtgtcggtgtcatccgtgactgggatgccaaatggtatgcagacaaagactttgcagcctttctgcatgaagacattgaaatccgaaacttcattaacaagaagctgcaagatgcttccgtatcacgtatcgaaatcgaacgtgccgcaaagcgcgtcaacatttccattcatactgctaagccgggtatggttatcggtaaaggcggttctgaagttgaaaacttgcgtaagcagctgaacaagctgactggccgccaagttcacatcaacatcgtggaaattaagaaacctgatctggatgccaagcttgttggcgaaaacatcgcccgtcagcttgaacaacggatcgctttccgtcgtgcaatgcgtcaagcaatgcaacggaccatgcgagcaggtgccaaggggatcaaaacccaagcttccggtcgtttgaatggtgcggatattgcacgtcgcgaacattacaatgaaggcttagtaccattgcataccttgcgtgccgatatcgactacgcatgggaagaagccgcaacaacttatggccgtatcgggatcaaaacatggatcaatcgtggtgagattttacctgaaaagccaaagcaaaatagtgtgaaaggagggaaataatcaatgttagtacctaagcgtgtaaagcatcgtcgcgaattccgtgggaagatgcgcggtgcagctaaaggcggccgtaacgtcgacttcggtgaatatggtttggaagcattggaatcccactggatcaccaaccgtcagatcgaagctgctcgtgtcgcaatgacccgttatatgaagcgtggtgggaaagtatggatccgcattttccctcataagtcctacaccagtaaaggtgttggcgtccggatgggtaatggtaaaggtgcaccaactggatgggttgctgtcgttaaacgtgaaaagatcatgtttgaagtcggtggcgtttccgaagcagtcgcaaaggaagctttgcgtttggcatccaacaaactcccgatccgtaccaagatcgtttcacgcgaggaagtaggtgggcaatcaaatgaaggctaaagaaattactgcattaaccactgctgagatgctcgacaaagagaagcaatataaagaagagctgttcaacttgcgcttccaacaggcgactggccaattggaaaacaccgctcgcttgagtcaggttcggaaaaacattgcacggatcaaaacggtccttcggcaacaggcactcaataaataatcggaaaggagacatttaccttggcagaacgtaattctcgtaaggtttatcaaggccgcgtggtctcagataaaatggacaagacgatcaccgtggaagtcagcacggtcaagatgcaccctgtttacggcaagcgtatgaagtactccaagaagtattacgtgcatgatgaagacaataccgctaaaactggcgatatcgtgcggatcgcagaaacacgtcctttatcacgcaataagcgtttccgtttattgaacattgtcgaaaaggcagttatcatctaatcaatttttcggatgaaaggaggaccattccgtgatacaacaagaaagtcgccttaaagtggcggataattccggcgcgcgcgaaatcctggtgattaaagtacttggcggttcataccgtaagactggtaacatcggtgatgtcgttgtcgcaactgtaaaacaagcaacaccaggtggcgttgtcaagaaggctgacgttgtcaaggctgtcattgtacggaccaagtctggcgcccgtcgcgctgacggttcttacatcaagttcgatgagaacgcagcagttatcattaacgccgacaagagccctcgtgggactcgtatctttggacctgtggcacgtgaactgcgtgacggcgatttcatgaagatcgtctccttagcgcccgaagtactttaatcattctgaccaaataggaggtgcgatacatgaagttcaaaactggtgacaaagtgcgggtcatgcgcggcaaagatgccggcaaagaaggccagatcactaaagtcttgaaggacgctgataaagttgtcgttgaaggcattaacatgatcaagaagcaccaaaagcctaacaatgctaatccgcaaggcggtattatcgataaggaagcacctattcacgtgtccaatgtgatgcttcttgatccagataccaataagccgacacggatcggttctgaagttaaagatggcaacaaagtgcggattgctaagaagtctggcaccgcaatcgataaataatagggaaggaggacaaactttttcatggagaatcgtcttgaagaacgttatagcaaagaaatcgctcctgcattggtaagcaagtttaactacaagagcaccatgcaggcaccgaagatcgaaaagatcgttttgaacatgggtgttggtgatgcgactcagaacgccaaattgctggatgaagcagttgacgaactgaccctgatctctggtcaacatccactgatcaccaaggctaagaagagtatcgctggcttccgtctgcgtgaaggcatgccaatcggcgcaaaggttaccctgcgcggcgaacgcatgtatgatttcttggataagctgatcaatgtctccctgccgcgtgtgcgtgacttccatggtatttcccccaagtccttcgatggtcgcgggaactataccttgggtgttaaagaacaactgatcttcccagaaatcgattacgataaggttaatcgtgttcgtgggttggatgttgtcatcgttacaacggcaaatactgatgaagaagctctcgaattgctgacgcaagtcgggatgccattcgccaaataagggaggtccgctacttggctaagaagtcaatgatcgctaagaacaatcggcctgcaaaatttgcagtccaggaatatacgcggtgccaacgttgtggccgtccacattccgtttatcgtaaattcaaactctgccggatttgccttcgtgagttagcacatgccggccaaattccaggcatgcgcaaagctagctggtaatcactagacaaaggaggttaaatcaatggtcttgaccgatccaatcgcagattacttgacccggatccgtaacgccaacatggtgcgtcacgaatccttggtcgtacctgcatctaagatgaaaaaagacatttctgagattctgaaacgtgaagggttcatccgtgactatgaagttattgatgatgacaagcaaggcgttatccgcattttcttgaagtatggtaagaataatgaacgggttatctctggcttgaagcggatttccaaaccgggtctgcgctcatacgttaaaagtgatgctgttcctaaggtcttaaacggcttagggattgctatcatctcaacttccgaaggtgttatcaccgacaaggaagctcgtgccaagaacgtcggcggcgaagtactcgcctacgtttggtaattcaatatatcaaaaaggaggtgccgataagtgagtcgtattggttataaagtcattaaagtcccagccggtgtcaccatcacaaaagatggcgacaacattacggttaagggcccgaaaggcgaattgacccgtcattttgccccggaaatcgaaatgcaccaggaaggcgacgagatcaacttcacgcgtcctgatgattcctacaaggctgtccacggaacaatgcgggccaacttgaacaacatggtcgtcggggttaccgaaggctacaagaaagaaatgaagttggtcggtgtcggctatcgtgcacaaaaacaaggcgaaaagcttgttttgaacgttggctattcccatccagttgaaatgaccgcgcctaagggtgtcactgttgaagttccaagcaccactcagatcatcatcagcgggatctcgaaacaggttgttggccagtttgcagccgttgttcgttccgtccgtgcacctgaaccttataagggtaaggggattcgttacgttgacgaacatgtccgtcgtaaggaaggtaagactggtaagtagtcttaaccttcaacaaatttaacaagaggtgaacattgtgatttctaagccagataagaacaagactcggcaacggcgtcacgcccgcgtacgaggcaagatttctggtacgagcgagcgcccacgcttgaacattttccgttcgaataaaaacatctacgcacaattaattgatgacgtagcgggtgtgacgctagcaagtgcctccactcttgataaggacattaaagatcctgaaaacaagactgctgcttctgcacaagttggcgcgttgatcgccaagcgtgctgttgctgatggtcataaagttgtggtctttgaccgtggtggttatctgtaccatggtcgcgttgctgcgttagctgaagcagcacgtgaaaatggcctcgaattctagaaaaaaggaggataaccaacacatggcatcatttatcgatccaaaccaattggacttagaagaccaagtcgtttccatcaaccgtgtcacgaaagttgttaaaggtggacgtcgtctgcgttttgctgcgatcgcgatcgtcggtgataagaatggtcacgtcggctttgcaactggtaaggcccaagaagttcctgaagcgatccgtaaagctgttgacgcggccaagaagagcttgatcgaagtaccgattgtcggcacaacgattcctcatgaagttatcggccattttggcgccggcgaagttttgctgaagcctgctgaagaaggttctggggttgctgctggtggcgctatccgttccgtcatggaacttgccggcattgctgatattaccagcaagtcactcggccgtaacaccccgatcaacatgatccgggcaacgatggacgggttgacacaactgcgtacccgtgaacaagttgctgaattgcgtggcgtttctgcgtcatcattagaagactaggaggtaaacacatggctcaattgaagattactttgacccgtagtgctgcccaccgtcttcctaagcaacgtaaaattgtgaaggaattaggcttagctcgagtaaatagctcagtgatcaagcctgacaacgcagccactcgtggtgcgattttccagatttcacacttggtttccgttgaagaaatcaaggattaataacattatttcgacaaggaggtgcccaagagtatgcaattgcacgaattaaagccgagtgtcggctcccgtcattcccgcaagcgtctgggccgtggtacttctagcggtcaaggtaagacagctggtaaagggacaaagggtcaattggcacgtcagggcggcaaaacgcgtcttggcttcgaaggtggccagatgccattgttccggcgcatgccaaaacgcggtttcaacaacattaaccgcaaagaatatgctgttgttaacctttccgatcttaaccgcttcgacgatggcgccgaagtaaccccagcagccttgatcgatgctggtatcgttaagaacgaaaagaacggcgtcaagctgctggcagacggcaagcttgagaaaaaactgaccattaaggtagcaaaggcttctgctgcagcgaaggctgctgttgaagcagctggcggttcgattgaggtgatctaatgctgaggaccctgaaaaacgcgctcaaggttaaagacatccgtaacaagatcctcttcactttagcggttttattggtctatcgattaggtacactgatcgcagtgcccggggtcaatgcaaaggcgctgcaatcaatcggttcgacaggcctgatctcactgctggatactgtcagtggtggcggactggcccagtactccatcttctcgatgggggtctcaccgtacattacggcacagattgtggttcagctgctgcaaatggatatcgttccgaagtttgttgaatggagcaagcaaggggaagttggtcggcgtaagctgaatcaggtgactcgttacttaaccattatcttcgggttctttcaggcaatcgggattacggccggctttcaaacgttaagttcgatgggcttggtcaaaaatccgtctgttagcacctatatcacgatcgggatcatcttaaccggcggcaccatgttgctgacttggatgggtgaacagatcactgataaaggtcttggtaatggggtttccttgctgatcttttccgggatcattgctcgcttgccttctggccttcaagagctataccgcgataacgttcaggtatactctggtgccgaaatctggaaagggattgccttcatggcagccttagccattatcgtgatcctagtgatcacgtttgtcacatgggtacagcaagcgaattacaagattccgattcaatatacccggcgtgtcaccagcgcaggcagcaacagctacttgcctttaaaggtcaacgtggccggcgttattccagttatctttgcgagttccttcatcgtaactccgcaaacaattctgatggcttttcaaaagaatcatggcggtgatggctggtatcaagtcatgaccaacatcttcaatatgcaaaaacctgccgggactgcgatctacacgcttctaatcattcttttcacgttcttctatgcgtttgttcaggtcaatcccgaaaaggtctctgagaacttaaccaaacaaggcagttacattccaggcgtttggccaggaaaagaaaccgagaattatatctcgcgtttactgatgcggttatcaaccgtcggggcattgttccttggtctggttgcattgctgccacagttagctgccaacatttggggcttgccacagtcaatcggactgggcggcacaagtctcttgattgtcgtcatgacagcgattgaattggttcgtcagttagacggcttactcatgaaacgcgagtatatcggtttcattcgcggagacttgattaaaggcgacagtaaaaaataaacgtcatttaaacagaacgtgagtcagcttgattagagtccaatgtgtaagcgaatctgagtatgatgaccgggttcggttattgtgtttaagagcgtttatacgtcaggttctagtctggcgagcgcgtttagaggaggatgcaacgtgaatctcattttaatgggacttcccggtgcagggaaaggtactcaagcagaacggatcgaagacacttatccgattgcacatatttcaaccggtgacatgttccgagctgcgatggctgctggtaccgcattaggtaaagaagcgaaaggtttcattgataagggtcaactcgtaccggactcggtcacgaatggcattgtcaaggaacgactcgctgaatctgataccgatgctggttatatgcttgatggcttcccgcgcactatccaacaagcagaggcactcgaaacgattacagccgatctgaagaaaccgttagatgctgtcatcaatatcgatgttgcacctgcaaaattagtcgatcgtttgtctggccgttttatttgcaagacatgcggcgcgacttatcacaaaatctacaacccgccaaaggttgccggcacttgtgatcgttgcggcggtcatgaattcttccagcgtgaagatgacaaaccggcaacggttaaaaatcggctcaaggtaaacatcgaaatgaacacaccgctgttggacttctatgaaaagaagggcctgcttcacacggttaatggcgaccaggacattgataaggtgtttgccgagatcaaagcgattttggctgctgtggcaaagtaagtgcttggacgattgcacgcccctcatgactgttttcaaagtcgaagaattatggtacaatatcgcggtatgcggtgagtgccaatcggcctcacccttttcgcgcgttaatagaaccaataatttttaggaggaaacacttcgtggcaaaagacgatgtaattgagatccaaggcaccgtgacggataccttacccaacgcgatgttcaaagtcaaacttgaaaacggcgcagagatcctcgcccatgtttccggtaaaattcggatgcactatatccggattttaccgggagataaggtaacggtggagctctctccatatgatctgaccaaaggccgaatcacttaccgtttcaagtagttgccaactcaaggaggctaaattctcatgaaagtacgtccatctgttaaaaagatgtgcgagcactgcaaagtggtccgtcgtaaaggccgggtcatgattatctgctctgcaaacccaaagcataagcaacgtcagggataatacaaactaattcaataggaggtgtcattgtacatggctcgtatcgcaggtgtcgacttaccacgtggtaagcaaatcgtcattgccttaacctatatttatggtgttggcaagacaaccgctcaaaaggtcctcaagaatgccggtgttccggaaaacgttcgtcaagatgacctgaccccagaacaagaagacaagattcgtgcagccttagactccgttaaggttgaaggtgaccttcgtcgtgaagtaaacctgaacatcaagcgattgatggaaatcggttcatatcgcggcatccgtcatcgtcgtggcttgccagttcgtgggcaaaacaccaaaaacaatgctcgcacccgtaaagggaagaaagcaagcatggcaggtaagaaaaaataattaaaggaggtcattgatcgatggcaggtagaaaaactacgcggaagcgccgtgtccgcaagaacgttgaatctggcgtggctcatatccactcaacattcaacaacaccttagtaatgatcacggaccctcgcggcaatgcgatcgcttggtcctctgctggtgcactcggctttaaaggcagtcgtaagtcgacgccttttgctgcgcagatggctgctgaagctgctgcaaaggaatcaatggaacatggcatgaagtcggttgaagttgcggttaagggcccaggttctggccgtgaagctgcgatccgttcacttcaggcaactggtcttgaagttactgcgatccgtgatgttacaccggttccgcataacggttctcgtcctccaaagcgtcgtcgtgtttaattgttacccttcggccgctttaacggtcaggcagacaaatcttcacttctcgttttgaaaggggtacaaactagatgatcgaattcgaaaagccgaacattaccaaagttgacgaaagcaccaactatggcaagtttgtggttgaaccgttggaacgcggctacggtactactttaggtaactcgttgcggcggatccttctttcttcattgcctggggcagctatcagcagcatccaaatcgacggggtactacatgagttctccacgattgacggtgtgctggaagatgtgacccagatcattttgaatatcaaaaaattggcgctcaaaatgaacactgatgaagacaagaacatcgaaattgatgtcaacggtccggctaaggtaactgctgctgatatcgtcgctgatcctgatgttgaggtcttaaatcctgaacagtatatctgtactgttgcagatggcgggcacttccatgtacgtatgaccgttaaaaagggtcgcgggtatgtggcagctgaccaaaacaagtctgatgacatgccaatcggtgttttgccgatcgactcgattttcaccccgatcagccgggttaactatcaagttgaaagcacccgtgttggccgtcggaatgatttcgacaagttaacgctggatgtatggactaatggctcaatctcaccacgagaagccatcagcttagcagcgaagatcctgacagaacacttggacatcttcgtcaatttgacggatgaagccaagaacgctgaaatcatggttgaaaaagaagagactcacaaggaaaagatgcttgagatgactatcgaagagcttgacttgtccgttcgttcttacaactgcttgaagcgtgctgggatcaacacagttcaggagttaaccaacaaaacagaagccgatatgatgaaagtacgtaatttaggtcgtaagtcacttgaagaagttaaaaacaagttggcagatctcggcttaggattgcgtaaagaagactaatttcgaaaaggaggccaatccatgagttaccgtaaattagggcggaccagctcacaacgtaaggcattgttgcgcgacctgaccactgatcttttgatcaatgaacggatcgtcacgactgaagcccgcgctaaagaagttcgttcaactgctgaaaagatgattactttgggcaaacgcggcgatttgcacgcccgtcgccaagcagcagcttacgttcgcaatgaaatcgcgagtgtcgaggaacaagatgacaacagtgttgttgtgaagtccgctttgcaaaagctgttcagtgacttggcaccaaaatacgcagatcgcaagggcggttacacccgcatcttgaagactgcgccacgtcgcggtgacggtgcaccaatggttatcattgagctcgtctaaacacagttaaaaatggatggcccacgcggtcaaccaactttgatcatttgatcgatggagcgttacgatgatggcaggcccagttcctgcttagtctagcttgagagcaccgggcaaccggttgtctccatcattaaatgattttttttgtggaagcgcgagccagcccgggtagaaaccggagtgtaagtggctttggtcgtgatggctgggttttggccattgtgaccaaagccacttacacgcaggtttctgggctggtgagcgcgttatagaacgcgcagaagctcaatggtattgccaagaatagaacattcctacaatagcatgaaccacagaaaacctgaaaaacctcgcagaaaaccgccaaaattggcggtttttcctgtatactgcaaaataacggaggttaacaatatgcacaattggcttaaacaaagagcaccatggcagattggattatatgtcatcggcatttggtcactgattgccattgtttgggttctcctgttggtcttgttaacaccaccaaatggcagcacaggtggtttattgatgccggtagtggatcaccttgctaacggcagcgttactgtgcaatggctgtcatatgcttggctcatatcgatgttaagtggttatctgacgggacgacaatatcgcaagcaaaaactaacccctgcattgcccaaagcacttataccactaacgactttctgggtcatcattttgcttcttgctcaatggtatccactgtcttggttgacgaaaccacactcacttgacggctttctgctgctggcaatgcttagttttgttgtcattatgccagtcgggatcggcgccgcatatgcaggactgtttgtgaacggttctcggtatttaacagtcattttctttgtgcttttgctgatgacaatgcacactaatcaattgatcgtgaatggtaacagtaatttggcatggtgatgttgaatgcgactccaatgcgagtacaggcttggatgttgttggttggcagtttgatatttagtgcggtttttgcattccttagtactaatcccgatatcgttaaaaataatttctagcaaacctgtttttcatggatgcatgattttcacccatgtcgtcatggcttggaaactgcaagacaaggggagcctaactcccatcggctaagtaaaatatggtatcattatccggtatacaaagcgtaggaagaaggggcatcgtgggcaacgccattcgtgttcaacatttgaattacacttatcctgaagccaaacagcaagcgctgacggatgtttcatttgatgtggccaagggtgagtggctggcgatcatcgggcacaacggcagtgggaagagtacccttgccaaaaatctaaatggtttgctggcaccggaatccggtactgtgcaggtagcaggcatgacgttgagtgaagaaaccgtttgggatattcgcgccaaagtcggcattgtttttcagaatcctgataatcagtttgtcggtgcgacagtcgcagatgatgtcgcttttggcttagagaatcgtggcgtcccgcgaccggagatgattaagcgagttgacgaggccttggatcgtgttggcatgacggcttttgccgatcgggaaccggcacggttgtctggcggtcaaaaacagcgggttgccatcgctggcatcgtggctcagcgaccggaaattattattttagatgaatccacatcaatgctggacccagctggtcgacaagaagtgttgggtgttattcgggaattgaaagacgaacttgggttgacggttctttcaattacacatgatattgatgaagcggccgaagcgcaccggattattctcttgaatgatggcaaaattaatgagattggtaccccaagcgagatcttttcgcatgggatggaattattacgactgggattggacgtcccatactcggagaagctgaaagatgctttggcccagcgcggcattgcgatgccgaaagactatatggacaatgaaaggttggtagactacctgtggacattacattcgaccatgtgagctttacctatcaggcaggtacgcctttcgctggtgatggcattaaagatgtgagcggggttattcgagacggcagctatacggcaattatcggtcacaccggttctggcaaatcaaccattctgcaacatctgaacgcgttgttgaaaccaacttccggcacggtgacgattggcgacaaggtcattaccaatgaaactaacaataagaacctcaagccgctacggcaaaaagtcgggatggttttccaatttgcggaaaatcagttgtttgaacaaacagtcgctaaggatatcgcttttggcccccaaaattttggggttagcgaaaaagatgccttagctttggccgataaaatggtcaaaatggttggcttaccgcatgatgtgttggaaaagtcgccgtttgatctatctggtggtcagatgcgtcgtgttgcgattgcaggcgtgttggcgatgcagccggaggtattagtactggacgagccaacggcgggcctggacccttcaggacgccatgagatgatgcaaatgtttgaacagttgcaccgcgagcaaggacaaacgatcgtgttggtgacacatcaaatggatgatgtggcagactatgcggatacagtttgggtcatggcagaaggcaagttaatcaaaaccggaacaccgcgagagatttttgctgacccagcttggttaaaagcgaatcagctagggctgccaaagacggcgcaactggcgcaacaattagcagctaaggggttccactttgatccacaaccgctaactgaaagcgagttggcagatcaattggtgccgcaaattggaggtggccagtgtggataaattactgctaggccgctatattcccggcgactcgtgggttcatcgattagatccgcgaaccaaacttatcgccagcttctactatattggaattgtctttttagccaataattggcagacatacctaatgatgtttgtagcgacactgttcatgatttggttatcgggtatcaaaatcggcttcttccttaagggggttcgcccactgatttggctgattttgtttacggttgtcctgcaggtgctattcgttcgtggtggtacagtttactggcattggggctggttatggattactgaatttggtctgataaacggagcctttatctttgtccggtttgtgttgatcattttcatgtccactttgctcaccttgagtactcagccgctgtcgctagctgatgcggtggaaagcctgttgaagccactgcgggtcattcgcgtaccagtaaccgagctggctttggttttgcagattgccttgcgtttcgtacccacgctgatggatcaaacgaccaaaatcatgaatgcgcagcgtgcccgtggtgttgatttcggtgagggtaacattttccagcagatgaaggctgttgtaccgttgctaattccactatttgtctcaagctttacgactgccgatgaattggctactgctatggaagcgcgtggctaccaaggtggcgatgaccgaacgaagtaccgtatcctacgctatcatcggcgcgactgggttgcagcaggcgggatgcttgttttaaccggtctgttgctgttgttgcgtgcttaatagaagggacatcatgacgcattacaaggtaacactggcctatgatggcaccaactttgctggctatcaggttcaaccaaaacagcgcacagtccaaggtgtgctgcaaaaagctttaaccaaaatgacgaaggggcagccagtgcatgtcgatggttcaggccgaacggattctggtgttcacgctttaggtcaggtgatcagttttgattacccgggaaatattccggctgagtcgatgctgaaagcgatgaattcgttgatgccattagacatcgaaattcttaaagctgaaatcgttgatgccgattttcatgcccgctattccgctaaaggcaaacggtatttgtaccgagtggctcgtggttactatacaaatccgtttaaccgcctatatactggtcattatccttacaaacttgatgtgcaacgaattgaagtggcattgaaggacctagtcggcacacacgactttacaagctttgcggccagtggcggcgtgattgtcgataaagttcggacgatttatgaggcaactgttcgagaagatccagtgacaaacgaaattatttttgaattctatggcaatggctttctttacaacatggttcggattctcgttgcgacagcgcttgaaattggtaatgggcggcgtgatgttcacgactttcagcgtttgtttgcagtcaaagatcgtcaacaagcacgcggcaccgcaccagcatcagggctgtacttgaaggaagtttattattagaggctgacgctgcggcgttggctttttttatgaaaaaagagcagattgatgctgcgtattgcatcaatctgctcttaggaaaaattcgattaaattaccgcgtatagtgccgcacaatcgcatttaacgtttcagccgctccggctttgccggtgccgtcttcgtaatacttgctaaaacgtggatcggaaacatacatcgcagctaaaccgcgatgagctttttgtgaatattgttcagaaggccaggtcatttgtagaaattgcttgtgcaatttgaagacgcgttttgcctccggggtgttgaaatcggtggtgccaactaacggctttaaggcatccaaaatttcctgttgtagggcagttagttgcgcaacctgcgcctgtgacatatcgcggaactttttgttgctggcttcgacaatatcatctccatattgttgccggatttcttcaccatattgttgttcgtttgctttgatggattgatctttaaaagcggcaaatttttcgtcatcagtcattgtatcgactcctttttctaaagtttgatcaagggtagtgagcagtaagcttagttgatcgcgtttggcagtgatgcgtttgcgttgttgcttgagagcgacggttaagttttcagcagggccgtctagcagcaccttcacttgggcaagtggcatctcaaataattgtaagaagcggatggtttgcagacgatcaacctcatcctgggtataaacgcgatactgattatcaggatcacgttgcgttttcagcaagccaatcttgtcatagtagcgcaatgttcgtggtgtcacaccagccaaatcggctagttgctttgtagaataggtcatcacttgcctcctaagcgcgcttaaccagacacttccaagggcaatggccaagacgcggccgatgttcttgaagtcgcttatacgccggtttcaaaccgagttggttcgcgcgctcccttaatcaactataacaataaaccgtgacgtaaggtcagggtcaagcgcaaaagaaattaattatttggcggggaggacttcctaaaatttgcaaaaaaagaaccgcgacccgatagtgcgatccgcggttcatgatattcagttgtttgacgatggttacttcttgaggaccttttcggccaaagctttgacttcgtcgtcggacatatctaagactggcttcatttcttcttcagtcttaatggtgtcgcggctgttcttttccatgtaataatcccacagcgcatcacgtacaggtgcttcgctgtcgctccagtcaaataccttgttcattggttcatcgagaaacaatgtcttttcaggatctactgatgccataatgattacctccatgatttatactcatttttgatacaagttcattataatccttttactaggagatggtgcaaatttttagcactgtttttaattgagtgctaatttttaggagtgtttcttcgttgctagccgatagctggtaacagtcagcgcgtttacgacatcaccttttagatggcacttgcctttattttccgcatcccttcgtcagttaacgtcttcaaatggccgtcgcgcatttcataaacggtgtcgacagcatcaagtaagcgtgtatcatgggtaatcatcatgacgacgcgttgagaatggtgtgcgatatctgctaacaaatcaacgacctgcaaggcgcgcttagtgtcgagactggcagttggctcatcggcgaggatgatcgatggatcgttgtacaatgctcgcgcgatggcaacgcgttgccgttcgccgccagataaagcagcagggtaattagtgaccaaatcgctaatgccaagcatgtcaaaaagtgccgacatggttgtttcatgcttatgatgatgattgaaccgatcaactaaggtgagctgatctttgacggttaaaaagggaatcaaattgctagcttgtaaaataaaaccaaacgtattgaagcgtaaatcggttcgttggccttcattcaaatgggtggtgtcttgatgattgacgataatctgaccgttgcttgggcgttgcaggttgccgataatcgtcagcaaagttgttttgcctgaacctgaagggccaatgatggccgcaaattcaccggcctttaaagtgaaatcggtcgggtacagagctgtgaccgcggtatggccagtaccgtaaattttactaacttgtttcaactgaataagaattgccatgtcattcgcctccaatcgctgctaatggatcaattcgtaaaatgcgtcgaagtgaaaatagtccaccaataagcgacatgacgattaacgccgtcgcaatgctgaaaaagaggatactgttggcataaaatggcattgttttgggaagtatcagctcagtcagcatcaacaggcctgcccccaccgcaacgcctaccacagcgagcattaggatttgccagaataatgcggcgatgatggcacgcgttcggataccttgcgcccgcatgacgccatacatcgagattttttggatcgtcaagatgtacatgaaaatcccgataatgagcaacataatgccaatcatggcaccaatcatcaaagcaaatgtcgaagtttcggcggtataaccggggatgttgttaatcaatgtcgctcgggtgacttgctccattttggcgggcacctttttgaaggcgtgcgggctaatcaaaaccgaaacgttctggacacgactttggccgtattttaattgccgaaaagtcgttaaagttgtgtagaatacaggtacagtgtaaaaaaggcgatcatgggtgagcccgacaatgtgatacttttgatcgctgccattgagcgtgatatggtcaccttgatggaggccgtaatgaagaacactgtcgtcagccagtacctcattgctgttctcgggcattcgaccgctggtgacagttggcctcagcttgccactaagattgacaccaaaaatattactgttcaccttttgattcgtcttggtgttttcggcgacaacggacacttgaccaagcagcgctgcctgatgagtgtctgcttggtcgacttgttgcttagtgacagtcgagcttaacagatttttatttgcgtattttgacatgagcacatagttacctggtaaggcatcaatcgcggttcggttgttccgcgctaaaccggttgccaggccagtcagaaagaaaactaggtaggaaattagcacaaaagtcaccaccaccaaaaggtaacgggccttgttgtgcgtaatctctttgtaggcaaggaacatcttgttcacctccagatttgattttgcacaattataatatcactaatttatcgaatgataaacgaaaaggacttaaaaaatgaatcaacgtgaacaacagaaaaaagcaaccatgcaacgcattttgacgagagcacaaactttattcatgacgcacggttatgctgcggtcacaacacggatgattgccgacgctgctgatgtccagcagccgttgctttaccactatttcaagactaaagaggccttgtaccttgctgttgtcatgcatgtaagtgaagcaatggccgcaaaaatcgtgcatgaacaaacagatagtcaacattttgtcgccaacgtcaatcggctgggccatttgttaaccgacgacaatgatatgaacttacagttggtgttacatgatattggcaacttgaatgaagcggcgcgatccaaagtgtttcaagcgtggcaaaaaggcctgttgaatcccttagacagtttctttgcggtgtttaaacaacgactcgtgccggattatcaaattcgagaaataacgttgtattttttgacagtgctatcagtttatcttcaaccaagtgatcgtccgactagcgacgggctaacgttcaaacgccaactatcgcttgatcgcgcgttgcaaatgttttgtacaggggtccagcagaaaggaactatccagcaagactgataagtgtgctggatgatggtgcgtcctttcaaaaacatagcatgagaaagctgctctagataaggcggttcggcactactggtttactgagcagtcgacagtttcgcggcgatcgtttttcgatttttacattgacttagacgccaatcgttggtattctagtagctggtattgtttgccccacgataagccccggaaacttaacgtgttcaaacaagcacagaattatggaggaaacaaatcgtgcgtacaacatttttggctaagccaggtgaaatcgaacgtaagtggtatgtggtcgacgcaacggatattccgctgggccgtctctcatctgtcgttgcttcgatcttgcgtggcaagaataagccgcaattcaccccaaacgttgatactggtgacaatgtcatcattatcaatgcttccaaactgaagttgactggcaaaaaagcctcagacaagatttactatcaccacagccagcatccaggtggtttgaaacatgaaatcgctggggatctcttgcgggataacccagctcgtctcgttgaatactctgttaagaagatgctcccgaccaagaatacacttggccatcagcaattcttgaagcttcatgtctatgctggggaggaacacccgcatttggcacagaagccagaagtactcgacatttcaaacttaatctaaggaggcaattactgtggcacaagtacaatacgcaggtacaggtcgtcgcaagaactccgttgcgcgggtccgtttggttcccggcaccggcaagatcacgatgaacggtaaagacgttcgcgactaccttccatatgaaaacctgatcactgatttatcccagccgttcggtatcaccgaaacaactggcagctatgacgtgctcgttaacgtcaatggcggcggtttttctggtcaggccggcgccactcgtcacggcattgcccgtgccctgttgaccgttgacccagacttccgtggcccgctgaaaaaggccggcatgctcacccgtgaccctcgtatgaaggaacggaagaagtacggtctgaagaaggctcgtaaagcttcacaattctccaagcgttaatcattcgatcaacatttggcgtctcaacactttcctgattttcgggaaggtgttttttgttgcgctgaaaatagtcagctgattttgaagtaaaaaaacgcatgtgatcatctagtctgaactagtctgttcacatgcgtttttatttaatgtgggattaaaattagttacctgttttttcaattcgatactgcctagcaaactgctgcttagagacgacgcggtgatttgtgacgtccaaatagtcacctagatagccaatggtaacgaccccaaactgaacgccttgagcgtgaaaaacactggctttctcatgctgtaagctttcgatcattggcggaaacaaaccggccattaaaatacgaagtcggtcatccaaccaaacaaggtagttcttttcaaaagcttctttgacccagtcagggaattcgttgtttttactaattttccaaacttcggcggattgatctttataagtcgctttcatcagtatcctcacattcggattgtcggatttatttgtttaaatagttgtgcgattttgaggttttatttgtggaaggaagaatgactgtgctgtttgttaaatgaaaaagctcatgctaggctagtactcatcaaaaatgtatcacgggggcagcaactatggcaagcactgaagcatgctgatttctgaaagcaagatttatggacgcctataacattttaaaacgtcacatggtaaaattggtaaaagaactttgcacgacttgggattaaacctatttggggactaacttatttggggaattgttaaactataaaactttggaggaaaaaatagatagatcgccgtgtgtgatctacatattttgattgagtgatgaagagaagaaaactggtcttaattagtttggccgtgatcgtcgtgattgcggcactcatttttggggtcgcaagacataacaaaaagcaagctgaacaggcgattcaagcgcgcaatgctaaggttgatcaaacattaaccgccataagaacacaacataaaaagaatgtggcgctgaaggatgatgccaaacgattgcaggcactggcgaatcttgagacgcgtagtgaggcgtattcgctgcgtgcagatagaaaacagccggtcatagcgctttataaggaactcatcaacaaggaaaaggcctattttactgacaagaatcaaaagagcctgaagaaaaataagctgactgatgaccaattgaaagacatcaagaagaaagaccttcaggcgaagctcgctgggttaaatgctttgaccgatgtgcttaatacacagagagatattgtctacaatgataagaattttaagactttaagtactgagattcagcatctgagtgaacgctatgctgaacgcttacggcagatgacgcaggatgaggatcaagctagtcaagcagctgcaagcagtagccaagcagccgctgagcttcaagatcagcaaagccagtcggaacaatcaaatacagggcagaatactgatgctagtcagtcgggaaatactgccagtggacaggcaaacacaggcgtaggtaccgttggatccacaacggggtatggaaataactatggcaatagcacctggaattggtacgggtcaaataacagcaactactggggatcaacgactggtaatggcggtacaggaacaagcactacgccaaaaggcggcagtggaagtggctctggaaaaacaaatcaagaatccacaacagtcaataatagtggcaatcagtcatatgacacgacgggtaacggtggtgggcaggcaagttccggcgcggacgggacaaacccataacccaatcgagataacccatcttctgaaaatactttgtcaccagcggcagcagtgttgactgcatggacggtgccataaaatacaacgtcatcatcaggcgcttggtactatcccctgtcaagttgacacttataaaaacgaaaacacaatttttctaaacgcggttctgaatgtctcttaaaatctgtctcaaatattgacttcaatccataacgccgttaatgcgctttgcgggacagctttaagtgacctttgaaggccctatgtctcacgtgataaatctcctgcaacttaagaaaggtgtcttgattaagaattttcactctcaatcaagacgccttttacttagtctctattcagctttgcagttttaaataatgccgaccaacatttaatccttcaagctactacagatcaatcgtagtccctttgtctgctttcgccgccgcttgtaaaattttttcagcaacaacgacatctaaaacggcggtgccaacggccttgaacaatgtgatttggtcatggctatctcggcctttaatatcgccattaataagttgtcctaactcacctgaatactgatcttttgaaaccagcccattcttcagtggactgatcatatctcccgcttcagctaatacgccatccatcgtatcaaagataacaatatctgcctgtttaactagttctgcggggatctcatgcatttgcggagtgtatgcgccgataccgttgatatgtgctcccggtttaacatcggcagcatcaaaagtcgcctgttttgatgttgtgaccgatgtgataatatcagatgctcgaatagccttttgtaagtcaactgctgggagaatttcaaccttaaattgcttaccaaagcgtcttgtcatgtcctgtgcaaactttgcagcacgatctttatcaatatctgaaacgtaaacacgcgtcaattgacgaacgtttagcatggcctctagttgtgttggtgcctgaccgccagtaccgatgagcgttgccacttttgcatcagggttagccatcaagtcagtggctgcaccttgaagcgcacctgttcgaagctgagtaaggtaagtaccgtcaataattgctgccacaataccagtctttgggttcagactaaccattgttgcgggaacgctaggaagacccttatcaatgttattagggtaaacggatacgatcttcacacctaatgctggttctttaccggctgcataaccaggcatgtaaagactttgcccattatcaggtttgatatcaatattcgttctcaatggaacggtggcatcaccctttgaatatgctgccagtgcaatcttatcatcagcgattgcatctttcattgagtaaactgcttgaacatcttttttcgttaaaacgcgcatcataatcctcctataattgttgaacctgaaacagcaatgctatgcttctcccttttgacgcaaggacaatgccatgctgattgcggaataaagtagcacaatgataaccagccactgtaacatactagtatctaagcttttaacgaaaaagacggcaactaagacacccagcacaccaaaagttgaagtgaataatgtgattttccgactataatcagccaacttaacgaattgaatcgaactcgttgaaactgagaatgttgcggctcccatcatgattggaaaagcagctgatggattgagccccatcgcataaaccgtggccatcgtcaaagcataggaaccaataccgatgttgttaagagcaccataaatgaacagcaggattgcagttagcattaatttccagccagataagctcgttgctgttccgttagcaggaatccaattgaacttacccgctaaaatcattaacgcggcaataatcagacctgctgtcacaaacttcttaattgtgttagctggcagtttaacaacaaacctaggtccgatgtaagcaccaatgactgccgcgatgatacatacggctagcgttttaatatcgacagtaatggcggtgatgtaagaaagtgccattgcagcaacggggacaacacattgcgtgtttaaggtgcctggcagtttcttaattgaaacccatttagccttagggtaaagtgccgtgctgatagcaaaatcagaaatgccaaaagttgaaagtaagaaaataataaatgagctaaatggcaatgcccatgtcgttgcaggttccgacataacctctgaacgatgccggagcaagtcacggataaagtaaaatacaaagcctaaattaattagtacgattaatcccaataagatcttaatcatgagcattcttcccttttctatccatcatataaatatctctgacgccttcgagatccggaccaaacgccttctttgctgctgcatctaaagtttccagcgttctcagatcatacgcatcgtgaatcacatattcttgcgcaatgaaaacaaacgaatgatttctcgtatagatgacatcatcaccttcatccccgaaagtgccataaagaacctcagcaccatcaatgacggcattaacccaacggccgccgaagtccagtagtttatcacgttcaaaccagtgcggatatactcgtgtaaaaggcatgtgatagtcatgacgattactaaacagaatgacgacgaagtgatcaagaatcttagaaagtcgtgttagttctcctaaaatgtccgaactgatatcttctttccagatttgtaagtaaagcgacttctcgcaatgcgctaataagtctgacagtttatcctgtgtctgttttctgttgggaattgaataaatcagttcaccatcttgtttagtctccacattcgctaatcgtgtttttattcgtgccaactgggcagaagcttggtgtccgagtgttgtcactaattcatcagcagagataacgttgtaatacgttggatcactcttgcttgccaaaacaatgccacgttccgtcatacgattcagaacttcatagatttttgaccgcggaatacctgatcgttttgcgatttcgtacccggtactcgctggtaattgaagcatcgtgacgtaacactgactctcgtacttagaaaaatgaaactgcttgaacaagtctgttagtccaggatccacaattcatcatctcccctcagaaatgaaagtatcaaaatggtagctaccaacagtaactactataagtgaatttattcactagtcaagattatttttaaataaagttgagtctttttttccaaagctcttgataaacagctttctatttaaacaagtctagcattctcttttgtgcacttcgttacaattacaaaaatccccacaaaaataaccttgtttccaaagctcgggacaaggttatttgaaagctattattaaaaatcgcaagtcttgataactgatttcactatcgggttaagaattcaacgcctctaatcgcttctctcaacgcctccaccaaccccccataatccactgccccataatcattcacatccactcgaatcaactgaccaagctgaaacgtctggtagcctcgatcttgcacgcgattgctaaacacttcaaatgtcggcatgccatcaggcgtttcgctgatgttttcgagtgtatcaccgcgatgatagtgattcatgagatgaccaagatgacgaggatcggataggtcgcgttttcgctggcgatcgtagagtaccttgatgtctgcttctaatctgatggtgataaccgcatagtgatgtttggctgccaatttttcgagcgctggtttttgcaatcggctgaagggatagtcgcccagaatcattttgtgttcctgcatcagcatgccaatgccgcggtagtatcgtgctctcgcttctgcatcgaggagttgcttttcctcaagattatcaaagcctaactcatcgtaaagatgttctttaaaaagatcgagcagcagggagacgaatccgctgattgcttgcatgatcttatttgcagtatacgttttccctgtgcctggcgcacctgctagcaggaccaagatctgcttttgatcgctcatcatgtcatcttctcctctagacgggctccctagctcggaagtcttcgtttaaggaccttgatcgcaattcatcacagtcacacgtcgacttctagccgggttacgctcttccccacttacgcgttaattggcacttcggcatctttatttaagaacaaaccactcttgtgcttgacgatatcgtagacaacttggttgcatggttcgatgttgttccgcagcgagttgttgacctcggtctgaccgaacatttctttggctttccgggtccaaccaactaataattcggtcccaacattgaacttgcggaagccgttttcggtcaaacgatgataatcagcttcgttcacgccggtaccgccgtgaatgaccattggtttgctgatttctttgtgcaattcttcaatcaaaggccagttcaattcggtctttgatttgaattggccgtggtgagtaccaacgccgacagctagtgcttcgacatctacgttattcaagaaggcaatggcttgttgcgggtcagtataccggccttccttgacggtcacaccttcttcagtcccaccgattgtgccgatttcgcactcgactgaaacaccatgttcatgtgcatagtcggctacccggcgtgcccgttccatgttttccttattcggcagcgctgaaccgtcaaacatcacagaggaatagccagcatcaatggcttctttaatggcatcaaatgacttagcgtggtctagatgcagatcaacatcgactaacagatcttgcgccatggatttgcaaaccgcaacaaagttcttcatgccaacgtattcagccgtcgcaacacttgtttgaatgataattggcgatcctgcatcctttgcagccgtgatcattgatggcaccatttccaagttgtgcgcattaaaggcgccaactgtataatcaagtgcttgcgcttcatccatcaattgctttaagttcttgtacatagtagattgcctcccagcagattaataaccaaaacctgaccgcatgacccgtttggacatatcgagcaatgcatccgtttttgtgacccatttttgaatgtcgtcatcatttttcgcttttgccgcttgttttcgctgcgtctcgtataggttcagcaaggcattgtatgcatccccaaactcttctttatctttgacactcgcttcataagctgcgattgcctctaagtcgttgcctaatttaacctgagtagcgcctaattggttgtatagcaggtggcgtttgtttttatcatcggttatctgttcaatttgagtcgtcaatgccgccacttttttggttagagcagcagcttcggttgtcgaaagtgattgattgacttcttttggcaccgcggatggttgtttctgcgtgtctttctttttaaataaactgccaaacatagtcgtgcccctttctttaaactgctttaagaatcggcgttaggatccaggcatacatcagcatggccacgatcgtatcggagtcagttgccgaagcattcacgaagccaaacgaggtcaaagccgtgactagcagcgctggcaacaaggtgatgaacaggccgtggataatgccaccaatgatggccccgcggcggccgccgacaacgtttccgaagatccctgcagtcccgccggcgaagaagttagttaacatccccggcagaatgaccgcgagtccgaaaacaggcatcaagaacatgccaatgacggtcccaatggttgtcgtaatgaagcctaagatgaccgcgtttggtgagaatgggaacaagactggacagtcaagtgctggtttcgcatttggtaccagtttcatcgcaataccgcggaaagccggaacgatttcaccaagtaagagccgaacacctgcaagtaggacatagaccccgacaacaaactgaatgcccatcatgaaagcattcatgatatagttcagactcgtgccgttaccggcgtacttaggacctgcaaaagccgcggtgatcataaacaatggcaccatcacaacagcaacagagagatacgtgtcttgcaagaattccatgtactttggtaacttgatgtcttcaatcgagtgtttcttttcgccacgttcaccgaagatccaagcggcgcctgcttctaccatgtagccgatcgtacaaaagtgtcctaaagcaatggcatcgcccttggtaatcttacgaacaaaaggctgagcaatggctggcatggccaccgcgaaaattcccccgataacactaccaacaagaatggtcacgactgaattgaagccagctatcttgccgccgacaaccgtcatggtcaacatccacaacagcgcctgtccggttagaaaaatatatttccatggcgagaaccgcgcaatgataatgttgacaatgaagatgcccaaaaaggttaaggcaatttcatttcccaaccccagcgtattcatggcttgaccattgatcgcctcaatgctgggtacaaccccttttaggtgaaaaccatgttgaaaaatctttccgaaatacgtcagtgctgtgacaataatggcggaccctgctgataatacttgaaatcccaggagtgtcttgaaggttccagttaggaccgcgccaaaggacttgcgttgtagaagcaagcccagcatcgcgattaacgcaatggtgatggctgcctgagtcagaatattttgaataataaagttaaccacaaccatgattgattcccccttttaaacgcgatcactggcgcggaaaccgccacatagggaccttggatgcaatggccaaagcccgaccatcacatgctccggtctctaaccgcgccagctcacgctctgttgttcaagccgatttttctgataactctttgataactggcacgagcttggtttcaatttcgtctggatcaacaatgttgtgcagaaagacaaacttgatggctggatcgaggtcatattgtttgaactgccaagcaaaattttccgccgagacaatgatgtccgtccgtaaacctggtgttgatgaaatcgcctcatgttcaaggttttcatctaatcccaaacggtttaaaacatcttctgcggtcatctggcaagctaaggaagagcctaggccggcaccacagatgaagtaaatcgttaattttctgatcatttaaatcgtctcctttgacgttttctcgttgaataaaatatttttaaaggtttgaatatctgtttgttgcgccagctgatcaactttttgctgatcattgatgagttggacaatggctttcatgacattgagatgcgaataattatcgatcgcggccagacagaagatgatcttcacgggatcattgtctggattgccaaagttgattggtttcgccaacgttgtgatcgtcacgccaagcttctttgtcccatcctctggccgtgcatgggctagcgcgatggcaggtccaatgacaatatacggaccgaatttcttaactgaatcaatcatcgcttggatataatttttggtaatgtaatcctcgtcaagcaatggttttgctgaaatacggatcgcatcttcccaatcatcagctttctgttgaagctggatctggtgatcgttgattaaatctttcaacataggctgaacctccctttcattaatttcgacatggttctccttgaatgctgcttgcagatcagctaatagtcgtttatcaactgtcacctgatgggttttcagcacatccagaactgtgcgaaatagtcttgttggatctaacgtacggccttcgtacttagttaacgttgtttgtttcttcaaaaacgctgcaactcgggttaaatcaacttctgaaggaatgggattaaccttcaaactcgggattttatcgattggcatgtcgactgttttgaaaactaagctgaccggtaatttgcggagaatgccaacttcagacgtgctcaaaacggcaagaacatcaatgttaaaccgttcctccagtttggctgccaacactctgcccgtcgccgtcccgaagttgcagacaactgcggcttgatactgatagtcttggcgctggcgatcctcagcttgtgtcgctgagaaatacatcgccagaaatgccttctcatcatcagacatggtcagctgatagcgtcccgtcttgaagaaacgatcaatcgcgtcatagatcggcccatagccttgctggatcgtctttctcaacggattaaccactttgacgtgctgtgacaagcgcttgaacaaagcggtcatatggttatatagctcttcgaaaagcttttcgtttttagaaaatggaaagccaatttcagtttccatatgatcaatgagcgcaacgctgaaaatctgggccttgacccagtcgtcaagatcaatcgcaccgcgacgattaaaactgttgatcagaaaaccgacataacctaactcgctggcgacatcaatttgtaaggcataatgctgaatgagttcattgagaaacttggcattttccttattgagatcaacggcagtttcatcatctttgacatagtgcccgctgcgaacacggtgtaaccagataatgagtaacacggtcacttgctggctgtacatgtcgttgacggccaaggccccttttggaaaacaacggcgtagtaagtcccggatataggtcacatcttgtttggtaaagacttccttcatcttgtcgacatacatcccgctggcgattaattgctgggcaatcaaggtgaccaaagcatgttgccgtgttaggacatccccaaacatcgttcgaattgatcgctcgttgccttcaatctgtgcgcctaactttgggctggtcgtgagtgttagattgtattttgctagatcagcgcgcaagttgcggagatcagaatccattgagcttttactaatctgcatcttttcttgttcatcgacgagataaaccggttgggtggcttgaagcaaatccaataagagatacacagcgcgttgctcaggggttaaagcgccttgactgatgctgtcaaaatcaaggacgtcagacagcgaatgccgctgttgcgttgaaatatgattgtaggcgacacctcttttgatatcgaataagggcaagcttttctccgccaaaacttcatttaaaacctgaatctcatttcgaatcgtctttgtcgtgacgttgaattgcttgcctaaatcagataaagaacttgccgaaccgtccaacaatgttcgcagaagattcgtcaatctttctcgcattgctttgcctccttacagcttccatgctaagcaagcgcttacataccgaaaagtagaacctttttccttaactcgggaaacgaagtacaccttgctcatcattcttcaagtttcggcctcggtaagtgacaaaagccccataacggctaggcttgcctgcctaactattatggggcatatgaattttcggggttgagcggacaccgccattttcagcgcatcaaaaaagcgattctcatctgctgagaaccgcctttaagtcattcaggttactgttgcgctttcacgtaagccgccgcctgcgttcctgcttggcgaccaaagatcacaatgtcggcgacggaattgccaccgattcggttgtcgccgtgtaggccgccggtgacttcaccggctgcgtatagtgctgggattggttgttgcttctttgtcagcacctcagtcttggtgttgatcttcacgccgcccatggtgtaatggatgcctggggcgattttgaaagcatagtaaggaccggtagtgaggccatggtccatcccagttgtccgaccaaactcggcatcctttttgttggtgaccgcttcgttccaagttgaaaccgtcttggataacgtggccgctggcaccttcattttcttggcgagttcatcaagggttttgccttcgacaccgagcttatccttgatataaaagtcaatggcactcgaccgttggcggacgcctgtatcaatcacgacccaagcatccttgcctttctgcttgttaatggcagcggaaaccttgtcacgggtattcatttcgttatagaaccgcttcccgctttggttaactaaaatgccgccttcaccgcgggtcgcttcaccaatgagaatatgcttgctctggttaacggttgggtgaatttggatcttattcatgtcgatcgcatagccgccgactttctcgatcatcttgatgccatcaccggttgcgccagcttggttagtggtgacgtaatgagccagatcagggcgatatttcttgatcatttgcttacttgcaccgaaaccgccagtggtcacaatcacggccttggctgcgatttttttcgtcttgtcttgattgatcttgacggtaaccccgctgattttgccatctgtttcattcaacttggtaacatccgagttcacaaacagcggaatcttttcttttttgacttctttcacgagtccatcaacgagataaccgccaacggctgaaccatcgtgtggccgatgtgtgcgcttgaccgacatcccaccggaaatcgtcagtttgtccagcttaatcccaatcgaatcaagccagtcaatggcgctggctgagttgtcgacaaaatagcgcagcagtgctttgtcattcgtcccgccgccaccttttagcgtttcttcatagaactgatcattgctgtccttaaccccttgggcagcttcaacttttgtctgactggcattcataccgctagaggctttcagcgtattcccgccagcaacgggcattttttcaagaatgacgggattcatcccttgctgcttcgcctcgatggcagctgtcatcccggcgccaccagcaccgacaatcactatgtcatacttgcccttcatcgtcttcggatctgtataggcctgctgtgaagccccgctagtgaccttgctgctagctgttttgttcgcttttgaacttgacgaactcgactttgaactcgccccgctactgcaaccaaccagcacgacactcataagcgccaacagccctgcgattttaacccactttttcaaaacatggtccctcccttatgttgttgtctacgtgaatagattaacaaagtagcgaaaccatctcaacttaaccttgagtttgatgatataaacgttaatcgttttgcaagaaagcgagcttagaagcaggaacgaaggaagacgaccgctacaaacatgattgctgctaggacagacagaccaaggcctaaccacgtccagccgcgatactttgctttaagcctaccaggaataccgagatatcaactaggaaaaacaacagcatcaatagcgaaaaactcattttgatcaccctttcacctagattgattgctatgactgtatcagagttttcttattggctgagggcggtttgacaactttgccttaatcttaacttacaaggcgaattgtcaactcaaagagggacatattcgtcttcatcatcaattcaaaatttaacatttccacaactcaaacaatttacaaggcgttcgtgccctcctgatttcaaacacatcagcgtgatcaatcattttgatcgacttgaaaaagagaacatcttctcccgatgctttattatcaagatgaccaatacacagaaaagaccagcaagaaagccgcatgaatgcgcaacctgaacaagtttttcaatatctgacatgtctggattcggccaatatcccactgtgacgtaataaagagtcgatgtaaacgcaacaatcttcgtcataaaggaaaatgtgggtttttcgattaaaaatgccaatatagctagtggaaataaggcatatccagacaatgacacaccgtaaaacgattcaatataggtgcctattccaaacgctgattgaatgaacccgccgaatccgaagcaaaacagcaagacaccaagccaactagaaacaaaaaaactaatgacaaatggtgtactgccaattttccactcgatgaaaggtccaagcacaatcactgcaagcatattcttcattaagtgtgaccattcatagtggtaaactgtgctcgttacaactcgccaaagttcccctcttaaaattgaaggtatgctcccgacaaagttagctgatggtattaaaagaacattcgttaaaaacgaaaacaaaagataacaaactatcaatatgcagcagataaggaatgttcctctagcattcaaaaatacggataaaagattgggtcttctcaactttaacaacataaaattcacccgttttcttttcattagcatcattagcaccaaattttcttaagtcttataagatcagttgctcggtttggcagaaaagaaagaaactttcttccaatttcttagcgccacgactataagggcacagaaaaggccggaaagagccccacataattgactaatctgtacaatgactgcaggctctggtgtatctgaattcggccaaaaccccactgtaaagtacaacaaaagaccgccaactaaaacgcactttgccaacaaagaaaaggcaggtttctttatcaagaacgccaatactgccagtggaaataacgcatagactgacagtgttccgccataaaaagcataaacgtaggtgtttatgccaactgttgaccgaatgataccgccaaatccaaagcaaaataacaaaatgccgatccaactagaagcaaaaaagctcataacaagcgcaggactgccaattttccattctataaaggggcaaaggaccaaaactataagaacagtcttaattaagggcgtccattcagaaaagtacacagtactcgttataacgcgccagagttctccttttaaaattgaagccacatcccctaaaaggtcgttcgtgggaattaaaaacgtatttgtcaaagttgaaaatagtaaatagcagaagagcaatagacagcatatcagaagcgttcctctggcagccaaaactatcgcgacaaaagtcgagtttctcagcttttgcaacataaaagtcacccattttctctttcaagtcaaacctacgaagttgcaaacatattggctcattgataagtattcaaaaaggcggatttgctcagatccgccttttcttcaactcatagacctaggtttcattcgattgttgctttaactgtccaatccaaaaactagtttgtgcccaatgcggaccggcgaaccggtattgataagcatcaccatcatacggagttgtttgtggtcccggaagatcacttcatgtgaaggaaccaccaccatcttggggatataagaacccgccagatgtgttctaaaattcattgcttatgagaatggcgctgtctagcaggctgttccttctaatcttttcaatagtccatcctcctcgtttttgtgaaaacggtggcaatcagataatatagtcatgagcttagcgctaatgtactttatctatggaggaaagtcaagaaaaacagatattatttattataacgaactgtaaaatttaaaaaatgatataggaatattgtttaaagaatggcattcaatcaaatctaatttattttctcgaaatatctaataagactaaacggtttgtgacactagctctcttgcctgaagaggctgttgcaaatctttaatcaccacacacattctaagatccggaaactgattgacaaaagaggttctcaaattgatctcccagatgccaaaaaacgcaccaaagtctggctgctatgccaaaccttggtgcgctgcatgttttcctgcaaaaccgaatgttcaagttaccttttcaaaccatcttctcatttcaaagcactatgattcgtcatcaaatcgttctaactgacgctccagtttctcaatctcgccttcagtttcttccagcgcccccatgacttcttccaatgtcaaaccctcagaactatagtctttgtacttggcactaatataatcttcgtctgctaggcgccgtgcacgttcacgcaagtcgcccagttgcgtcacaagcgtatcgaaatctgcttttgccattcggtcacctctttacgctaaggcatcaggtgctgctaattgtgggatcttgccttgtcgcgccaaaacccaattgtcatagttccacatttcggttgcccgtcgatttctgaagtaatcccaaaacgactcgcgctcaatttcaataatctggctgtcgggcccgatggtgacccagttataggaaccgttgcgatgggcaaacttgatccagtaaactggcacgctgacctgcatcccgttatcttcataatggcgttcttgctgctcggttcgcatgtagctcaaaccatcggcataatttgggtctaactgattgaataacgtgactgcctgccgtaatgctttatcagctgacggcagtttcccgccatttttgaaggtgctggcattaaaactgatcaagttgccgtttctatcagtcacaagtgtcagatgcttgttgttcggcgtcacttcatcaacgttttgataacggtctagcgtcacttgcactttatttcgcttgcggacgtctgtttgaaccacgtgataatcttcgggaattggcaataaagccatcatatcgtttttcaaaattccgaccccttttcagtttcgttaagcacatccagcatcctgacaaattcaattttgttagcttcagacagttttgctgtcaaagtggcttcataatcggccacaatttgcgtcaccattgggatcaggcgccggccttttggcgtgaggctgataatccaagcgcgtttgtcttcgtcagatcggcgttttgaaacgagtcccaacgcgatcaactgggccaatcgtcgtgtgacgttgctgggattaaggtgaatcgttttaaaaagtgtttcctgccgcatctcgtcgactttgccaagcttcaagataaagcaatagttactcgcactgagcgtggttggtgccaacgcgacatccaagtcgtgttgaatgtggcgcgctaagatattgactcttgagagcagttcatccggttcttttggcattttctaccttctttcgtaacatcatgacagcgatgaaaaacagaacagcagcgagcataaagctgacaccctgcgcaacgaacaaggctggcggagcggcgtgggcggcggttgtgggcggactgacgatcgcgagggtttgatagaacaccaaaccggcaatggcgctaccgatactcatccccaactgtctagcaagtgaagtggccgcgccaacctgcccccgcatggtcgcatcgacactttgcatcaacacgacactattaggattcgtgaacagcgctgtgccaaccgcaaacgcgactgacacgataacaaacggccaaattgtcgtttgatgaggcagcaaggcaaagaccacattcgtcaaaaccagcatcagcaagccgattcgcatgagtcgctggcgatcaaagcggtcactgagcaccccagccactggattggcggccaacgaaacaagtggtgtcagcatcaacaaatagcctgacaaggccactggcaagcgtagcatcaactgtagataaatcggtgcgagcagcgtaaaaaaataagccgcaacatagttcaaaaacgaagccgctaaattccgcgaaaagcgctgattgctaaacaaccgggtatcaagcattgcttgtttcgtctgccgctcatgacgccaaaaccaataggcgcagctgccaatcaaaatgaccagaattccggtgaacaacggttgcttgttgatctggatgagcaacaacaacccgccaatcacaatcaattgaagaaagccgcggacatccacgctttttttcccagaaaatgcatgagtccgctgaaaaaccgcccattcgactaacaaacacacgacaccaatcggcaagttcacccagaaaatatagccccacggcaactgactcaggatcaggccaccgatgccaggaccagccaatgcgccggctgaaatgaagatcgattcaatgcccagcgcacggcccaaaatggcgggtgggaaaacgtccgcaacaattgcataactcgtagccatggtcatactagcacccactgcctgcactactcgggcggccaatatcaactgaaagttaacgccaaaaccagccaaccccgagccaatcagaaacagataggtgccccagatgaacagccgcgttcggccatattgatcagccaactgaccaaagaacaacaggcaaacgctgatcgtggtgagataaaccgtcagcaacaagttcacctgactcggacccaccgccaaagccgaggcgatggtcggtaccgcaacgacaacaatggtgccatcaataatcaccataaagaagaataaaccaagtgtgatgagtatgagccagcgtttgatcaatcactcacctccctgtgaagtattataggctgacttatttgcttgcgcaagcaaatttactgatctttaacgccagcctttcaaccaatttaactcaccaccatttcttcacaatactcgaacgagtagaatgaccatatatacggagcaaaatcaggaaatggggaaactatcatgaagaaatcgaccctcaccattattggcggtgtggctgcggcgattgtgatcattgcgggcggatttggcctttatcattggtatcaaggcaaatccgaagctgacgcggttcaggccactgcgcaaacttatacgcaggcgtttgctaagcgccaatatgacaaagcagttaaacaagttgataccagccacctgactggacctggttggcattatacggctaaaactttggcagcgcgcaatcaggcggtttttgatcgcgtgggcgccagcgatatcaaggttactaacgtgaaaaccaagaagtccgacaacaaaacctacgagctgacgtttaccgccaacatgaacaccaaaatcggcaagttgagtgcgcaacactacgaagcgccgattgttaaagtcggcaatgactggcgggtgcagtggtcgccacgtctgcttttcccgtcaatgaacggcaaagacacggtgcaaatcgacttgatcgcggccactcgtggccagatttatgaccgcaataaccagttgctggcaaaaaatggcgatgtgacccaagctgggctagttcccggcaagctcggaaccggtgccgatcgcacagccaacttagagaaaattgctgccgcgtgggacgtcaaggtcaccagtcttgaaaccttgctgaaacaatcttgggtgacggatgatacctttgtgcctgtcaagatcgtcactgattcaccagccatgacaggcgcggcttatcagacgatcggctcgcgcacctatccccttggtgaagccgcggctcagctcattggctacgtcggcaccgcgacggctgatgacattcgcaaagatccaacgctgacggctaatagcaaaattggcaaaaccgggttggaacaagtttatgacaagcgactgcgcggcacagacggcggccagatttcaattcaaaacggcgacaacattcacccgcttttaactaaaaaagctgttaatggcaagtcgctaaagctaaccattgacgctaaccagcaaaagatagcctacacccaacttgcagggaaagccggcagtgttgtgacgatgaatccgaccaatggcgaactactgactttagcaagttcgccaagttatgatccaaacgcctttgtcaacgggatcagccagacggactatgacaagtatgcaaacaacacctccctaccactcctcagccgctttgcacaacgctatgctcccggttcaacatttaagatgctgacagcagcgattgccctccagaataagacgatcaccccggacaccaccaagtccatctccggtctcaagtggcaaaaagacagctcctggggtgactacaaggtgacgcgcacagttgatgcggcctctgaaaacatgacacaggctttggtcaactccgataacatctggttcgcccaaacagcacttaaaatgggtgccttcgcttacctcaaaggcctcgcgccactattcaaaacccaggctgacttaccgctgaccatgaaaaaagcccagatttcaaactctggtaagctcgcttccgaaacccttttggccgataccgcctatggccaagggcagctcctcttgtcgccaattgaacaagccgcgatgtacagcacgattgccaatggcggcaccatgcaacaaccgaccctcattcaaggcacgaaaggtaaacggaccagcagcgttttgcaggccaacgcagctgatacggttaaaacggcgctaacccacgtagtttccgatcaagctggaaccgcccatgatcttgcgattgacggtcacaccatcgccgcgaaaactggcacggccgaactcaagcaaaagcaagatactgacggcaaagaaaatggctttttagtcgccatggatgccgataaaaacacctatctcacggtagctttgattgaaggtaccggcagcggcgatgtggtgacggcgatgaagccttatgttgctagtctttattaggtttgaataacagtaaggatgacccccatggatgcaatgagctaccatcatttcaagcagtatcttaaagaccacctgaaataagtcaatgaagatgccatcccattagtcgtcactttcaagaatccagacgacaatgttgtggtgatgagcaaacgcgattttgacgctaacgaagaaacgatgtatctgcttaataacccagaactgatggcccgaattcgccgtggggacgggcaaattacggctggtaaagccaagcgccacgatctaccaaacgtataatcagggcgcggtagatcaattctcagttcaactaaaacaagaaagctggcaatcgtgtgaggtaagcacgactgccagctttcttgttttgattaaggtaggttttgatccagtgatttactcgttataacctcacttgattttcgctaacgccgcccgcacctcggtactatcccctgtcaagttgacacttataaaaacgaaaacacaatttttctcttggttggatccggatgctaactgaccgacgccggagctaagggttccggttttggattgtaaggttcccaagccattggttacctggtttgacccattggctaattgacccacaccactagctaattgggtggtgctgccattgagtgtttgcaagccgcttgcaacttgattggcgccgcttgcgagttggggaatctgtgaagacatcggcgagactttaactttcatggtctgaatcccgtcatttacctgtgaaacggcaacggtatactgatcaatcccatcgtcaagcttgacttgaccttcgtcgatttgcgtggcggcatcagcggcatttttcatgcctttgccaatggttttgatttgatcaaaaaccgcactggcgtaagcattggtcacatttgcccgaatctcgctgtttaaggcattcagaccgattcctgagatgacttggccgatgtaatttagcgaatcattggtttgatatttaagatccatttttcggggatgctcgtccagaatggtggcagcatttttcgaaaaatctttaggtagggtaatgaccgtgtaatacttgttggctttcattcccttatcagcttgggctttagaaacaaaatgccagccaagctttttgttattcttgagtttattgaccgtctgctcaccaacgttaagttttttaccttggtaagtaaccggctgatctaagttcaccacggctacgggtagattctgtgtatcaccataagggtcccaaacagactttaagaagaaaatgctgtaaagaaaaggaattaaaatgatgacaagcaccgaaactaagatcaatttatttttgccgatgaacttaaattcatctttgatcataagcactttactcctttatttcgtttagatacatgtccagcagagattcaaaagatgtgtcgcggctggctttattgtcaggtaaaaatcccatgacttccaaaacggtaaaaccaagcacactactaatgaaatcctggacaaaactttcttttgccatttgcttcagctccgtgtgcgcaatcagacgcttcagcaagttaataacatcgccggtgccttgcacaaatggactgctttctgggaattgatggacaaaataaataatttcatctaacgactgttgacgttcaaaatagcgatgagcgacttctgcaaaagcacggatcgcctctttgcctgagataccgctgacgttctctatcaactcttggtaaaggttatgcataaattcggtccccaacgcttcaatgactgccggtagattcggaaagtagttatatagcgactgagaacagatattcagttccttggccagcgtctgaaaggtcaagtcccgaataccgtcttgggcgaccatcgttcttgcagcatctaaaacaatttcccgatgtaaaatctgatgtttggttgtcatgcaagcctccttaaagctaatctatgttccaaagtacgaatatacgcctaccgattgaagcatgcaatctacaaaatgtagatcatgcccaaaaaatggcctaaaaaatttcgcggaaattgatgataatatccagttatacggcgcagtacattgagaaaaagaaaagtatctccgtttaagaaagttaggattcggtaaaatcaagtgacgagttcaagctgatttttgccagttgaaccagtatgatgattgatagaaagaacaagagtttgatattagaaaagagggacggtatggcaccatacacgattgaataaataagcgcgcccagtcgcgaacaattggatcaaattatgcggttatggttgcaggggaatttacaggcccaccagtttattcacgctgaatattggaaaagtaatgctcctctggtgcgccctttaattcagcaatcaacattgtgggttgtgcgcgaaggagcaacggtgattgctttttgtggcttgcaacaagacttcatcgccggcttttttgttgatgaaaaacggcgctacgatatttggagttgataggcagcttgcctaccagctcctttttctatcgccgtcacagcgttccagccccagctggccggagattgcggagtttggcacggcaaggaaattttggcctagcatcttcctacgattatttggaatttaatgaatcacaagttctatgagggtaagatggctcaccctcttccgcatacaggtgatttttaattacttctggtgtccttcttcaggcagcaagatagtttgactctcgccgtcgtcgtaagccatgactgtgtcgggaaaactgggatcatacgggaacggcagatcaactgacatctccgttgccgcgccattttcactaaaatgaacggtcagcttcccctgattattctgcagatcgaaacgtaacaagttgtttagcggaacaaccccttgcagatttcgatcgatgatcatccaaatgctatcaatgatttcacctggcagattcgagatgacgccaaaagtcgcgaaacgactgtgatttgtctcaaacatacacgcgatctccttccttcagtcttgcgtggcaatatccgcaaattgtgcatcaacaaattgcgccaaaattttaggatcaatgccaactgagcgacccactttaccggcggaaacaatgatcgttgcctggccctcagcctcttgactgataaaaataggatacttatgccgttcgtgaatgccgatgggtgtgttagcaccatgctcgtaacctgtggttttcatgagatccttcagcggcaccatgcccactttgcggttaccagagaccttgcttagttttttataatcaacatgccgatcgagcggcacgacgccgaccaccggaccagttttgttgcccgtcaagaccagcgttttataaatctgatgttctggcacatccagatggtcaactgttagctgagcaacatcgcccacctcttcagtcggaaattcgtaaggcacataagcgatccccgctttgtccaacattttttcgaccaaggtcttttcaaccttattgtgatgtttagccatcgcgatccccctaaacgcgatcacagtcgcagcaatctgcgtgtaagaacctcgggtgcaataggcccaaacccggtcatcacgcccgaggccacttacacgccggtttctaagcgcgactgctcacgctcttgcttaaatgcgccaccttgcgtagcaacctacatgcatgtaaggaccttggtcgcaatggtcaaaagacggccatcacgcccaaggtcgcttacacgccagctgctaaccgcactggctcacgctctgtcttacgttaatcccgatgccacttaaaatactagggcattttgactgaaaataccactatcatgcgccagtgtatgacatcagcgtgaacatgtcatagtctttgatcttgtcgcggccgtgcaagttgcttagctcaatcaaaaaggcggtgccgacaacgatgccgccaagctgttcgaccaagcgaatcgtagcagcaatcgtgccgccggtggccaacagatcgtcgcaaactaggacacgttggccaggtttaatcgcatctttatgcaagtataaggtggcttcgccatattcaagatcgtagctggctttaacggttggccgtggcaacttcccttttttccgcgccggagcaaagccaatacccagcttgtacgccactggacagccaacaatgaatccgcgtgcttctgggccgacgatcatttcaacgcctttgtcctgtgcataagcagcaatttcatctgtcgctgcagcataggctttgccatctgccatcaaaggtgaaatatcacgaaaaataatccctggttcagggtaatcttgcacactggcaatgtaatctttaaagttgatggtcatgattctacctcactgtctgaatgctccgtcagcaacatggtttcaagctgagcgcgcggcatggtctgtaactgttgcgccagatctagaaagactgcacgcgctgcataagccttcgccgtttgcagcggctttttcgccggggctgtgactggagaaataaaagcaccctctattgtaacaaaatcgagttcaaaaaacacctgaaccgccaagatcacttgatggacggttaaatggaccgccttagcaatcgctggaatgtgatgcttgtcgaacccaggatgggccttcagaaaacgcaacacgaccccaaattctgcccgcgtcggtatagcaaccaagcggcttggtgcgccgtaaaacatgacggcaacaggtggctgcacatactgcatcacctgatgcaacgcggcaacatcttttggcaagtcgactaaaactgcattcgctaaaggcgcttgaacctgagcagcgatggtcgttggcccaccaaaggaaaattgccgctcaaactgttgctttactttcgcatcaaaaaacacatacgtgcggctggctttgaactggccgccgtcaatcgttggcattcgccagtcaatgacttgcggctgtttgacttcatagtctttcaacatgagttgtagactggtatgaccttgccaagtgttttgatccagctgaaccgccaatttaacggcctgtgccgttgccagtgtttccgcagcatcaccatagccaaaaccaatcacattgatgccttggtcgatttgaaaacgcaggtgattgttttctttaccaatctgtttcacattttggatagcttgcggacgtactgagaagaccggttcgggattgccttgaccaaacggtgccaactgacggatcaattgatagtgatccaatgtcaaatcagcatcttccagcctcgttgcgataggcagcgttggtttcggaacagttttcagcattgttgccgcagctgcctccatctgcgcatgaatcgctggtaaatccgttgttttagctgtgagaccgactgccatatgatggccgccaaaatggaccatgtgttcctttgctggctctaaagctttgaaaagatgataagccttgatcgagcgacctgagcctttggcagtttcgccatcatctgcaatgttcataattaacgttggcttgcctgttgcttcgacaaccttgctggccacaatcccgacaaccccttcatgccaacctttactggccagcaataatgttttggccgcctggttttccggtgcctgtgccatcgtcaaagcttcctgagcgatctttgcaactaatccttgtcgttcctgatttagtttgccgacttgttcggccaactcagcagcaaggtcatcctcaaatgtcgtcagcaacgttacgccgggattcgcgtcgcccatccgcccaagtgcattcaaccgcggtccgatgacaaaaccgaccgttgtttcattcacagtttccggggcaacaccggcttcctttaaaatagccgcaagcccgacccgtggctgagtctggatcattttgagtcctaattgcgcaatcacccggttttcatcggttaagctgaccagatcagcaatggtacccaaagctgccaagtcaacgctttctaacggtggttcgcctaataaggccgttgcaaccttaaaggcaacgccagccccagaaagatcaccgaacggataatcgccatctggatgccgtggatgaacaacggccaccgcatgcggcaaatttgctggcaactcgtgatgatcggtcaccaccacatccatgcctgcagcctgtgccggatcgatgactgcggcaccagcaacaccgttatcaacggtgattaccaactgtgtgccagttttttgcaaataagcataaacttcggcattcggaccataaccatcggtgaagcgatcaggaataaatacatccggatcggcgcccagactttgcaaggtctcaagcatgatggcactgctggtcaacccatcaacatcgtaatcgccataaatcgtgattttttcattttgctcaattgccttcaaaatccgggcaacggctttatccatgtcatgcaaggcgaatggatcatgcaatcgactagtgtctgggtgcacgaacgcatcataatctgcctgatcattaatcccgcgttgcagcaacagggtcgctaaaaatggtgggacacccaatgtctcgctaagagcatgctcatcagctgctgcaggttgtggggcgagttgccattgatactgcgtcatatcgtctcgttcctttctaaccgatccagtataccagagaaagcttagcgaattaaccggtaagcctaagttatctttggcagatgctgactgacagtaacacaaacagaatgcgtatcggcatgacatgttattgtgtcggacattcaatgcaagccatccgtgcgactcattgaaaacgtgatataattaaattgtgaataagcccaactccagtcagcgacttaagatgtgtgatcagcttaagttggtcatgcgataaggaggaagcaccatggcaaaatctcaagaccaattcaatgaaaaggtcggtaaagaaattaacgtttctgacgaggccgtcgataaagcagctgcccaaatcgagaaagtcggttacgtcactgaaaaggacgttccggaaatgatcgatcgcgattacactcgggcattgtccaagaaggtttcggcaaaacttcacaaagacaatgacgatgattacttctacgaagagccttttgactatgaaaatggccgcattgcaaatatcatgtgggacatggataaaattaagacccgcgaagaagccatgaaaattttggctgatgaacttggccttaccgttcctaagattgtaatgcgcaaaaccgacgaacaggtcttctagtctggaggagtttcacagcttcagtttctgcagctgtggacgcggttcaactttaataaaacaaccggtatcctttgcggagccggtttttttgtgagcgcgaacaaaccacacttaaaagacggcgcgtaagtggtcttaaggcaaacggtcaaaaccgtggccttaattttcacaggtaagccttctgcaattgcgatcacgttatagcgataaccggcaacatcaggatagcagctagtgacaaggatttttcaaacacatcatcatgcaaccgccagcttattgtgtgataatgatgataaagaaaggatgtgaatgccatggctgaccaacaggaattagatgatttttttgcccacgccaaggctgctctagatttgcccgctaacacctatgaagatgcttatcaactcggcggtgcaaaatttgctgataaactcgctgcattggttagaaccggcaagaaaaccgcaacttcaagcggctttgagctgtatactattgaacaggatccgctactcaacgccggcgtctataatattgtcttgaatcgggcggataagcctgttgccttgactttcacggacaatgtttttgtgacgccatttatgaaagtgactgccgatattgctaaacgcgaaggagaagacgatcagtccttagctagttggcgtgaagtccatcaagcctttttcagtcaggaatatcaagcgaatggcattcaatttgatccagaatcatccatggtcgtggtcgaggaatttcatactgtgtacccagtcgttcaaacgaggtgaaagcaatgaatctcaagcatcgtacagcgatcacagaaaagaaagtcacgcaaaagctcgacgacatcccccatcccacacttgatgccacactctacttactcgttttcagcatcactgccatcggcggcctagtttcctatggcgcctatcagctctttaaaccggagcgaaagttagcccacaaagcaaaaacactcgttgatgaacatgaagatgaccaccaacacgaggcataaaaaaagcaggtcacaacggcctgctttttgcttgttttgaagaagaggtgggcaaatcaccaaggtctttgtttctatgaaaacagaactgcctatttaccttggctttcctcatcattcatcttcagaatactcataaacgcttcttgtggaacttccacagaccccactgatttcatccgcttcttacccgccttttgcttctctaaaagcttccgtttccgcgtgatgtcgccgccataacattttgcaagaacgtttttacggtaagccttcacagtgcttctggcaatgactttattgccaatcgcggcctgaatcggaatttcaaactgttgacgcggtatcgtggttttcagacgcgcaacaatggccttgccgcgttcgtaagcaaagtccttgtgcacgatggtactgagcgcatcgacaggatcgccattgagcaagatgtccatcttaaccagatcactttggcgatagccggtgatttcatagtccagactggcatatcccttcgtgctgctcttgagatcatcgaagaagtcgtaaatgatttctgaaagcggcaagttgtaaatcacattcacccgatacttgtctaaataatccatcgtcacaaactcgccgcgcttacgttgcgataactccatgactggcccgacataatcattaggtaccatgattgaggctttgacatacggttcgcgaatttctttgatttcgctaacttctggcatgtcagccgggttgtcgatcgttttttcagtgccatcggtcatgatgatttcataatccacacttggcgcggtcatgatcaagtcaaggtcgtaatcgcgttctagtcgctcttggacgacatccatatgcagcaaacctaagaacccacatcggaagccaaaaccaagcgcctgcgaagtttctggttcaaattccaaagccgcatcgttcaactgcagcttttcgagcgcctcgcgcaaatcgttaaacttggcattatcaactgggaaaaggcctgaatacaccattggcgtgattttgcgatagcccttcagcggcttttctgctggccgatccgctaaggtcaccgtatcacccacgcgagtatcctgaatggttttgatcgcagctgtgatatagccaacatctccgaccattagaaaatcacgtttgaccgctttaggcgacatcacgccgacttcggtcacttgaaattgcttgccattgctcatcagctgaatggtgtcgccgactttaacttggccttccttgacgcgcacatcaagcacaacgccacggtaatcgtcataaaccgagtcaaaaatcagtgcttgtaatggcgcattcaaatcgccagatggtgctggcacatcggtcacaatccgctcaagaatttcaggcacgcctaggccggttttaccactggtcaaaatagcatcggaggcatccagcccgatcatctcttcaatttcctctttaacgacatctggctgggcactcggtaaatcaaccttgttaatgaccgggatgatttcaaggtcatcatcgatcgctaaatagacgttggctaatgtctgggcttcgacgccttgggtggcatccacgaccagcaaggccccttcacaggccgccaaactgcggctgacttcatagctgaagtcaacatgtcccggtgtgtcaattagatgaaaaatataagtttcgccatttttagctttgtaatgcagttcaaccgcatttagtttaatggtgatgccacgttcacgttcaagtgccatatcgtctagcacctgcgcctgcatatcacgtttggcaatggtatcggtcaactccaaaattcgatcagcaagggtcgacttcccgtgatcaatgtgggcgatgatcgaaaaattgcggatatgcttttggcggtccagcatttcttcttgattcatgtttagtagtgcctactttctaagcgaatgtgatatgagttctattatagcagagcttggtgctgctcggtagaaacggcattagcgcgtgaacaaacacggataggtgccagaaccataagcgaccttcatgccgaatagtgctacgggaagctcagataccatcaaatacaaagaaatctgacggttcgtttttcttatagtgagctatctcgcttcggcgaacatcttgccaaacagcttcgtggtgctgcataccaagccgatgataaagtgttagcgtttgatcaaataaaggagctgcctcagattctgcgcattcgaacaacttaagccaacccgccatgaatggcagaaaaatcgaaatgtcagccaactcagcctttttcgcttctctttgagccaagtttagacattgagctgcctctgcaaaatgtgtttgggtaatgtaggctgtgatagcggtgaaatagacataaaacagctcgcgttgataacccggaatggcggccaaaagagccgacttgcgtttaacattgtcgatgaattgacggttgactgccaaaggaaaaagccgcgcactttgcttaaacaagcgcatttcatgcaacccccattgatcaacattttgtaaataataagcaatccctgacaagtacgggggatgtccgaaatgcgcatagccatggcgaatttgcaaaaaatgatccagttgaagactgtaacgtttttcattttgacgctcaagcatggttaagcgctggtcaatggcctcatgatcataaggatgcgacagtcgatcatagctgtagcgaataaggttcaagtaagcttcaatttgctgttcagagaccgacttggcggtgccggttcggattacttggaactcatcaaaactgacagcaatgcggtctagcaaatgaataaaccgctcagtcgaaatatgcagctgatcatgctcaaactgtgagatcaacgaaatagaattaacgtcatccgccacttgttttagcgttaatcctttactgcgtcgcaaacttcgaaaagtcgccccatactgcatatgacatcaccgcctcaactttttagcatactgaaattatagcaccgacacatgtcatcctcggtaccttattcattaagaggtgatcccgatgacattttttcaggaattattacggcttaaatggcggctggtgacctatattggcctatacggattgatgaccagtgccttaactgcgacagccatattgagcgggaatgcgatgacagcactcacgcattttcatcgcaccatgtttattgaggcggcacttttgctggttatggtgacaatcacccagcttgccttagcaacgttgaccaatattgaccaattcgtcctccagcgccatctcaacaacaatattcgccgccaactcgtcgccaatatcgctaaaatgtcctatctgacttatcatcgtcgcacggatgccgtttatacttcgtggctcaccaacgatatgaacacgatcaatcagcagggactgcgatatttttcttacatgattcaagctatctggcaggttctgcttagtgcgatcgtcttggtgaattatcaaattagttttttaccgactgttacattggcagctactgccctgttgacggtaccgctactctatcgcgaacgacttgctcgggctgctgctgagtttagctatcaaaacgagcgcctcaccaagaaaatcaccgatgttttggcaggatttgacaccttgttgatggctaatcgccaaatgctgttgatacaccagatcagtcacgcttctgatgaaaccggtcaggcaaatcttcactatatgcaatttgacatgttcacacaatttctcattaacttggtcaatttgacaagccaattagcacttttgattcaggcaggtctattggcctaccatcatcagctggcagttggtgccgttgtgacgatttacagtcttggcggttcaaccttcagtggcttaacgttgctgagcttctccttaacgaccctcaagtcagtcaagccgatttttaaaaagtttggggccgctgcaattaccttaccgagtactggacaaaagatcgggccactagcgcaagctttgaagatcaagcagcttgattttacttatggcaattgccgtgaaccaatcctccggcaacttaatctcactatttccgcattaacaaaaatagccgttgtcggtgcctctggtcgtggtaaaacgaccttagtcaaactattgaccggtttgttgcagccaactcacggcggtatttattgggatcagatgccttatcccgagattgatggtggttctttacgcaatcaaatcacttacattgatcaatcaccatacctttttaatgcaagcatccggttcaatatcacattaggtgatccttttactgatcgccagctcaatcaagtcttagcgctgtgtcggttaacgaccttcgtcgcaaatcagccacacggcctggagaccatcctcagtcagaatggcagcaatatttctggcggtcaaaaacaacgactggttttagcccgcggcttgattcgcaaccggcgtttggtcatcacagatgaaagcaccgctgccttggacgaacccacggccatcaaaattgagcaactgctcgtcacattgccaaatatcactttgatcatgatcacacatcatctgcattcacaaatcgctaagcaagtggatcggatcatcaaactgtgatgatggcttgtctccaccaaataatctaagattagttcatgtaaaggatgtcggtttccaactccttaccggatttttcttttctcccgttacactgtaaaattgggatattattcacaaccagcaaaaaggccaacaatttccaaagcggaattgttagcctttttctcatggataatttttattgggatttaaagatcccagtgccaaggcggagcaatcgcgccgtcacagcgttccagccccagctggccggagattgcggagtttggcacggctcaggactctttctacaaaactaatcgaaccttattttgaatatttctccgattccccacccgaaagttgcttcacaaatcttgccaccaatggattgtgcaacgcctcaggctgccaaacgagcgtcatgtgcgtcacccatggctcataatcaatcacggcaaggtgactttgctgactcgccaaggcggccatggtcgctgggactaacgccacccccatccccatctgggcccaatgcaacgccgtgcgcgcgtcatcacacaacacagcaattgtcggtgtgatgccatactcgacgaaagtggttttgaatagcgaactaaaccgacgatacacaatcagcggctgctgcttgaggtcgggaatggttagcgtggctggcaacggctgcgacgcggcagcaacggcgatcatgtggtcactgcttaggcgacatgaagctagaccgtcatcattaaatggcgttcggacgatggccaaatccagaatgttgcggcgtaacttgtcgaggatgccataagtgttgtcctcataaagcgcaaactcgacctgcggatagcggcgattaaaggcctgcaatttttgcttcggcaggacatcaccggccgaagaagtcagtcccagcgccagtgtgccaatctcaccttcaccgctacgccgcgctgcgttctcagctgccgcaaccgtctcaacgatctgttgtgcgtatgtcataaactgttggccgctaccagtgagtcggacaccgcgcgacccacgttcaaacaggcggacacccagttcatcttcaagtgctttcaattgataactcaacggcggctgcgccatgtgcaattgtttcgccgccgcagtcatctggccagcctccgctaccgctaaaaaataggtaatttgcttgagattcatcgcgattgatcccttcatttttaatcgtcagcttcgcaatccttcagctccactatacacaaattgtatggatagtacctcgaatatgtttttttatattgctcaccacgcgttacacttgagtcacaagcgtgtgatgaagcagctgataagttggtcagtcatgtcgacgacgtccaggaactgtttcgcaccaactaaaaattttgtcgttaatgttttgattcaggatgggatgattgaatgcttgcagatactcgcagttatcaagataaaagtcaggcagcagtgttaaagcaactcaacacgacaacggatggtctcacgagtaatgaagctaaaaagcgactagctcagtatggtccgaatgcgattcctgagcaaaagcgcaataacttgcttgatttcttaaagcgctattggggtccaatgccgtggttgttggaattggcgattgtactgaccttgattttaggccatgacactgaaagcatcatcatcttcgtattgctgacgattaatgcggtgattggctttgtccagtcgaacaattcgcaaaaagcggttgcccttttaaaaaagaagctggagattatggccactgttcgccgcgatcaggcttggcaagcactcgccgctagccaagttgtgcctggcgatatcgtgcaactgaaaattggcgccattgtcccagctgatcttgcgattatcgctggcaatgtcaccgtcgatcagtccgccctgaccggcgaatcgctgccagctactgccagtgctggcgacctgctttactctggcagcattgtcaaaagcggcgaagttcaggccgtcgtcttaaacaccggcacaacgacttacttcggtcaaacggtgacgttggtgaaaaccgccaagccaaagtcaaaacaagaagaactgatgctcgccattgtccgttatatgctctatcttggcattgccgcatcggtcattgtcgccatttacggcctttacctgcatgaaagtccggtttttattctgtccttcgtgctcattttcctgattggctccgtgccagtcgccttgcctgctgtcctaaccattgttcaggctgtcggggcaatggcactttccaaaaaaggcatcatcgtcagtcgcttgacgagcttggaagacgctgcttcaatcgatattttctgttttgataaaaccggcaccatcacccaaaacaaattgtcgatcattgcttgccaaccgctcaccggctatactgccgagcaactgttggatgctgcagggttagcggcagatcaagaacatccggatgcgattgaccaggcggtgctcaactatgccgccgaaatcaagcatcccctcgatttctctaaacggcagcagttcacgccgttcgattttgccaccaagcgcaccgaggcggtcatcacaacctctgatcaccggcaaatgcgggtcatcaaaggtgctgttccgacgattctggcgttatacgccaagcagcatcctgctgacactgcgcctgccagcgctgctattcaacaactagcaatcgccaacgccaaaaaaggttatcgttccctagctgtcgcaagcgtcgtcgattcgcaaatggcgttagtcggcgttttggcaatcgccgatccgccgcgagcggattcagcatccatgcttgcacggctaaaaaacttaggtatcaagccgatgatgatcaccggtgacagtgtaccgattgcccgtgatgttgccgaacaagttggcatcggcaccaaaattctaccagccaaagctttgaaaaccggcaccgcagccgataaaattcaattgattcatgaaagtgacgggtttgccaatgtttttccagatgacaagtatcaaatcgttaagttgttacaagaagatggccatctcgttggcatgaccggtgacggggtaaacgatgcccctgcgctgaaacaggcagagttagggaccgccgtcagcagcgccagtgatgttgccaaggcttcagccagcatcattttgacgcacccgggcttgcatgacatcatcgctgctatcacgaccagtcgccaaacttaccagcgtatgctgacttgggtcatcaacaaaatcaccaaagtcattgagatcattatcttgtttacactcggcttcttctggttaaaagtcagcctagtgtcgctgctggggatgtcgctgctcgtgttcgccaatgactttgcgaccatgtccatcgctaccgataatgtccagtcaactgccggtcctaatcaatggcgactcggcccgttaaccgcggcttccggcgttttgggcttgtggtttgccttagtcgacctcgtgatcgtttggttagggctaaatctgttccacctcagcttgccagtcttgcaaaccgctgttttaattggtttggtcttcaactcccagttccggctgctgatcgtccgggaacggagccacttctggacatcttggccaagccgcacactgctagctgtcaatcttttcacaattatcatctttgcactgttagccttgactggctggctcatgccggccatcagctcaccgcttttagtcaccattctgctactgacactggcagccacaatcgtgcttgatttccttaaagttgctgtctttcgttggttaaagattgcatgataatgcgtgctttgtttaccaaaaaaccaccgatccgcttcaaattcggactgatggtttttgtgtgcttttaaaataagcaatgactaattttcttgtccatgctgcttttcttccatgtgcgctttcgtcagcgcgtagatttccaaaacatggtcatccaccaaatgataataaatctgtttaccggagcgatcccccacaaccaaccgcgcttgtttgagcaggcgcagttggtgggaaaccgctgactgaccgaggtcgagcatggcggccagatcggtgaccgtaattggccccttggcaatagcaagaataatccgcatgcgggtcgggtcactcatggttttaaacacatcaagcacatcccgcaattcggcgtcactaggcaccgcgttctcattcatgtccgcattacgaacatcattagttgtcatagcactgcgctccttaagatacttatggcccattttaacagactttggtatcgaaaggcacttttcactgagggcggatgtcggcagttttcccttaagctctctgcggaattaacaagcgtaggccatttaagatgacaatcagcgtgctgccttcgtggaacatgacgccccaagcaatgttggtgagttgcaagacgtttaggacaaccagcatgacaacaacagccatggagagtagcaggttctcgatcacaatgcgattcattttagttgaaacttgatgggccaatgctaggcgtgaaaggtcattttcgactagaaccacatcggcgacatcaatggcgacatcagttcctgatcccatcgcgatgccaacctctgcattggctagggctggtgcatcattgaccccgtcgccgaccatggcaacgggccgcatggtggtctgcagctcacgaaccacggcaaccttttgttcgggcatcacattagcgaccacttgatcaatgcccaagtcggcggccacggcttcaccggtttgttgcgcatcccccgtgatcatcaccggttgaatgtcgtgccgtttaaggtaattaatggccgatttagcgctgctttttgcttgatccatcaaggcgatcaggccaacaaccctttgatcgaccgcaacgaaaacaacggttttgccttgcttactgagtgttgcggctcgcttgcgaaatgccgaatcaacttgcttgaatcgctgcggcttaccaatggtgtaagtgtgtccctgatactcagcggtcaagcctttgccaatttcgttatgcacatccgtgataggtacatcactttttgaataatggctcacaatcgcattcgccaacggatgattactttgcatttccattgccgtaataatctgagtcaaggcggcttcatccacatccgacacaaattcgctgtccgtcaccactggcacgccttccgtcaacgtcccggttttatcaaacgcaatggcttttaactgggtcagattagctaaatagctgccacctttaaaaagaaccccttgccgcgccagacttgaaatgcctgacaatgtggccggcaccgcgctggcggccaaggcacacggcgacacagccactaagaagacgatcgtgcgatagatgctggttgcccatgaccaatgaagtaaaaatggtcccgcaagtaaaacaatcggcaatacggccaataccgccttcacgtaaatcggctcaaaacgttgaatcacgctggctgttttggtcggggagtcttgggctgactgcaccatctggacaatcttagcaaaaactgtttcatcacttgacttggtaacccgcatatcaaaggttgacttgccgttgatggtcccaccaaaaacctcatcgccggtttgcttttcacggggaatgctttcaccgctgatcgcagcttcattgagactagcagtgccggcaataataacgccatccgtcggtacctgagcgccattcagaatctgtaattgatcaccgatgtttaatgctgtcactggtacaacttctaatgcaccggtgtcggtatagcgccgcgcttcttgaggcgccatagccagcagtgccgtaatttctttgcggctcttgttttcaacgtactcctccaaaaagtgcgcgccagcaaaaatcagaattagcatcgcggcctcttcaaaactgccaatcgcaatggcgccaagtgcagccaatgccatgagaagatgaatatttggcgaaaaacggcgccgttttctagttgcttgaatcgttgacatgataccttctgcaatcacttgataacccgcaacaatcgcggcaaaaaccaacaacgccgcgcgagctatcggttgggtgatgagtaagccgccaatgaaggtgatgacgccaagcatataaaaaataatggccttgttttttttcatctttgatcccgcccttacatttaatgttcatatgagcatatgttcatatatcatcttcaatataccgattttaagggacggtgtcaatcatgaaaataccttgattgcgacaatctccggccagatgggactggtagagcggagacgacgcttcgagcctcctctggccgacacttgctccgccttggcactgggctcttttagaatccaatgaatgatgtcctaatttgtcaaaaaaagagccaccagtgaattttcacctagcagctcttaaaaaatcgctattgaattatcaaatcgcggtgggtctagcgcgataccttatcccaaacattctcaaggacattggtttggtcacggtcagggccaactgagaaggtcagcaggtcaacaccaagtaattctgtgatgcgttcaacgtaacgccgcgcattttccggaagatcatccaaagttttggctttggtaatatcttcttgccaacctggcagttcttcatacactggcttgcattcactgaggaacttgagcgaagctgggtagttttcaacccgttcgccatcgcgttcgtaggcaacacagattttgactttgtccaaaccggttagcacatcaattgagttgaggcacagatccgtaatcccggcaacacggcgagaatgacgaacaacgacagcatcgaaccagccaatccgccgaggtcggccggtcacagtaccgaattcgtggccagcattgcgaatgaaatctccggttttatcgagcaattcagttgggaacggaccgtcaccaacgcgggaggtataagctttcgcaacccccacaacccgatcaatcttggaggcaccaacgccggcaccaaccgtcacaccgccagcagggttcgatgacgttacgaacggataggtcccttggtcaatatccagcataatcccttgcgcgccttcaaacaaaacgtgttcacctttgtcaatcgcgtcgttcaacacaattgaggtgtcgcaaacatactgtttcaattgttggccatattgataatattcttcaaaaatatcatcaaaattcatcggcgtactatcataaactttgacgaattcttcattcttagctttcaaattagctttgaggcgttcttcaaagatttctttgtcgagcaagtcagccatccgaatgccaactcgagcagccttgtccatataggctgggccgatgccgcgattggtcgtcccaatcttgtcggcgcccttggctgcttcctgcaatttatctaatttaatatgataaggcaaaatcacgtgagcacggtctgaaatccgcagattttcgccagtcacgccttgttctgcgagccgggccaattcaccgaccaagctcttaggattcacaacaacaccattaccgatcaccgataactgatgcgggtagagtacccctgatggtacgaggcgcagcttataaacctcgccatttgcatggatcgtatggcctgcattgtcaccgccttgataacggctgaccaccttggcgccttggctcaggaaatccgtaatcttccctttaccttcgtcgccccattgtgtaccgacaataactacagttcccattaactgatcgctcctcacggcttagtgcgggcatttttacccgccatctggtagtctaacaggatagcggtatgaaaacaagcaaaatccgaactttaaaaatgcaatttaagtcttccatctaaaaacacgaactttatttttaaatttgcaatgtttttcatctgaaaccgaagataagcggctcgtagcgaaaaaaaagatcgcccactttggggcaatctctgatcgtcacgctgtcaacgtccagcatttttcaattgtgtctcttgcaaatacgcaaagatgtggccaaaggcaatttcacgaatctgaccatagcgaatttgcgccgtttcgccatcatctggtccgactaggtttaagtcaaaatcggtttcaccgacattttccggatagcccagaaaatgttcatcgctgtcggctactttaatgcgcaccacccgttcaaacccagcggcctctgagatgatggtctgaatcaagtcatcatttggatcgaactcacgatcagcattcaacactggctgctggctgaagtgatgggtttgatcccatttttcgtaaaagctgatcgtttgcaaataatccgaggccgtcgctacattttggatgcttggtaacgtcagtaaaatgtagccaccaaactggccggccatgtctttaagactcaacaccacaacccggtcgttgaccgctttgacgcgacccacaaagaactggtcttccggtcccttgggtacgactgaaatcaagcgattgttcgccaaggcattctgaaacacgccagccagttgaccgtcattttggtacagcttggtggccacgtgctttagatgatcacgttgccggaccagttccgtttccagtttgagatcaaggccatggaattccatgactaaaatatccgagaaatcaacctgcaaggcgcgcacatcggtgtagttgaatttgttgaagatcgccatactaaagcgatcctcagccacagctgttacctgtccttcaagataggcatcatcatcggccaccacgaccatgaccatttgaccattcgccttagcctgcgtcgccagttgctgaattaagttctgtgtcgcatcgaactgcaatggcttttcttggccttgcagcgtcaagaaatgctgggcctgtgccaagttaattcgaaaattcatgctatcgagatcatccccggcaaattcaacctgatcaatcgcagaaaatgcgatcaaggcacatccatcggcaatccctgaatcattgtaggttcccagaacaaccgcatcatgacctaacacctgtacgtaccggtgtaaaaatcgtcggtatcgcgctgatacacattgatcagcaggtgttcattgagtgctgtcattaaactcatcaaaatggcatccatgcggcatccctcactttcttgcgcttaaatctaaaaataactttctaatctttcttgctaatgttttattgatccggaccattataggcaatattcgtaaacttgttatacgacttcacaaacaacaacttgacggtaccacgcgggcctgaacggtttttctcaatgatgacttcaacttcaccaacattgtcatccccgtcatcattgccgccttgatcgtcgtcatcctcatcgccttctgcatcgcggtaatagtcatcacgatacaggaaagccacaatatcggcatcctgttcgatcgaaccggattcacgaatatcgctcaacaccggccgcttatcctgtcgctgttcaacgccacgactcagctgggacaacgcaatcacgggtacatgcaattccttcgccagttttttcagctgccgggaaacggcgctgacttcctgttggcggttttcttggccagaaccttcaatcaactgcaaataatcaatgataatcagccctaaatcaccttgctcacgcgctagccgccgacacttcgcgcgaatctccgccattctgatgcctggcgtgtcatccatatagatcttcgccttactcaagctacccatggcgataatcaagttttgccattcttcttcattcagctgaccagttcgcaggtgattagcatcaatactaccttctgaacacaacatccggtttaccagctgttcagcgcccatttccaaactgaaaatggcgacacttttgtctgttttcgtcccaacattttgggcaatgttcaaagcaaatgcggttttcccgacagcaggccgcgccgctaaaataatcatttcgtcctcatgcagccccgtcgtgattttgtccaaatcacggaaaccggttggcaacccggtgattgcctgatcattttgatacaactgatcaatctgcgccatagcctgattcagcacatctttgatctgtttgaagccggcctgattgcggttctccgagacatccataatctggcgctcagcgtcttcgactagcccttcaacatcgtcttgttccgtatagctgcgactggcaatgttttgcgccgtactaatcagtttgcgtaacgtgctcttctgctgcacgattttggcgtagtataccacgttactggcaataggcgtcgccgcaaccaaatctgtaatataaccaaccccgccaatatcgtcgaggttgttatgattgtccagataatccgacaccgtaaccgtatcaatcgctgtgccgttatcctgtagatcggtcatagcttggaacaacagccggtgtgctttcttatagaagtcatccgccgtgacatactcttgtgcatccggcaatgtgtcagcattcagaaaaatgccgccaaggacggcacgttctgcttcgtcactatgcggcggctgctggtcaattaattgattatccatgcgcgtcctccttcagattaatcgtcaaaaattttttgtcgcttatccctaacagtctacgttaaacccgcagtcaagacaagcgttttcacatcggcaacaaagccggctttcttacgctatctgccctcgtagacacatcaaaatgaggtgatcagcggtgacggaaaattaaaactaatgacgttgtccttttctcaaacaataaaatcgacgaccccttcatcattaaacgctctgaaggtttcgtcgatattgtttagagacaggaatcatcaaccactttcatagaaaacggttaagatcgcctgcttttaactatgcttgctgaaacaccaagctgatcacactgttcacttgcgggttcagtgtcaaagttgtcgttgtcacggctgccccatccttcaataccttcgttaaggtataaccggctggtgctgtgctcattaagtcgctgactttgatggtcagtgcgttccctgttgccaaaacaaacttcggtgatgttcccggtacattcgcaccattgcccaaaacatagcgaatctggtagcccggtgcttgcccgactgtcaaggttgtactcttggctgcttctcgggcgaagccatagccatcaattgtccggaagtgaactgtatacgtctttggctcctatgctgtaattacggacaaaaatagtttgtgcgataattgacagatgagcgcgttatagttgagcgcgttatagttgagcgcgttatagttgagcgcgttataacggacaccaaacaaggaggaactttttgatgaaaaaaatgtccagtggtgaaattcgccaaatgtttctggatttctttaagagcaagggccatgcagtcgaaccgagtgcatcacttattcccgttgatgatccaactctgctttggattaattccggcgtggcaaccctaaaaaaatattttgacggatcagtagtgcctgacaatccccggatcaccaatgcccaaaaatcaattcggacgaacgatattgaaaatgtcggcaaaactgctcgtcatttgacgttctttgaaatgcttggcaacttttctgttggcgactacttcaaaaaagaagtcattccttgggcgtgggaactgctcacgagtccaaaatggtttggatttgatcctaaacggttatacgtcaccgtctatccaaaagataaggtcacgaaagaactttggcagaaaactggggtgcctgacgatcatattgtggaggcggaagacaatttctgggatatcggtgaaggtccttctggtcccgattccgaaattttctatgatcgcggccaacaattcaataatgtggctgaagatgatccagaaaattatcctggtggcgaaaattcgcgttatgtcgaaatctggaacatcgtcttttctgagttgaatcatttgccagatggccgatttgtggaacaaccgcataagaacattgatactggcatgggtttggagcgactggtggcggttattcaaggcacactcacgatttttgaaaccgatttgttcatgccaatcatcaaagcaacccagaaaataagtgctggcaagcgctatggtgtcagtgcgcaggatgatgtctcttttaaaatcatcgccgaccatgcgcgaacagtgacctttgcgatcggcgatggtgccttaccaagcaatgaaggccgcggctatgttttacgtcgattaattcgtcgggcggttctgaatggtaaaaagctgggcattgatcatgattttctatatcaattagtgccggttgttggtgagatcatgaagagttattacccacagattctggccaaccagcagtttattcaaaaggtcattgaatctgaagaagcacgcttccgccagactttggacgccggcgtgaccttgctcaatcagatcattgctgacttgaaacaagacggcaagaaagaaattcctggagcagatgcgtttaaactctttgacacctatggcttcccagttgaaatgaccaacgaatatgcgcaagatgaaggtttgcaagtcgacatggctggcttcaagaaaaacatggctgcgcagcgtgatcgggcccgcaaagcgcgtggtgatcgacagtccatgggcagtcaagataaagtgctgatgagcatcactacgccaagcaaatttactggctggaccgaattggatcataagcacgcctccttgcagaccattgtggtgaatgatcaactgcaagatagtgtcagtgaaggcaccgcccaactgatttttgacgagaccccattctatgctgaaatgggtggccaagtggcggaccacggcgaaatcaaggcccaagacggcacggtgttagctgacgtgagcgatgtgcagcatgcgccaaatggccaaaatctgcacaccgttacggtgaagggcaaactggaaacaggccagcaatactggctaagtgttgatccgctacgccgtaagaaagtatcactcaatcacacggcaactcacttgctggaccaagctttgcgtgatgttctgggtgagcacacacatcaggctggctctttggttgaaccggattacttgcgtttcgactttacgaattttggtcaagtaacgcctaagcaactacgccaagttgaaacgattgtgaaccagaaaatttgggacgctttaccgattacttggaaagaaatgccaattgaagaggccaaaaaacttggtgcgattgcgatgtttggcgacaaatatggttctgtcgtgcggattgtcaagattggcgattacaacaccgaattcgatggcgggactcatccaaccaactccaatgcactcggcttattcaagattacaagtgagtctgggattggcgccgggattcgtcgggtcgaagcggtcacatcaaaagaagcttacgaatatttgacccagcaacaggattggttgagcgaaactgctgagaatctaaagattgaccaagtcaaaaatgttccaagcaaagtgacccaattacaggcggatttaaaagccgaacaaaagacagtggctggcttacaggccaagttggcagcacaagcggcagcaggtatttttgatcatcctgaggaagtcggcggtttgaaactgattgccaaacaggttcaggtggccgggatgaatgaactccgacagttggcggataaatggaaagccaagcaggcatctgacattttggtactgggtaccgaagttagcggcaaggccaacttgttggttgctgtcaatgacacggctaaccaagcaggctttaaagcgggcgatttgatcaaggccattgcaccaaaagttggcggcggtggcggtggtcgtccagacatggcgcaggctggcgggaagaacccagctggcattcctgcggcgttgtctgaagcaaagacagtgattagccaaaaggcttagctgattaggccagatggtcaccatcgataatgaagcggcaagtttttggaaatttcgaaaacttgccgcttttacttgaccttttttctgagattggtgaagtcaatcacgcaaaggtgagcggtcatgttaaacttgagaaaacgatttcatcgaggtggggagtatgaacaggttgcggttgtcgttgactggcttttttggaccaaatgaacactatctggttgccgaacaacatgatggcatcaaaatcatatattcagttgatccgcgtgtttcaacacctatttttttacggaccattgcacaaaatcaaataggccattaaattagtcgataacgacgattggtagccgcgcagaacaaaaaatagcatttattcacttactattgctcaggaattgtacatttgcttgtatttcaagtaaaatggtctgtgaagcggatagaatagaggtgtaagaatgagcacattagatcaaaccgttcattttgattttcgagataacaatccgaagaatgttcacgaaacgctggagacagtttacaaggctcttgaagaaaaggggtataatccgatcaaccagattgtggggtatctgatttctggggacccggcctatattccacggtacaatgatgcgcgtaatctaatccggaaacatgagcgcgatgagatcattgaagagcttgttcgaaactatcttggcaaggagcaagcttaatgcgcttgatggggttggacgtcggttctcgaaccgttggggtcgcggtcagtgatcctttgggctggacagctcaaggtttggaaattattcggatcaacgaagacaaggagcagttcggcatcgcccgcctcaaggagcttgtgaagcaatatgaggtaacggcgtttgtattggggttgcctaaaaacatgaacaactcgattggaccgcgtgcggaaaagtcacaagcttacggtgaactgttgaaaacaacgtttgggttgccagttgatttcattgacgagcgactcacaacagttgaggcttcccgcatgttgattgaagaagctgatgccagtcgcaaacggcaaaagcaggtgatcgataaattagctgctcagatgattctccagaattatctggatgcaaaaggtcccttgaccaagcaataatcagggcaagtgatggcatgacctccgcccgtgttgaaggagaaacaagatggcaaataatgaacatgtaacgcccggcgaagacgatcagcagattacgctgattgacgaaaaaggcaatgaagaattgtatcaggtcttgttcacatttgattcggaagattatggcaagagttacgtattgctgtatccggcgagtgaaagtgacgatcaggaagtcgaaattcaggctttctcatttacccccgacgaaaatggcgatgccagctcgggcgatcttttcccgattgaagacgatgctgaatgggatatggttgaggaagttttgaacactttcttggccgacgacgattcgaatctgaaagattaagtcttaactcacggcatgtaagaccaccagaatattggtggtctttttgtagagcgcgagccagcccttacacgcaggtttatgggctggcgagcgcgtttacgagcgaagcgtaaattgccagcagcctaaaaagggagttaaagccggcccggttttgaactggcgagcatatgatgacgacaagcatcaccccacttaatattcgctggcaaaacagataaattgagctgtgtcgcaatcaaccccttatcctacttgccggctatggtagaatacactttgagagagtggaggcattcacgcaatgagcgaagaaaagcgtcgttttaaagccgtgatcggtgataaaacgtatacgattatcggaccagggtccgaacaacattttacaacggtcacgaagttgctgaatgagcggctggagcaagttaaaacactggcgccagatctatcggccgaggaacaagccattttagttgccttcaattctgtttccgatcaggtcaaactgttggcggcgcaacaggatgatcatgagcaggaagagtagtgggggaccgtgttgatttcattatcgattattttaattttggcctatttctattatagcggcgcgcgtcgtggtgcggcgttgcagtggttgcatgtggccggttatgggttgagctttcttgctgcaactgcacttgctcggccactgggggcgcattttactttggtagtgccttatccgtctgctacgaatgccggccagtttgcattttattcagataaagtcggcttgacgcttgataccgcattttatcgcggctttgcttttttagtcgtgctgacgtttggctggttattaactcgagtaggggcattgtggtttcacgacttgacatatgccgcaatgggtcatcgacgcagtgccattattggcggctgtgctaatttagtgattggttacatttttctgtttttgattttagccttgctggcattgattccgattgccggtattcaacatggcttagaccatgccatcgttgccaaggtcatgatcaaatattcgccagggctaacacaatttgtgaatgctttgtggctatgaatgttgatgacgctcagggacgatttatcacgtctttgagcgcttcttggttataggagcaattatttatgaatgaaaagattttaaagacccttgaatacgacaagattcagcaggcattgttgggtcaggtcgtgacagcaaatggccgccagctggtgcaggccatgcagccgctgaccgatccagtcgccgtacaacaggcactagatgaaaccgcagacggcgcatcggcgttgcgattaaaaggcggtattccggtgccgcaactcgagaatattgatccggcgcttaaacgagtcgacattggggccgttttgaatggtcaagaactagccagcatcagccgtgtcttgcaaacggtgagtgccattgataaatttttgactgatttacaggatcagattgattttcgccagctttacacacttcaagaatcgttaaccgtgttaccgcaattatcacggcgcttgaagacagccgttgatcctgatgggacattgaccgatgaggctagtcctcagctgcatggtgttcgtgaacagatcaaaagtattgaaggcgagatccgcggtaaaatgacaaattatactcgcggcgcccaatcaaagtatttaagtgacccgattgtgacgattcgggatgatcggtacgtgattccggttaaggctgagtatcgcgccaaatttggcggtgttgtccatgatcaaagtgcgaccggccaaaccttgtttattgaaccgcaagcaattgtcgccttgaataatcgactgcgtgaggcacaactggccgaggtagctgagattaaccgcatcttagccgaattgtctaatgaattagcgccttataccggtcaaatcaaggcgaatgcggcggttcttgggcattttgacttcatcaatgcgaaggcgaaattagccaaggcggaaaaagcgacagagccgttagtgtcggctgataatgacgtattgttgcgtgatgctcggcaccccttgatcgatccgcataaggtggttggcaacgatattccgttgggcgacaagtaccaagctatggttatcaccggcccgaataccggtgggaaaacaatcaccctcaaaacattaggactgttgcagttgatggggcagtccggattgtttattccagctgatgatgaaagtcgtatcggcattttcgatgaagtctttgcagatattggcgatgaacaatccattgagcaaaatttgtcgactttttctgcacatatggacaatattgttcatattctcaaacaattgtcacagaatagtttagtgctgtttgatgaacttggcgccggcactgatccgcaagaaggtgcggcgctggcgatcgcgatcttggacgcagtgggtgaagttggcgcgtatgtagttgccacgacccattatccggaattgaagttgtatgggtacaatacagcaaagacgattaacgcatcgatggaatttgacagcaaaacgctgcagccaacttatcgccttttggtcggggtacctgggcgctcaaatgcgtttgatatttctgcacgtttggggctgccgggcgttatcgttgagcgtgctaagtcaatgatcagctcggacagccatgagctgaataatatgatcagcgacttggaaaaacagcgaaaggcagcggaaaccgcttatgaagccgctcgtcgtcagctagccgatgcacagtctgtccatgacgagctagcggcagcctacaagaagttcacaacggaacgcgatgcccagttgcagcaggctaaggacaaggccaactcgttggttgacaaggcccaaacgaaggcagataaaatcatcaagcaactgcgccaaatgcaattgacgaatccgggaaccgtgaaagagaatcaattaattgctgccaaaacggcgcttaaacaattgcatcaagacgagccgcttcagaaaaatcgcatcttgcgccgtgaacgtgagaaacaggcattgcatgttggtgatgaggttaaagtggcaagttacgatcaaactggtaccttgctggagcaattcgataagaagcattggcaggttcaactaggcattttgaaaatgaaggtaccaactgatgagctggaaaaaatcaagccaagtaagcaatcagcggcgcaacgtccggttgtcaaagtaagtggcggcgggatgagcggcccatcgaccacgctggatttgcgcggcgagcggtatgatcaggcgatggcagatttggatcaatacattgatgccgccttattggccggttatccatctgtgacgattattcacggactgggcactggcgcgattcgcaacggggtgacccagtatcttaaacgcaatcggcaggttaaaacgtatggctttgcaccacaaaatgccggtggttcaggagctaccagcgtaaactttaagtagcaggtagttttttacacttgattgtgctatgatttagttacaaaaaataagaggagggatccgttcatggttcaagcagtaacagattcaaactacaagacggagaccgacactggcgtcaccctaacagatttttgggcgacttggtgcggcccttgccggatgcagagtccggtcatcgacaaattggcagaaagtcgcgatgacgttaaattcgtgaaaatggacgtcgacgccaatccagagacaccaaagtcttttggcattatggccattccaaccttggtcatcaaaaaagatggcgaggttgttgagaagcttgttggctatcaaaccaaggatcagttggagtcaaccttgaacaaatatacggcttaatgaataagtgaacagacacgcatcgacgctactggtcgatgcgtgtttttttgcactaaaacatgttgaatgggatgtcacttaagatgaagctgacaggcgttaatttcaaaacctaaaatattgaagattttcttgatgctgatgaattggtctaaaaataactaggatatcaatagttatgttaaaatttttctaagtcattgtgtgggttttgggacggtggcagcataattgttttacataccagtttcaaaaagggatagcttaggctccataacgcgttcggcaccgcagaaacctacgcataagaaccttggacgcaatggcccaagaccagccatcacgcccaaggccgcttatgcttcggtttctaaccgcggtggctcacgcttctcatattacgaaactgttagctcattgttacgcaattcgttggcgtcattttttctgaaaacctataatgaatgtgtaaataaaaacgtggggtggcatcatgttcgcaaaattaaaagctatgtgggagaatcccacttttcgatttattttttggaccattacgtattttcttatcttgttggtcttgatttatctctacggctacagcgggattaataacagtaaattcatttataacgagttctaaaagcgtgaattggcgcgactagaaaccggagcgccagtgaacgcgtctaaagaggaggagagccaatatgatcgataatgtgattactgcgatcgatcgggtcgccgcggaacattcaacgcgcgttgcttacgattatgaaggcacacagtacacttacgcacaattaaaagaaggtagcgatcgcttggcaggcttttttgctgaaaccttgcctgagcatgagccgatcattgtttacggcggtcagactttcgatatggtcgaggttttcttgggcctttccaagtctgggcatgcatacattccgattgatacccatagccccaatgagcggatcacgcaggtgcaggatgtcgcccatacaccggctatcatcgaagtagcgcctttgccgattgcggttccggatgttcagattattcgcgcaccagagttgcatgaagctgagaagacgcatgcacccattagttcattgcaacatgcggtcgttggcgatgacaattattatattattttcacaagcggcacaaccggcaaacctaaaggtgttcagatcagtcatgataacttgttgagttacgtgaactggaacatttccgattttggtctcaaggaaggcgttgtggccatgtcacagccaccctattcttttgacttgagtgtcatggatttgtacccgacattggttttgggcggtacgcttaaggcattgccaaaggaagtaacggacaatttcaaaacgttgttcgcaaccttacctaagctaggtttgaatgagtgggtatcaaccccgtcgtttgccgaaattgccttgcttgatcctaatttcaatcaagataattaccctgatttgacacatttcctgttctgtggtgaagaattggtcaataaaacggcgcaggagttgatcacccgttttccaaaggcaaccgtgtataacacatatggcccaaccgaaacgactgtggcggtcacaggaatagcaattacgcaggacattgtggatcaatatccgcgtttgccaattggttttgctaaaccggatacggaaattttcgttgtcgatgagcaaggcaatcaagtgtcagcgggtaccgaaggcgaattgatgattgttggaccaagtgtttcaaaggggtatcttaacaatcctgagaaaacggccaaagctttcttcaatgttggcagtcaacgcggctatcggtcaggcgatttagccacgatgactgaggatggcatgattttctatcgtggccgaactgactttcaggttaagctgcatggctatcgaatcgagcttgaagatgttgatcataacttaaatcaggtttcctacatcaaacaagcttcaacggtaccgcgctacaacaaggatcataaggttgctcaactgattgcttttgcagtggcgaagcccaatgacttcgaaagcgatatgaagctcactcaggcagtgaaagctgagctaggcaaaatggtgatggaatatatgatcccgcagcgcattatctatcgtgacaaattaccgctgacagccaacggcaaagtcgatcggaaagcgctgattgcagaggtaaatcattaatgctgaacttacaaccatatgagaatccgcaatactttgtttatctcatcattgctttactgccagttatcattggcatgttcaagggtttccggatgcactggtacgagagtcttttctcaatcgtttttctggtgatgatctttgatgccgataagtggccgcaaggtaaagcactgttgggatatgttgttttcaatctgctcttggtctatgcctacttcaagtatcgtacgcgagaaggatcaaaaaactcaacggcagtcttttatctcagcgtcattttgggcattgcccaattagtcgtagtcaaatttacaccgttgttccaacatcatgggtccattcttggatttttgggcatcagttatctgacatttcgggttgtcggtaccatcatggaaattcgggatgggtcaatcaaagatttgaacatgtggaaattcattcagtttctgctgttcttcccaacaatttccagtggtccaattgaccggtatcgccggtttatcaaagactatgatcgtgtccctgatccagagcattatgcccagttagttactaaggcaatgcattatttgatgcttggatttttgtacaagttcattcttgggtacatttttggaactttatggctcccatcggttgaacatatggccatggtcagtcgtaccggcgcatttctaggcttaagctggccggtcgtaggtgtgatgtatgcttactccttctatctgttctttgactttgctggttatagtttattcgccgttgcgatctcgtatttgatggggatcgaaacgccaatgaacttcaataaaccgtggatgtcatacaacattaaggatttttggaatcgttggcatatgagcctaagtttctggttccgggattatatctacatgcgttttgtcttctttatgatgaagcataagttgattaaatcacggatctggacagcctttgtcggctatctggtgttgttcctgattatgggtatctggcatggggaaacttggtattacatcacgtatggactattccatgcgatgttgatcaacttgacagacgcttggctgcggttcaagaagaagcacaaagacttcttcccgcacaacaaagcaacgcattactttgcgatcttcatgaccgctaatgctgtctgcttctcattcctgattttctcaggattcctagacacactctggttccattaaggtaacgttgttacaggcttgtcgctgtgatgacaagtcgcggattaaaaagaaagaggtacttaataatggctgacgaagcaattaaaaatggtgttttagatattttggcagatttaaccggttctgatgatgtgaagacaaatttggatctgaatctgtttgaaaccggcttgttagattcaatggggacggtacaactgttgttggaactgcaaagccagttcggcgtagaagcacctgtttctgaatttgatcgtagtcaatgggatacccctaacaaaatcatcgcaaaggtcgaacaagcacaatgaaaaaaccgatcgggaagatcctttggcgcggacttggcccgctgctgatcgctgtgatcctggtcgctgcgttgatgctcgtgccatttaagtttggccgcagcagccaagcaacgattagacaagcggccagctctatgtcggccaacgtgcttaaaggcgagaatatcaaaaatgaagccatggccgaaaactatgttccgtttatcgggtcatccgagctgtcgcggatggatgccttccatccttctgtcctggcacaaaagtatcatcgcaactatcggccattcttgatggggatggctggcacgcaggatctcacgcacttcttgtcgatcaatgcgttacaacatgtgaatgggaaaaaggcagtcatggtgttgtcaccgcaatggttcgttcccggcggggttcgcaaggcgcagtttgattacttcttttcgcctgcacaaatgacaaccttcttgttatcagcgaatcctaactcagaggctgatcgttatgctgctagtcgattgttgcaatttccatccgctgactctgatcgcatcgccaatgatgctttgaagaatattgcggcagggcagaagttatctgacagtcagtactggtatttgaaaaaaatcaaggaacccatgtctgaccatcaggatattttattctctcagctgttcttggataataatcaacctaagttaaccaaagcagccaagacgctaccaggtacttacgatgctgatgtattggatggtctggcaacacaggatgggatgaaggaaacgacgaacaacgcgtttgagttgaaaaatgatttctacaccaaacgggttaagcgtaatttgcctaaattaaagggctctcaggcaacatggagctatgtgaaatcacctgagtattcagatctacagttggtattgaacacgtatgcaaaaaagcacatggaggtactgttcgtcattccgccgatcaatgccaagtgggccgcttatactggtctggatctcgggatgattcaaaacacggttaccaagttaaagtatcaactgaagacccaaggttttaatcacgttcttgatttgagtcaagatggtgctcagccatacttcatggaagacacgattcacattggctggcgtggctggctgaagatggatcaaactgtccggccatttctcaaaaccaccaaggctgcacccgtgcactacaagctgaatgatgacttttatacaacgcgctggcagcagcgtagtgctaatggcttgaactaaaacttgtcgagattcaaaaagcatcatactcaaaaaggagtctaaacgtaagcaactgcttgcgtttagactccttttgattgagcagtaagcatgcaaacccaaaaataggacagtcaattatgatacgagtcttttagtctattttttggttggttggtgatcagtttccaagtcaatcagatgttcagctcgcggttgggtatcttgattatccatcacaacggtcagaacaacgttttgctcgcgacgttgaatcgcactgccgccttcgactgcaaaacctaaaacttgttgcagtgcttgcgccaagaaccctgcttctaattgaaaatcaggatcttcatatgtacgaattcgcgttgccacaacgtcaccagcgagtaaatattgccgttcctgccgcttttgtttgagcggggtgagcgcgccaaagccaacctgcgtgaacaattgcggaatggctgtctcatcgacaggcaacttagcagccaaatcgcgcccagcccaataaaggatgttgtgctgttcctcgccaagcatattcggcagcatgagatcacgcattgctgtcaacgcaaagaacgaaaccgagcctggaaggttcagcagggtggtatagtcagattttgccatgttgtgcctcctgtttctattcgtctagtatagcggaaaatccaaagcaaagcatgattttctcaacgcttgcaatttttaacaagaaaactcacaataaagtttcagagagcgtgagcagtcgcggttagaaaccggagcataagcggccttgaagctaaatggctgggctttggccatttagcttcaaggtccttatgtgcaggtttctgcgcctgcgaacgcgttttagcggatccgagggccattttgcgaccaaggtccttacacgcaaactctcggacctagaaatgcggctaaaaacgatctgtctcacacctctacagcttcacccaaagcccgtgaggcagaacattttaaaaagaatcctatgcagacattttggcaacatgaactactttgcttgccatccctgcaaacctgtttcaaaaggagaatatttcatgaacaagcaaccaatcggctttattgattctggtgtcggcgggctgacagtcgttaaagaggcgttgcatcagctgccagctgaaagcagtgtttatctgggcgatcaggctcgtttgccatatggcccgcgacctgccgaacaagtacaggcgtttacttggcagatggtcaatttcttgcttaaaaagcatattaaaatgctcgtcattgcctgcaatactgccaccgcagcggcattacccttaattaaggctaacttagacataccagtcatcggtgtgatcaaacccggcagtcgggcggcactgaaggcgacgcaaactggtcacatcgggattatcgccacagaaggcaccgttaaaagcggtgcttatgtgaaggctttacgcgcaaaggcgccgaagattcgactaactagtctggcggcccctaaatttgtctcattggtggaaagtaacgaagcccactcacccattgctaaacgggtggtggctgacaccttgcaaccattgctgcatgaagacattgacacgttaattttaggttgtacacattacccgattctgcgcccgttgattcaaaatgtgatgggtgatcaagtgaccttaattgattccggcgccgagactgtgaatgatgtttccatgctacttgattattttgatctagcaaacaacagcggcgacaccccaactcacgaatattacacaaccggggcaccatcaatgtttgacgaacttggcgaagcttggcttgaactgacggcgccgatgcacgccaaacatgtcaacattgaggctgaggcagaccacgctatggctacagtgcctgaagcaaagggtaaaacgattgtcgttgccagcaaaaatcaaggaaagattaaagaatttaaaacaatgtttgaacctgctggcatcacggtgaagagtctagccgactttccaagcgtgccaacagttgacgaaactggcacaacatttgaggagaacgcccgacaaaaagccgatcagtatgccaaagatttgcagttgccggtgattgcagatgattctgggttgatggtcgatgctttagacgggcaacctggtattcgctcagcccgttatgcaggcgatggtcacaacgatgcagctaacaatgccaaactattggcagccttggcagatgtcccggaagatgatcgaacagcgacttttcatactaccttggtgcttgctaaaccggatcatccggaagcagacttggtggtacatggtgatgtgagcggactaatcactgcgatcccacgtggcacagatggttttggctatgatccattcttttttgttccagcgttagggaagacaatggcggaaatgaccgctgaagaaaaaaatcaaattagtcatcgcgggaacgcaatgagggcacttgaagatgtttggcaaacatggttggaggcaaacggatgaaaattttagcagttagcgatacccacggtgatcgagagattctcacagctttgttgaaacaacagccgcatcttgatggctatttctatgccggtgactcagaattagccgctgatgatggcctttttcagcagtacgaggcagttgaaggcaacatggactatgatcctaattttcccatgcaaatcacgaccaccattcaaggtgtgacagtcttcatggcccatggacatcgttttggggttaattttggcctagataaactcatcgttgcgggcgaaggggttcatgctgatctgatcattttcgggcatacccatcagttgggtgtggaggaacatgcggggattgtgattcttaatcctggttctatcagccagccgcgtggccagtttgccaaccttggcggaacttatgccactgttgaatttactgcggataacgttcatgttgattttttgaagcgtgatggggcaatcgtgccagaattaagtcgtgatttttcaaggaagcacgattaaaaaagatctcactagcaggacgctgtcaattgacagtgatctgcaggtgagatctttttggctagcctttgatgaatagaactttgtaggtgaagacggctaagatggctgctaaaatcggagcaacaaccggtacccatgagtatccccagtcggagctacctttatgtttaagcggcagcagtgcatggagaatgcggggaccgaggtcacgggccgggttcaaggctggcccagttggtccacccagcgaggcaaccaaggtcgcgaccagaaaacccagtcccatgtgggcagtacccagattattttggaaaaaaggagccttggtaattccgagggcaccgataaaaagaatataggacccgatgaactcgttgacgaaaccgttaagcttgctcttggtggcgctgatcgtgctgaaggtgcctaaaacatgctgtgtattggttgtgagatcataatgcggtttgtaggccgcaaccaccaataactgaccgaacatggcaccagccatctgtaccgcaatatatggcaagacttctgaccatgggaacatgccagatgcagcgagtccaagggtaaaggcgggattgatgtgattgcctgaaatcgcgccaaacatcatcgcaggaatcatcaccccagcaccgtagcccacggcaatgagcaaccagtcagagccgttaccttttgtcccttttaaatcaacgttggctacagagccatttcccagtagcaccataatcgcggtgccaataaattcggcggctagacgcacgcctagatcgtatgtcatttgtttcctccaagtagttaaaataatacccaaaagcttatgaaagtataaatatagctgaaaatagtgtaccaactttttggggaaccgtccatttaaacgactagtaagcgtgggcaggtttctgtgcctgcgaatgcgctgctttgcgcattatcggacgaattcgatcgaaagatggttgaatcaattaaccaattgtccgtcttttgacggatggcagcgagtaacgtaagcgttaagatgaaataaagaagttgcctaaagctgaatttttatgcgtactcaggtaaaataggactgtcaataaaggagttgctcatatgttaaatccagtcattgccaatatgctgatcgaaaatcggcatcacttcatgatttcagccgacatggttgcaactgtgtctgaagacaatcctttgagtcatgcctttttggtattgaccaaggtgcggtatgcgaaaattcccgtcctcgatcatgattcaaaattcaaagggctcatctcactgccaatgattaccgagaccatgcttggccttgatcacatgagttttaattcactagatacaatgacagtcaaagatgtgatgcagacagaggtcgcgaccattgatgatccctacgacttggaaaatgtcctacatttgctcgtcgataacccattcattccggttgtccaagatggttactttactggcatcgtcacccgtcgtgaagttatgaaggggatcaataatattggtcacaacatagataagaattttcaattagaacccttaacagttacggtacctaaagaatcttaacttagaaaaaacgtcgcattgctaaaagcagggcgacgcttttttatatcagcgagcacattcagtgacagtcgtgatgccaaacttattttttctcgtcagcatctggtttgtctaagaaaatggtggcgagcacgccgatgacgaggctaatgacaaccatggcgatggcgccgaggtgaccagtggctggccaataaggggcgataccagcttcgataagaattacgactgctgccaagacaatgccgcaaactgcgtagtagacttgtgcttcaaaatgagccaataagtaggccatcaatttagctactgctatcagacctgctgcagccccaatcatgaacgggagcaacaaggcaactgatcccatcgcagtttgaaacgcgggccagttgccggatgcagcagcacgagcagcatcacccaactgacccacagcattgtaaaccgtaccgtattgatcaatcaccatcaacatgactgaaccagaaataccgggaattgccatcagtgaaactgcaaaaacaccggcaaaagccatgacgccagcatcgctgacacttgtcaaacgtttaatggcaatcagattctcagggtcagtaccaacaagcttagccagcccgtatatggcaacgaagccaaagaccactagtagtaagtaccaccatgaaaactttttggttgtcagtttacggtaaatgaacggaccgatacccagcactaaaccaataaagaagccatagcttggcagcggccagcgggtggtgacgaccagaaccgccttagtggaaagcaggatgccgatcacagcacccaacccgatcggtgtcaaaaaccgcatatttttttggggatcatcgcgaaaatggttgaccgcatttaacaatcggtcatagaggccaacgaccacagcaaaaatactgccagaaagtcctggaatgacaagtgcgatgccaataatggcacctttaacgaaatttagcataacatctccttttgaattgggttaagccgcttgatgataacgtgacaatggcacggtggttcatgaaccactttgcaagtttaacggcggtgtgacaacttttatgcctgcagaattcaaggcagcaacgtaggcgcctaagaaagtgcgttgcaggctcacttgttcgccattttcggcgtaaaaaagaacctgataggtgaaagcaccattcttttcttcagttagcccaagaatatcaggctcctcggtaatggttgtaaatttcggtaccaaatcttgattcacacgttcaatggttttccgaactagatcgagatcagcacttggggcaagcggcaatttaatcagcacctgcatattgcttcgcgaaaggttgctgacgatggtgatgttgcgattgggaatgaaattgacagtcccatcggaactcttcaccaccgtcgtccgcaaaccgacattggtcacggtaccagagatggtgccgagtttgacgacatccccgacatcaaattgtgcttctaaaaggatgaagaagccggtcacgacgtcgtttacaaatccctgtgccccaaaaccaactgccaaacccacaaccccagcaccggctaacagtgtccccactggtacgccgagaatcgataagatggcgtaaaggtagaagaagagtaccagatagaaaaaaacattcaccgataacgcatgaattgttttgacccgggtgcctgtcagatgtgcccgtcgttgatagcttttaaaggtgcgattgagcgcaaagcggccgagccggtacaaaattaaaaataagacggtgaaaaacagcaacgacagcactttgtcgataaaagtgcctacgattttatcccaatcgatggttgtaaaatatttcagccaaacgttggtttgctcgttgacggttgttgctgtgacgatcatgtgtatcacgtgactgcctcctttacattggcactattttaccagaatcggtgggtgtgtgctgggagatttggtttgagtgggcggtaagattctccgaaacgcgcaaaccggcgcagaaactttcacgtaaggatcttggatgcaatgaccccaaaccggtcatcacgcccaaggccacttacactccggtttctgaacggggctgctcgccaaaacgcgcaaaccggcgcagaaacttccacgtaaggaccttggacgcaatgacccaaaaccggtcatcacgcccaaggccgcttacgttccagtttctaagcgcgccggtttgcgctcttaatttttttgcaccgttcttgtcacgatgttatgattgttttaatcaactggtttgaaataggagggtgttggatgtcaggtggagagattgcttggattatcgcggctattgcgtttctgattattgcacttgcaattgcgattattgcggttcgtgtttctggtgtgacgaaagaagttaagggcacggttgccgagacgaataagacgttgaacacgatcaacggagagcttggcattttgacgaaggaagttgaaggtcttttggctaagagcaacaccctgcttgaggacgtgaacggtaaggtggcggcaattgaccccgtctttactgcgatcggcgaacttggtgagagtgtctccgatttgaatcaatcaacgcgcaatttaactgagcgtgttgcgcatggtgccaagaacggagccaaggcgaccgttgcggctcgtatgagtgccaaggcgttttcaatgttgacgaagaaaaaacataacgatcaatagcagggggaagaatcatggctaaaaaaggacattttttgcttggatttgtattcggtgccgctagtgccttagccaccacttatttattaacaccacaaacaagcgatgaattgaagcggcgtgtgaagcatgcttctgaagacttggcagatcgggcagttgattatttcgattatgccaaggaagctagcgctgactggaaacaaagtgccacagattttgttgatgaattgaagcgtaaaggcgacgatgctgatggttctaaagcattggcaaactatgatgctgcaaccgagcaattgcgtgatcaactgaatacggcaacagatacggactcatcagcagactttgatgatattgttcttgacggtaaaagtgcttttgcgcaagctaaagatgacgacgagggcagtgatacccgcaccgatgaagtgccagaaccagtagaaccagaagcagttgcaccagcgtcaactgataccgcatcggctagaagtgttgcacctgatgaaccgcaagcatctgcaacaaatgataagtaacagacatgcatcacttagtcacaattgatgcaaaaaaggcgacaaacggactgttcctatgattggagcaagacgtttgtcgcttttcgcatcagttattgtcaatttgccataatcggtggtacttcatagatcaggcaggttggggccctttgcagcaaccaaacgacgacttaattgccaaggtcgcagcaacgtctatggatcttttttaaaggagagaatatgctgaacagtgaacgtcaagcgcagatcaaggctgctttaagtacagccgctgagccgcttagtgcctcaagttttgcccggcagtttgccgtgagccgccagacaattgttggcgacattgcgttgttgcgcgcacaaggtgagccgattattgcaacgccacgagggtatatgttttctcgaccggccgcccatgagtttttgttgccttgcaaacatacgccggcacaaactgccgaagagttacagttgattcttgaaaatggcggatggatcgaggatgttttggttgagcatccgctttatggacaattgcgcggccagttgaacatccggacagtggctgacatgaaactgtttatgagtcggttgtcgcgctatcatggacgactgttgtcagaattgaccggtggcattcatttgcatacgattagcgttaaaaatgagcgcgatatgcccaaaatcaaagcagctttgcggcaggcggggatgctatatgaacaagtggagcagaggtagtctgatgccgctaaaaaagccgtccggaatctttccgggcagccttttttgtggcatatgaatacgactatattgcagttttttagacctgtcctagccgttaatgaccgtgaattcctttgaggtgtgggtaaatggttcgcagccggtttcggtgacatggacacagtcctcaatccgaacgccagcaacaccaggtacatagatgcccggttcgattgagaaacacattcctagctgcaacagcatatcgtttccttccatgattgatggaaattcatgtgtcgacatgccaatcccatgaccaagccgatggttaaagtaatcgccataaccagccttagtaatgatgtcgcgggcaatcttatcgagctcagatgctttcaaaccaggcttgacagccgccattgcggttaaattggcctctaaacagacatcgaaaatttcccgcggctcgccggtgacctgaccaaatgcaacagtacgggtggcatctgacatatagccatggttgtcagtcccaaggtcgaacaaaaccaactcgtttggttgaagcttggtgcccattggttcaccatgcggattggcagcgtcgacgccggcctgcacaatggtaccaaagctcatgtgcatgacgccttccttcatcatggcataatcgatttcagctgccacttcttgttctgtcgcgccagctttgatcgcgttaaagccggcttgaaaggcgcgatctgcctgggcaccagctgcttccatctgtttgatttctgacggtgtcttaatgagtcgctggttctcaatgaaccgggatgcgtcaactgggaaggtagcatccggaaattgtttcatgagagcttcaaatttgaagacagctagattatctttttcaattgccaattttgtcgggttcgctgtcaccgctttgatgtgattagccatgatggcaaatggatcttcgtgatcaagataaccgaagacttggtacggccagccagcttttttgacctcttcaatcgtcagctgaggggtgaataggaaaggatcgttgtcaggggtgacaatcaacgctgtgatgcgttcctcaggatcttgaaaaaagcctgtgtagtagttgatattgattgggtcgctaatgtaggccaggtccaacccttcttttgcaacccaagcttgcaaagcagctaaatgttcattcatattttttcctcctcaacgtgttcactggcgcagtaccatgcagacgcagtgcactttttaaccggactagctcgcgatctggcttaaaagtcatgcgccaatcaagcatcgtggtaaaatagcacaacttaaaactttagcttttagtatatcacgtgactagcttgatgggctttctgaaaaaggcggttgtgaaaatttcatgtaaaattcagtaaaacgcttgcattgctatttctattctgttactttggaatgtaaatagaacttcgtgatttcatcttttcacgactaaggagaaaatcaattggaaaagcaaacaattacaatttatgatgtcgcacgcgaggctaatgtctcaatggcgacagtgtctcgagtcgttaatggtaacccaaatgtgaaaccagctactcgcaagaaggttttggaagtgatcgaacggcttgattatcggccgaatgcagttgctcgtggtctggcaagcaagaagacgacaactgtcggggtaattatcccagatgtcacgaacatgttcttctcaagcttggcacgtgggattgatgatgttgccacgatgtacaagtacaatatcatcttggcgaactctgatgaaaacaatcaaaaagaagtcacggtgttaaacacattgttggctaaacaagtggatggtttgattttcatgggccatgaattgactgactcaattcgtgctgaattctcacgcagtaagacccctgttgtgcttgctggctcaatcgatcctgacgaacaggttggcagtgtcaacatcgattacgtggctgctgtcgaagaagccacgcgtcagttattggaaagcggcaacaagcgggttgctctggcgaccggttcattgacgcatccgatcaatgggcagttccggctcaagggttacaaacaggctctggaaaaggccggtgttgcttatgacgaaagcctgatttttgaaaatgagccaagctaccaagctggtttggccttgtttgataagttgcagaaagttggggcaacggcggttattgcaggtgatgacgagttagcagttggccttttggatggcgcaattgataagggcgttaaggtgccggacgactttgaaattatcaccagcaataacaccaaactgacggaaatgactcggccacaacttacttcgattgatcagccattgtatgatattggtgcggttgctatgcgcttgctgaccaagatgatgaataaagaagagatcgaggaaaagaccgttatgcttggcttcgatattttgaagcgtggttcaacgaaataatgccagcttttgtgagctgcttagcagacatgtaaagtaagcgtcacatagtgcagtacctataattgtcaaaatcctccctctatacttgattaaggcctagatgcttcacaaaagatctatcaactctacttgacgaagagcctatatgttttatttttctcagttcgtaaaaagcatcacccagacttaagactgctttaatgctggtttttaggcgccgctgtgcgcctcccgcttcggttgacaccttgcaccctagcacgtaaactaatagaggtgtaataatttaaaaaagcatcaaagattttgatcaaaatttgattgaatcgcttagatgatgcggaggtgaaatgatgagttcagtaacactggtctcaataaccctcgcagcagtcatcgctttagcggtcggtttattgatcggatttgcacttcaaaagaagctccaccagaacaatttggatcgagcgacgcagacagcagaaggcattattgaggccgctaaaaaagaagcagcgactttaaaaaaagaaaaactgctggaagcaaaagacgagaatcatcgctatcgaacccaacttgaagatgaattgaaagatcggcggacagaagtccagaagtcggaacatcgactgaatcagcgagaggatactttggatcggcgggacgatacgctagatcgcaaggaacaaagtcttgctgaccgggaagcaaatttgaacaagcggcagcaacagctagatgaacgtgaacaagatatctcttcagaaatcagtaaacagcacacagaacttgaacggatcgccgagttgactcatgaacaggctcggcagcagattcttgaccagacacaatcagaactgacgcatgaacgcgccgtgatgatcaaagaaagcgaagatgaagctaaggaagccgcggataagaaagctaaagtgctgatcgccgatgcgattcagcgcagcgcttctgacatcgttgccgaaacgacagtgaccgtggtgaacttgccaaatgacgacatgaaaggccgaatcatcggccgtgaaggtcgaaatattcggacacttgagactttgacaggtatcgatttgattattgatgataccccacaagccgttgttttgagcggctttgacccaattcgccgggaaatcgcgcgaattgctttggaaaaactcattcaagatggtcggatccatccagcacgaattgaggaaatggttgataaggcgcgcaaagaaatggacgaccggattcgtgaaattggtgaacaagccattttcgacgtcggtatccataatatgcatcccgatctgattaagattttgggccgattgcacttccgtacgagttacggtcagaacgttctggatcattcgattcaggtcgccaaactgactggtgtgatggctgctgaattaggagaagatgtcaccttagcgaaacgcgcggggttattacatgatataggcaaggcgcttgaccatgaagttgacggatctcacgttgaaattggggttgagctggcaacgaagtacaaggaaccaaagacggtcatcaacgccattgcatcgcatcatggtgacgttgaaccaaccagtgtcatttcggtactggttgccgcagcagatgcgatttcagctgcccgcccaggcgcgcggtcggaatcgcttgagaactatcttcatcgtttggagaaactagaagcaatcgccaacagtcatgctggcgtggatcatagtttcgctattcaagcaggtcgagaagtccgggtcatcgtccaaccggaaaagctctctgatgatcagagcgtcatcttggctcgtgatattcgcaatgaaattgaaaaagaactggagtatccaggccatatcaaagtcaccgtgattcgggagacaaggactgtggaatacgccaagtaaaaaacacagtacccaccagcacaaagttggtgggtactgtattttttatgctgttttagttcggacgttattgttagacagttagatgtcctcttagagcttaggctttgttggtaaagggacttcgcggtattgactggcgccaatggtaggcgaaaactgtccattcaagaaatcatttagggccgcgagcgtcgcctgcaaatgctcatcatctagatacagggtgatggtaacagcagtcccgtaatcagtgttcgcaattgacaaatgattggttgtcaaaaaatgctgaattggatcaaagtcagcgtaaggaatggtaaaagttacagctttttgtttaatgcgcaccacaatgccgatggtttcgatcgccgtgttggcattgcctgcatacgcccggatgagtccgccagcaccaagtttaatgccgccaaagtaacgagtcgtgacggctaccacatcacgcaagtcatgctgcaacaaagcctccagtgttggggcaccggcagttccagaaggctcgccattatcgcttgcgcgttgaatttgattggtatcgccaagaacataagcaaaaacattgtgggtagctttggcgttttcctttgatacttgcgcaatgacggccttggcatcgtcttcatccttgatacgcgcaagatgggtgatgaaacgcgattttttaatggtatttgtgtagttgccggtttgttggatggtaagatattgctctgacatgcgtaatctccttatgaggtgatcatgatgaattttgctggggcacaattgacagaaaacgaactgatgcgcttaaccgtttctaatatagcacaggccacatcactgccagcgttgattcaagaacacgggcgctggtgttgccaacgttgcggtgatcgaaagccagttcaattgcctgatgggcggttttattgttcagcttgcgtgagtttaggccgcttaacaaatcgtgatttgctttaccgctttgaacagccgcaccggcctgttggcgacggcttattaacgtggcacgggacattgacgcctgcccagcaaaaagcgtcaacagctttacaaacgagtgttacagcaggggctgatcatttgatttgggcagtgacaggtgctggcaaaaccgagatgctttttccgaccatttcacagatggtacaacaaggcaagcgcgtggctattgtttcgccgagaattgatgttattcgggagcttgcgccgcgactgcgaactgcctttgaaaccacgccaatcgccgttcgatatggcggtcattttgatcaaactgacagtgatttggtgctggccaccgtgcatcaattattacgatttcatcgggcttttgatctgattgtcgttgatgaggtcgatgcgtttccgatggcgggaacacccatgctccatcgggcggttcaaggtgcccggcgtggaccggttgtttatttaacggcaacgccggatcggccattgaaggcggcgatgcgtaaagggttgatggtcagtcgattgtttcgtcgatttcacgggcaccctttgccagttccagcgattcggttgatgaattttaaaaaattaccgtcccagttgccacctgccatcgtgaagtgggtgcgtgatgtcgtggcgacagggcggtcatgtttgctgtttgttcctaagatcagctgggcgcctcaaattgctgcgcttgttcaacgtaacgggctaagggtagctggcgttgctagcacggaccgtctacgggcagagaaaataacggcttttcgtcagcggcaaattcaggttttagttacgacgacaattttggaacgcggcgtaacggtgcccaggtgtgcggttggggtcgtggctgcagccgatcgggcattcacggcctcggcgcttgtacagattgctggtcgagccgggcgggcagccgatagtgccgacgatccggttgtctttttcacggatcgctatacgttagcattgttagcggccaaacgtcagattgtcatgatgaatggacggtgatggtgatgcgttgttgcgggtgtgatcgccatgttgatcgtagtccgacattgaaggcgttgttagctggcagcaagttgatagcaccccgattgtgcagtagttgtttagcccgctttaagatgattactggagcgacttgtccaggctgcggccggtcgggtgatgcacgaatatgcgcggattgccgccaatgggagcagcaagggcggttgttacataatcgggctttatttgtttatgacgcagctatgaaacaatggatttaccagtacaagggtcttggcgattatcgcttacacgatgcgtttcaagatctcattgctgcacaattgcaaaatgctgggacactggtcgccattcctagcgaatccaaacattatgatgtgcggggatttgatccaattcagggactttttggcggtttgcagctgcagccatggctacgtaaatcaccaacggccaaaccgcaggcgcagaaaaatcgtcgcgaacgattacaaacgccgcaaagctttaccgtacttgtgccagcagcaaagttgaatcaaaccaaacaaattacattggttgacgatttatataccacaggacggacattgtatcacgctcgcaatgcgcttgtggccgcgggatttcagggcacggtgaccgcatttactttaattcgctgaaatgtggcttttgttgtgtctggcgacaacattcgggtataatgaaattgaagattggaagggttttatcccaaccaatcgacgtgtaagtgtttattacacgtaggaaaggggagaagttttatgctcacatacaatgttcgtggcgaaaacatcgaagtcaccgaggccatcagaagttacgtggagaagcggattagcaaactgaacaagttcttcggaggttcggttactgcaacggcacacgtcaatttgaaggtttattccgataaaactgcaaaagttgaagtgaccatcccgttgtctttcttgaccctgcgtgctgaagaaaccagcccggatctttatgccagcatcgatctcgtgaccgacaagctggaacggcaggtacgcaagtttaagacaaagatcaatcgcaagtcacgtgaaaaaggctttggccaaatcgacattgatgcgactgcaccagctgaaccgaaaccagccgaagataatgataatctgacggctgttcgtactaagcgagtgtcgttgaagccgatggattcgcaagaagccattctacagatggatatgttggggcacaacttctttatctttgaagatgctgacaccaatggcacaagcattgtttataagcggcgtgacgggcgttatggcttgatcgaaaccgacgaataagcagttcttaaaacaaaaaacaagatcgccgcaaaaggtgatcttgttttttgttgggaaagtttgccatatggacttattgctggtaagtttttattaaagtttaatgacaatatacaaattggggcctggtatatgaacttgcaggcagtggagattgaggcgctatcgtgctggtattcagttgttgttttgaacggcatcggcgtgcgctcgtcgatgtggatgatgcaagatctttgtactgctcggttttcaatacccaatgaaaatgttaagatactatagatatactgtcagtttaacgaagtttcgacagagaggaatccattcatggccaatattcttagaaaatgggtcgaaagcgataagcgagaaatcgcacgcctaggcaaaattgctgataaggttcagcaatatgaagatgagtatgcagcattatctgatgaacaattaaaagcaaacacaccaaaattaaaagatcgtctcgcagctggtgctacccttgatgacattctgccagaagcctttgcgactgcgcgggaaggtgccaagcgtgttttaggtctattcccgttccgagtccaaattattggcgggattgtgttgcatgaaggcaacattgcggagatgaagaccggtgaagggaaaactttaaccgcaaccatgcctgtttatttgaacgcactcactggtaaaggtgttcatgttgtcacggtcaatgagtacctgtcaacccgtgatgccacggaaatgggcgagctatacaactggcttggcttgagcgtagggttaaacctcaattccaagaacagtgatgaaaaacgagaagcttataattgcgacattacctattccacgaacagtgaactcgggtttgactatctgcgtgacaacatggttgtttacaaagagcagatggtccagcggccactgaattttgcaatcgtcgatgaagttgactctattttgattgatgaggcgcgaaccccattgatcatttctggcggcgcagaaaaaacaaccggtctttacattcgtgccgatcggtttgtcaagacgctaaaagcggagaccgattacaagatcgactggccaacgaagacaatctcgttaactgaaagcggcatccggaaggctgaaaagaatttcggactggataatctgtatgacaccgaaaatacggccttaacccatcatattgatcaggccttgcgggctaattacatcatgctcaaggatatcgattacatggtttccgatggtgaagtcctcattgttgatcagtttactggccgagcaatggaaggtcgccgatattctgacggcttgcatcaggcgattgaagccaaagaaggcgtccaaattcaggacgaaaataagacgatggctaacatcacttatcaaaacttcttccggatgtacaccaagttggccgggatgactgggaccgcaaagaccgagcaagaagaattccgagaaatttataacatggaagtcatctctgttccgaccaacaagccagttatccgggttgactcccccgacgtgctgtacccgacgttagatgctaagttcaacgcggttgttgaagacatcaaagcgcgtcatgaaaaaggccagccgatgctgattgggacggttgcgattgaatcgagtgaacggcttagtaagcaacttgatgaagccaagattccacataccgttttgaacgcgaagaatcactttaaagaagcagaaatcattatgaatgctggccaacgcggcgctgtgacgattgcgacgaacatggctgggcgtggtacggatatcaaacttggacctggtgtcaccgaacttggcggtttggcagttatcgggacggaacgccatgaaagtcgtcgaattgataatcagttgcgaggccgttcagggcgtcaaggcgatccaggctctacacagttttacctgagccttgaagatgatctgatgaaacgctttggttctgatcgaattaaagctatgttggatcgctttaaggtggcggatgatgatcaggtgattcaaagtcggatgatttcacggcaggtggagtcagcccagaaacgggtcgaagggaataactacgacacgcggaagaatacgctgcaatatgatgatgtgatgcgtgaacaacgcgaggtcatttacaagcagcggcagcaagtcatcaatgaacaggaaacgttgaagcctgtcttgatggctatgatcaatcgaacgattacacggattgttcagactcatacccaaggagatcagaaggactggaaccttgatgcattgtacgcttgggtcactgctaacatgattgatcctgagaaattcaaacgcagccagttagatggcaagtcgcaagacgagttgatcgggttactggccgagatggcggaaaccaacttccagcaaaagaataagcagctgggcgatgacgcgcagatgcttgaattcgaaaaagttgttattttgcgcgtggttgattctgcttggaccgatcatattgatgcgatggatcagttgcggcagtcgatcggattgcgcggttatggtcaaatgaatccgctagtcgaatatcaagaagaaggctaccggatgtttgaagaaatgattgcatcaattgatgatgatgtgactcggctgttcatgaaagctgaaattcgacaaaatattcgccgttaataacggcttagcgccccggcaccgcggctaaagcatgcggtactggggtgttttgaagcagtcgccgacgcacttagtcatgttacaataacgcaactatgtttaaaaaaagggagattacacgatggaactgagtgttatgcgcaacaccttggccgccatgcggaccaaaattaatcaatttagggggtcactttgacctcgatgcgctgaacgaacgcattactgaaaatgaaggccgaatggctgaacccggcttttgggatgactcggaggctgctcaaaaggttattgacaacaacaatgcgctcaaagaaaagcatgatcgattttatgcactagaaaatgagttggaagatcttgaggctggttttgagttattacaagacgagcctgataaggacttgcagcaagaagaagaagcaaagatcaaagatttacaggaaaagctggacaagtatgagatgcagcttttgctgaacggtccatacgatcacaacaatgccattttggaaattcaccctggtgcaggcggcacggaatctcaggattggggatcaatgctgatgcggatgtatcagcgttgggccaatcagaacggattcaaagtagaagtggcggattatcagcctggggatgaagctggcatcaagagcgtaacgctgctgatcaatggcgagaatgcttatggcttgctgaaaagtgaaaaaggcgtccatcgacttgtgcggatttcgccatttgattccgctggacggcgacacactagctttgcctcggtggacgtgatgccggaactcgacaactcagtcgaagttgatctgcggccggaagacatcaaaatggaggttttccgttcaagcggcgctggcggtcagcatatcaacaaaacctccagtgcggttcgcttgattcatctaccaaccggaatcgtcacctcaagtcaggcgcaacggtcacagtttcagaacaaagcgactgcgatggcgatgttaaaggctaaattgtatcagcgcgaagaagaagctaagcgtgctaaggccaaggccattcaaggcgaacaaaaagatgtcgcatttggttcacaaattcgctcttacgtctttcacccatacacgatggtgaaagatcatcgcacgaattatgaaaccggcaatggcaatgcggttatggacggggatttgaatccattcatcaatgcgtatctacaatgggaacttgcgcaaaagaatcctgattaaactgtaatctgcctgaaaccttgctgacttaatcgcctgctatactgatgctagcttagaaaaaggagcaatttgcatgattcaaatggagaacgtgacgaagcagtatgctaacggcgtgactgccattaaaaatctcaatcttgagattcatgatggcgagttcgtctatgtgatcggtcccagcggtgccgggaaatcgactttcgtcaaaatgctttaccatgaactaatgccaaccagcggtacaattaaaattgatgattttgattttgcaacaatgaaaccgagccgggtaccatttttgcgacgtcatattggtatcgtctttcaagattttaaacttttaccgcggttaacagtgtacgaaaacattgcttacgcgatgcaagtgatcgaagcacctgacgaaaaaatcaaggaccgagtcctcgaagtactggggctggtaggtctcgaacaaaaactgcgccgttttcctgatgaattatccggtggggaacaacaacgtgtgtcagttgctcgtgccatcgtcaacaagcctaaggtattgatcgccgacgaaccgacaggcaatttggatccacaaacatcagatgaaattgttgatattcttgagcggatcaatgccagtgggacaactgttattatggcgacgcataacaaggacatcgtaaatgagcgtcagcatcgcttacttgaaattgctggcggccgtttggttcgtgacgaagaaggaggcacttacggtaatgaagactaagatctttttccggcatgtaaaggattcgctgcgcagtctgaagcgaaatggctggatgtcagttgccgctgtcagtgccgttacagttaccttactattggtcggtattttcatggcacttattttcaacttgcatcatgtatcagagcaagttgaaaatgacgttcaagtgcgtgtttacatcgagaagaaaactacgacgaaacaacgtgatgcattaaagactcagctagaaaagcttgataatgtcaagaaagtgacttaccggtcacgtcagcaggaattgaacaccattgtcggcgggtatggttcgcaatggaaaatgttctctggcgatcagaacccattgagtgatgtcttcatggttaagacaagcaaccctaaggcgacgatcaaggtctccaaacaagctcaaaaactaaaccatgtggtggacgcaagttatggcggtcggactgcgaaaaaactgttcaactcagttgattcagcacaaaagtggggacttggttttactgtccttctgctgttcgtggcggttttcctgataagtaataccattcggattacgattctgtcgcgttctgacgaaatcagaattatgcgcctagttggggcaacaaattcatacattcgttggccatttattcttgaaggcgcttggactggattgttcggggctgtgttgccaattgtgattgttgacatcggttatgccgttgtttaccgcagcttcagcttatcaagcggctctaacggttattcgctatatggcacgatgccatttctgctttggcttgatttgatgctggcgggcattggtatcatcatcggtgcattaggcgcagtcatttcaatgcggcgtttcctcaaaatttaatcgtgcaatttgtgaactcatcctcgctaatgacggggatgagttttttgctatcatactcggctatgcgtgcctactcacattttgatttttatgacgttgtgggagcctccggcgatttctgctatactggtcacagtgaatattggagggttaccgatggcagttgtagttgccttacttatcaatccggttggtttggtgttttggctagcgctaggtttaacgatttggtttactgtcaatcgcactgatcgcgagcgccgccggtatctgcgcgcaattcatcccaaacatccagaaattggtcggttcttctggatcggacttgtcgtaggtgcgctagtctcgctggtgatggttattggacgactgcagatcagtttagctgctttgcttgcattaagcggcttgacgttagtagcattgctattttctaaatggcgatttagcccttggtggctaggtcttgccagtctggcggcagttggtcagtctggtttgctagctgaacagcatgcagctaatttagctattttggtcggcctattatggctaacacaagctggacttgcgagattcaaccgcggcgatgagatcgagtcgcctgtgattcaacaagaccgccgccagcggcaaagtgcggcgtttgagttgcggcaactgttctgggtgccgttaatcttacctgttgctgttgaaaacgtcagcaacctcccactgctggcggttacagtgcagtctttgacttttgtgggcttgccgttgcttttaggtgcgaccttcatgactccgcgagatcgcgctcagacggcttggcggcgaagttggccgtggtatggcggcgcaggtggcgtgcttatcatttatggcattgttgcccgcaccatgaccttgcctttgctggttagtcttgtctttccagcagtggtgagtttagtattggttggcggcttcatttggcagggacggcaggtgcatctgacggtgactttagccgatcaaggtgtggtgttgattggtgtcgtgccgcatacaccggctgcagagatgggcatacaacccggtgatcgtgtattggcctgcaatcaccattccgtgaacaattctcgtgagctttacgatgccattcaaaaagaaccaacctattgccgcttgcggcttcgacaggcagatggtgagctgcgattagctgagacggccatttttgccggtgccccacacgaacttggtatgattttatttccggaggagacagcatgaagaagatcttgattgttgatgacgaacctgcgattttgacgttgctgcaatataatttggaagctgaacactatcaggtcgaaacagcgacagatggtcaggaggctttggataaagtacgcaacgagccatttgactttatcatcctcgatttaatgctgccgagtctgagcggcttggatgttacccgcaaaattcgtgaagataaaattcagacgccgattatgatcttgactgccaaagacaatgaaaccgataaaattgttggcctagaactcggagcagatgactatgtgactaagccgttttcgccgcgggagatcattgctcggatcaaggcgattgaacgacggagtcagagtcagccgcaaaccagtcaaaaaccgggcaacagtgatcagatcacagttggccagatcgcgattgatccagaaaattataaggccagcaagggtggcaaacgtctgcagttgacgccaaaagaatttgagctactggtttactttgctcaacgtgttggcaagaccttgtctcgagatgctttattgaacggggtttggggattcgactatcccgcagagacgcgaatggtggatattcaggtcagccatttacgcgataaaattgaaacggatccgaaacatccggactatttaaagacagttcgcggtttcggataccaaatggaggcaccccatgaataaacgaatcattcggcgtgcactcatcattagtctgctatcattggcaggcttttttgtgcttgtgacaacggtgaatcaacaaattgtccatcaacaagcgcgtgatcttcggcgggtcggccggacgtatgcggcctcgagtcatgatggggtcaatcggcaagcattggcagagtcagaggcagccttcatcacggtcattcccaataatccgcggaccacgcgtcaaaaagtgatggctgatgccttgcgtggtaatcgggatgcagcatttgtaacaaccgtcaacgtgaatggtcgaacagagcaagcgtatttattccaaaataaagggcagtgggtggcagtcagccgctttaagtcaagtgtctggacaactgcaccagagcaattctggctcctaacgcttgcctttgcggcattgctcgctgccattctcatttggctttttcgatctgaacatcgttatcaagaagcgattgaagttatgagccataatctagatcgcatccgtcgaaagaaagacccagatccggtgattttaccgcctgattcaccttttgtaccagttgctcgccgcatcaatgcattggccgctgaacaagcccatctccgtgaaaaagtggcggtgcgtcaatcaagttttgatcggttgattgataacttgccattgggggtcatgctgattgacaccgataaagatgtcatcttgcataatcacgccatgtcgcagctgctaggtcatcaaatcccgcagccccgacacagctaccttgatgaagttaaaacttatgccttggcgcgcatgatcgagcacacttttcgccatgaaaaaacgcatcatcaggaactgacaattttgaccacgcaaaaatccgttgatgcttcggttattcctttgaatcaaggcatcagtcggttgcaggtgctggtgattctatatgatgtcacttacttgcgacaggttgaaaaaatgcaactggactttgtcgggaatgtcagccatgaattgaagaccccagtcacagctatttctggatttgcagagactttacttggcggtgcgaagagtgatccggcgaccttggacaggttcttagggattatttatgacgagagcaagcgattaacacaattaattaatgacattttgaccttgagtcgaccggattccaaccaaaatgtggctgcatcggttgctttgaaaaaattggtcgatgatgcattgcataatttggccaaagtgattcaagacaagcaaattcgcgttgaagtggcaattaccccggatctattggtcgtgactgacgagcgcaaattgacccaaatcgtgcgcaacttattgaacaacgcagtcttctacaatcgcttggctggtcatgtcacgatcagcgctcaggttgtcgatcatcagctgtcactggcagttgccgacactgggatcgggatttctgagacggaacaggcccggatcttcgaacgcttttaccgagtagataaggctcgcagtcgtcacaatggcggtaccggtctcggtttagcgattgtggccgaactggttaagagtatggatggtcatgttgcggttcacagccaagtaggggttgggtcaacgtttacggtcactttgcctgtgggtgagggcccgcacagaggatgaaaaaccgcagccatcatgcctttacacaatctttacattcaatgacatgaacatttacatgtaactgataaaataattggagcttgaaatggaggatttcgtgtgaaaaaaattgtgaccctgttgagcctgctgtttttgccactgttaatcagtgcttgcaacagcagcagtcaacagtcgggagaatcgatcaccgcagttggatcaagtgccttacagcccttggttgaagcggcgggtgaacaatatcagacggaacatttgggggtctttatcaacgtccaaggcggcgggagtggcacaggtttaagccagatccaacaaggtgctgtggacattggtaattcggatctttttgctgaagaaaaagctggtatcaaggccaaagcattggttgatcataaggtagcagttgtcgggatcgccccgattgtgaatccgaaggttggcgttaaaaacgtctcgatggcacagctacaaaaaatctttcttggcgaaatcaccaactggcagcagttgggcggcaaaaatgtgccgattgttctagtcaatcgagcgcaaggctcaggcacacgcgcgacttttgaaaaatgggtgatgcaaggcaaacagccaatggccgctcaggagcaggattctaccgggatggttcgacaaattgtcggcagtacgcctggtgccatttcttatgtggcgttttcgtacattgataaaacagttcaggggctctcagttgatggcgtcgcacccacggatgcaaatgtcacgaccaatcaatggcgcatttggtcgtacgaacatatgtatacgaaagggcagccaaaaggactcactaagaaatttttgtcttatgtgatgtcaccagctattcagaagaagcttgttttgaaaatgggttacgtcccgatgacacaaatgaaagtggttcgggacgcgaatggcaaagtgagcaagcagtaacctgtgatgttatcaagacacggtcagatccgttggctgtgtcaggtgtcggacagaagcgtgatctaatccggatagaaaccgatgttgtggtctttgccgggaaggttttagttagaaagcgcgtttaggaggtcaagatggatccaattcgggaagcaatgctcaaaaaatcgcgttcagctaagttagagcagcgtggtaaactgatcagtttgctttgtatcagtttaattgtgattgtggtggtggcaattttcttctttgtggcatcgaaaggactagctaccttctttcaaaacaagattaatctttggtcgtttctaagcaaaagtgtttggaatccgtcaatcaaagatgcgcacggcaatcccgaagttggcgccttgccaatgatcgtcggttcgtttggtgtgacattcctgtcagcaattattgcgacgccgtttgcggttggcgcaggtatttttatgactgagatttcccgtaaatggggacagaagattttgcaaccggtgattgaattgctggttgggattccatcggttgtttatgggttcatcggcctctccgtcatcgtgccttttattcgccacatttttggtggtactgggttcgggattttagctggtacttttgttttgttcgtcatgattttacccactgtgacatccatgaccgtggacgcgttaaaagctgttccacgacattatcgtgaagcgtcattagcattaggtgcaacacgctggcaaaccacgtatcgcgtggttctacgtgctgcgattccgggaattctgactgggattgtgtttgggatggcacgtgcctttggtgaagcactggcggttcagatggtgattgggaacgcagcgcttttaccgaaaaatttggtttctccagcttcgacactgacctctgtcttgacgagcggtattggcaacacagttatggggtcgctagataacaatgctttgtggtctctggcattgttgctgctcctcatgtcgctagcctttaatctgctgattcgctggatcgggaagaaaggggagttgaacaaatgaatccaaaagttgctgataaaatcgcaacgacggttttgtatatcgtctcaggtatcatcattatcatcttggctagccttcttggatacattctatttcaaggcttacctcacatctcctggcattttctgacaagtccggctcaaagctttgaggctggcggcgggatcggtatccagttgtttaactccttttatctcctgctgctcgcaatgttgatttccacgccaatttcattgggtgcagggatttacttgagcgaatatgctaagaaaaactggctgaccgatgtcattcggacgtccatcgaaatcttaagctcgctaccttccgtggtggttggtttattcggcttcttgattttcgtgttgcagttcaagtttggcttttcaattttgtccggtgccttggcgctgacggttttcaacctgccgttgttaacgcgtaacgtggaagactcgttgcgtggagttgagtatgagcagcgcgaagccggtctggcgcttggcttgtcacgttgggaaactgtcctgcatgttgtcattcctgaagcattgccaggtatcattactgggatgattctcggcgcagggcgtgtcttcggtgaagctgcggccctgatttatacagctggacaaagtgcgccagcattggattttaccgactggaatcctgctaatatcgcaagtccgcttaatcctttccgtccggccgaaacattagccgtgcatatttggaagatcaactcggaaggcattcagccagatgccgttgccgtctcggctggtgcaagtgcggtcttggttctggccgttctgctgtttaatctcggtgcgcgctactttggcaatcgcctgttcaaaaaaatgaccgcatcctaatgtgaatacgcacatgccattgcagtgaagttggtgatggtggtcataaagttggcgacaaaacgcttggaggctcacgatgcaagaacttgaaaaatattcattagatgacacttatattcgtccattcgatcgcgacaagcaggaaattgcgatcgaaacagagaatctacgcgttttttatggtgagaatgaagccattcataaggtctctttaccgtttgagcggtataagattacggcattaatcggcgccagcggttcagggaagtcgacttacttgcgctcgttgaatcgcatgaatgataatattgaaggtgcacgtgtcaccggcaagatcatgtatcgcaaccttgatatcaatagtgacgcggtggatgtctacgaaatgcgtaagcatattggtatggtctttcagcggcctaatccatttgccaaatctatttacgacaacattgcctttgccttacgtcgatttggattaaaagacaagcaaaaactcgacgagatagttgaaaccagtttgaagcaggcggcgctttgggaccaagtcaaagatgacttgaatcaaagtggcatgtcactttcgggggggcaggcgcagcgtttgtgtattgcccgcgcgattgcgatgaagcctgatattttgctgttagatgaaccagccagtgcgctggatccgatctcaacttcggcggttgaggataccttgatgtcattgaaggataagtatacgattatcatcgtcacacacaacatgcagcaggccgcccgaatcagtgattacacggcgttcttctacagcggaacggcgatcgaatatgatgaaacccgcaaaatctttacccggcctaagatcaaagcgacgaacgactatgtctccggacatttcggctaggaggaacacatggctgaagcaaaaaaaatcattaccagttcaaatgttcatcttttttatggcaaatttgaggctttaaaaggcatcgacctagacttcaatcagaatgaaattacggcgttaattgggccatctggctgtggtaagtcaacgtatttgcgaaccctgaatcggatgaatgatctcattccgggtgtcaccatcactggcaatgtcagtttgcggggcaataacatttattcgcccaatgaagatgtcgttcaattgcgaaaacaagtcggcatggtttttcaacaacctaatccatttcctttttcgatttatgaaaatgtcatctatggtttgcggctggcaggcgttaaggataaagccgttttagatgaagccgttgaaacgagtttgaagcaggcagcaatttgggacgaggttaaggatcacttgcatgaaagtgccttatcattgtcaggtggtcagcagcagcgggtctgcatcgctcgggtgttggccgttaaaccggatgtgattttgttagacgaaccaacaagcgcgcttgatccgatttcgagcacgcagatcgaaaatatgctgctggaattgcgtgatcagtatacgattattctggtaactcacagtatgcaccaggcctcgcggatttcagataaaacggctttcttcttgacgggtaatctgattgaatttgctgacacaaaacaaatgtttttaaatccaaaggaaaaggaaaccgaagattacattactggacgcttcggataggaggggtagtatgcgacgactttttgttgatgaattgaacgatcttcatgtgcgcttttcggaaatggggatgatggtcaacgaggccatctataagtccgtgaaagcattcatcaatcacgacaaggccctggcccgcgaagtgattcatgaagataagcatatcaatgaacgtgaagtagatttggaaaaacgcagcttcgaattgattgcactgcagcagccggttacgactgatttgcgggtgattgtgacggtcatgaaagccagctctgatttggaacggatgggtgatcatgcggtatcaattgctaaatctaccattcgggtcaagggtgagacccgggttcctcaaatcgaggaagatatcgctggcatggctgaagcggttaaagagatggtagaacaggttctggatgcgtatgtgaaggaagattctgctcgcgcccgtaagattgcgcttgaagaccatgggatcaatgacttttcatcacgaatctacaaggaatgtattcggcagatgcaggataatccagaaacggtgatcggatccatggattacatgctggtttcttcctatcttgaacgaattggcgattatgtcaccaatatctgtgaatggattgtttatctcaaaacagggaagattactgaattgaactcaaacgctattgaggataagttctgagaaaatgacgctcttgctggcttgcaagggtgactgaaaaagattgacattgattgttattttgaaagagggatgatttttacttttgtgaaaatcatccctcttttgatctctcatggatgacttactaatatctaaagatcccggtgccaaggcggagcaatcataggctagatggggttcagccgtgcaaacatcatcagctcagcgttgccagccccatctggctggcgactgtggatagattcctttttgatgaacgcgctgatgatgtgtctcatgtcaataaccagatgaatagatgcattactttcaagcgtccgtcttccgacccgttcaaaaatcaacctttggacctatgcgccccggcgcgaatccgtgcatactaatcatgtaatcaaatcctggagggataacccatgaatgaacgcgaaagaattttagacctagttaaaaaaggcgttatttcaagcgaagaggcgctggtacttttggaaaacctggcgaaacgtcaaggttcccagcaggccgctagcccggccgataacacagctcccgaagaaacttcggaaacgccgaatacggatgatgagcatgcaaccagtgacacggatcgcaatgaagcgctgacagaactcaacactgagattgctgaagcagcaggtgccttagatgctgctaccgcacaagttacaactattggtaaacaaatcgatgcgaacaacgaacagatcatcgtgctggacacgatggaagatctcgaagccctttccccggaaaaataccaaaagcgcggggatttgaaacaggagaatcagaaactgactgatcagttggccgaactaaaaggccaaattgagtctctgaaagcgaaccttgccggcttacgtcaccaaaagcatgatttagagcgtaagaagcttggcgacaagattttaaatgacgattggcaaaaagatgctcgcgatgctttttctgagtttggcaaaaacttgggtgatgcaaccacgcaactgggtgggttcgtgaaggatactgtcaacaatgttttggataacgttgactggaagaatgtcaccattacagtacccggtttagcaactgaaaaatttgaccatgttttcgattttccagatagtcaggcaacgattcttgatgtgaaagttgctaatggtgacgtgaagttcaagacttgggatcagccaggcattcaagttgctgctgcgatcaagttgtacggcaaaatggatgccgcatcgccgctggatgcgttcaaagaccggagccgcattgatgtcacggacgatcattttagcttccaagtaccaaacaagcgggttcaagctgatttggtcatctcattgccaaagcgcagttatgatcatgttgctgtccggttattaaatggcagtgcagacttaactggcattaccggtaaagatttctatgttaagagtacaaatggtcagatgaacttcactcatgttgatggtgttatgatcgagagtgaaggtgtcaacggctcaatcaaggttcaaggtggtcatacccatgacttgttgctcacaacagtgaatggcgatgtcagtgttgatgctgatccggcaacggccgccttaaagacagttaacgggactgtgcgagctacctatcacacggacttcacgacgcttgaaggcacttcgatgaacggcaatgttaaagtcgccgtcccgtcctccattgcgcttaacggcgaggttcggacgcattttggcagcatcaagagccgtttgagtgaggttgccgaaccagctaaggggattaagcgtctggaactgacgcgtcccgggactggcagtagtgaaatgaaactcaatacaaccagtggtaacattcaattaaaagattcaaatgactgaggggattgcttatgccttttctattaattccattaatgttctttatcattggcttgatcatcgtggcgatttttgccatcgggatattcctgctgaaacttctcattgtaccggccttactcatcatcttagctgtgtggctcttctcgcggcatgatcggtctgaccgttatgatcgtcggcgtccgcgtcacccttatcgtgatcgcgactcatctcggccccgaaaaaatgcaacgcatgtgaccgagtcgcatgacgatgactggagcgatttctaatgaacttcgtcaaacgcaccatcataacgacggcagttttcctgatttacgcgcaactgtttccggctcagctttatgtggcaggatttggcgttgcggtagtcggtgcattggtgctcggcgtcttgaatggtctgttgcgaccaattctagtgattctgtcgataccaatcacgattctgacactaggtttgttcctgatcgtgctgaatggtttgatgctaagcatgatgacttggttcgtaccaggcattgtgttcagcggtttcggcgctacgatgttgctggcggtcattatttccgtgttgaatatgatgtttgtcggcaaaaattaaagtgacgattgaaaatggcttgcgatctgcaggctatttttgggtgacttgaatgaactaaaggcttatcgttatcttccaacgaagagcacaatgtgaatgaccttttgcgaatgtttcaacctgctgaccataagggaaatcgacttatggtaaaatagagcaaatatggcgaaagaaaggtggacttcatggcagacagcgtgacagtgcggcagttggttaaggcaaccaagctcgaggtatacagcggcgaggagtatcttgatcagcggcaagtcgttttgagtgatatttcgcgtcccggcttggaactgactggctattttaattactatccacatgaacggattcaattgttcggtcgaacggaaatttcatttgcgcgaaacatgtcatccgaagaacgtttattgattttaaagcgcatggcaactgaagataccccagcatttttggtatcgagggggttggaggcgccggcagaaatgatcaccgcagcgacagcggctcatattcctgttttgggatcgcgtttgccgacgacgcgtttgtcgagtctgattaccgagtatttggatagtcagctggcggagaggcgcagtatgcatggggtgctagtcgatatttatgggctcggcgtgctgattaccggcgattctggtgtcggcaaatccgaaacagcgttggaattggttcagcgtgggcatcgcttgattgccgatgatcgggttgatgtttatcagcaggatgaacaaaccattgtcggggctgcaccgccgattctttcgcatctgctggaaattcgtggcttgggcattatcgatgtcatgaatcttttcggtgctggcgctgttcgtgaagatactactatttcattaatcgtccatcttgagaattggacaccagacaaaacctttgatcggcttggttctggggaacagacacaattaatttttgacgtgccagtgccaaaaatcacagtgccagttaaggtcgggcgtaacttggccatcatcattgaagtcgcagccatgaacttccgcgccaagtcaatgggctatgacgccaccaagacatttgaaaaaaatcttaatcatctgatcgagcataatgaagaaaccgaccagaacagttcgggggacaaataacttgttattagcacttaatccgatcgcttttcaattaggcggtctggaagttcattggtacggtatcattattgccagtgccgttctaattgcggtttatctagcgatgcgcgaagcacccaaacgcgggattaaggaagaccacattttgaatcttatcttgtgggcgttgccgtttgccttgatcggcgcacggctttactatgtggcgtttgaatggccttactatgccgctcatcccggcgagatcattgctatttggcatggcgggattgcgatttacggtgcattaatagccagtgtcatcgtttttgccatttattgtcgggtccaatggttgccagtttggcttgtcctcgatattgctgcaccaactgtgatgttggcgcaggcaattggtcgctggggcaacttcatgaatcaagaagcccatggtgctgtgaccacgttagcctatttacgcggcttgcatttgccagaatttatcattcagcagatgaacatcgggggggcatatcgtcaaccgacttttctgtatgaaagcatgtggaatctagtcggctttgctttgctcatgacggtgcgtcaccatgagcactggtttaagcaaggcgaagttgtgttgagttatgtgatgtggtacagctttggccgtttctttgttgaaggtatgcggaccgactcattgtatgtcatgcccggactgcgtgtttcacaattgttgtcgatcatcttatttgttgcagcggctggcttagtttggtatcggcggcggcaaggaaatgtggcatggtatttagacggcaatccgcttaaagcggtggaataggagtgattttgtgccaacgaaaatagcagtgttaggtgctggttcttggggcaccgtgctagccaatttattaactgaaaatggtcatgaagttgatttgtggagtcacaatccggatcaggtagccttgatgaagcggacgcatcaaaatgaacactatcttggtgctgagtttacattacagccggctttgcatgtgactgctgaccttggccaagccttggatcaagcggcggtcattttgtttgttgttccaaccaatgcgattcgcagcgtggccgagcaagttaaaccaattctgcaagctcataaagggcgcggtgaacaaccgattattgttcatgctgctaaaggacttgaacgtggcagtgagttgcgcatctcgcaagtgctcgcagaagtcttgccgaaggaattaattcaaggtattgttgtgatttccggcccgagtcacgccgaagatgccgccacccacgatattacaacgttaaccgtcgcttccgatgatttgaagttggcagaaaaagtgcagaagctgttcatgaatgattattttcggttgtataccaacacagacgtcattggcgttgaaattggtgccgctctgaaaaacgtgattgccattggcgctggtgccttgcacggtctcggctatggcgacaacaccaaagcggccttgatgactcgcggtttagctgaaatcagtcgggtcggcgtgaagctaggtgccgaaccgttgactttcatcggcttatccggtgtcggtgatctgattgtgacctgtacctcggtccacagtcgtaactggcgagccggcaacgcacttggacaaggtgaaaagttgccggatgtgttgaaaaacatggggatggtggttgaaggtgtctcaacgaccaaagttgcccatcaaatggcccgtgaacttgacgttgacatgccaatcacagacgcgatttatcaagtgctctgcgaaaacgcgccgattcgtactgtcattactgacttgatgaagcgttctggtaagccggaattcgattttgacaatgcgagtttacaaaaaccataaaaccatgtatattaaacagtatagcttactaattgtaagcaatatggcaaaaggagagactgcctatggcaaaaaaatatgatgtaatcgtgatcggtgccggcccaggtggtatgacggctgcactttatgcatcgcgtgccaatttatctgtgctgatgctggatcgcggcgtctatggcgggcagatgaacaacaccgctgaagttgaaaactatccgggtttcaagtcaatcctcgggccagatcttggtcagaaaatgtatgatggtgccacccaatttggtgctgagtatgcctatggcaatgtcgtcagcgttcaaaaccgcggtgccgtcaagctagtgaaaactgacgaggatgagtacgaggctaaagcgattgtcattgcgacaggcgcagagcataagaagttgggcgtaccgggcgaagaagcctacagcggccgtggcgtttcatactgtgctgtctgcgatggcgccttctttaaagatcgcgagttggccgttattggcggtggcgattccgcgattgaagaaggcctttacctggcacaaatggccaagaaggtcacagttattcatcgccgtgatcaattgcgtgctcagcagattatccagaagcgagcatttgccaatgataagatgcatttcgtctggaatgctcaggttcaggaaatccaaggtgacgatatgaaagtcaccggcgtgaagtaccgtgataaggaaactggcgaggaacatgttttgccagtcgccggggttttcatttatgttggcattatgccgatgactgaagccttccaagatttaggtgttctggatgagcatggttggattccaaccgacgagcatatgcggacaaaggttccaggcgttttcgcgatcggcgatgttcgcgccaaggacctgcggcagattaccacagctgttggtgaaggtggcacagctggacaaggcgtcttcaactatattcagagtttgaatgatacgaatattgagattaaagcttgatttgaaaacaggttgagatattactcatacccaacaagtaaaggccgacgatttccctctaccctggaaaattgttggcttttttcgtggataattttttgttggatttaaagatactagtgccaaggcgtagcaatcgtaggccagatggggctcagccgtgcgaacaacacagcgacggtctctggagctgatgttgttaggcgacttcgagaccggtcttactactccctgtacgacgggaatcgttggttaggatatcttgcttcttgggcaaccgtaccttacgaattacgattcttaaatgtgccttatgtcagccaattccgaccaattatggctccagacggatgtgcaccagcagcgctgagtatggcgttacaagccgttggcgttaatccatcactgtcttacttgatgaataacttgcctatggccggatcggttcctggtggtcaggctggtagtatttatggtggtgggttccagtatgttatcacgccagctgcattaaccgtttatgcccagaactgggataaaaatgctcggaatatttccggtgcatcaaccacacagattattgcagaggttgttacagggcatcctgttctgtattatggtttctcaccatatcaaaagagtggagactataatcgtaaccattgccatgtcattgcaggttttgatccaaaccgtggcttcgaaattatggatccaggttataatacgcagtttgatcgtgctggaagcgctggcgggaacagtcgctttgatcatggtcctgtttattggatctcactctcaagctttgaaagtgaatatgcgcatcagtatgggtccgaagcagttaaacgggcaattgcgttttaagcgtcagcttaggctgtgcttataaacttttaaagtgtgactaatccttcaaccaaaataataaataagtttgacacttgttttggggctactaggtgaaacttcttgaacaaagcatcagaggctcgcaaattgcgagccttttttgctagatgatattggggtaaagtaaaaatgaaaacgaataatgaaagaaactatggtatcgatttactacggattttttcaatggtatcggttgttattcttcataatctgtatcaaggtggtattttaccgcagttaaaaacaaataatccaaactggtggcaattttggttactggaaaacttggcaatagtagctgttaacgtttttgcgatgattacgggctatgtttccatgatgcatagatttaaaagtgatcgagttttgcaggtggtttttcagacaattttttggtcagtcactgtctcaataacgttatatcaactgagaatgccaatttccgtagaaacggttaaagctagtttctaccctcttgctcagttttggtatgttaatgcatatattggtctgtttttgctttcacctgttcttgcttttggtgtcaaacatgtttcgaggaggacttttaaacgtctgcttgtcgttttgcttattgtttcggcgggccttgatgccggcagtcactttttcctgctgaacggttatacagcttattggcttgtcgtgatgtacttggttggcgcttatatccagttatatcctgatgctattagatggaaaccagttgcttttctgggcatttatttcttaatggcttgtttgtcaacatatctacaatggaatgcaggatggtttcatactgataaatggtggtttattcgatatacttcgccatttgtaattgtggaagctatcgcgatctttgtttggggtgtacgattgcgaatcaagaatcgattattaagggcaatattgaaatttttcgccccaatttcctttggtgtttacttaatagatgagtcaaatttttatgatgttattctgccaagaatgttcacgagtatgattcgtgaacagccaacctattttgcacttagaatactgggtatttctttgttaatgtaccttgttttcgcattactagattttgtgcgtttattaatttttaaactacttcatattaatcaaggcttggcattgattgatcggtctggcaaatggttaatagacaaattgtagattttcaagctcactaaaatgttgctgaaaagctgttgaggtgggatgagtctctcgtcgataatttttttaatcggctaatttgtgagaccatcagcacttaatttttcatgattttaatggtctgggagacattcatttttggatttatctccttttcgaatcaattttaaaccatactttatccgattcatgttaaaatatttttgaaattgacggataaagatattgaggtggatcggtgagtcttcgcaaagttacaagagtatcggtggttttcttagcactattgttgatcgttggcggtatttatacaactacgcgttatttccacgatgaacaaattaaacgccatgctgttcgtattagtaagcaaaagtcaaagatagccgagtcacagcggcaagcatcaaaggagcgtttacgcactgcagcgagggtggctaaacatcgagagatggaaaaagttgcagcggccaaaatgggacagaatcacatcgaaagtgccaatcaatatgcttatccagttgcccaagtcaaacaagagatggatgcaccgtatacaagtccaattaaagagaaggtggtatttttaactttcgatgatggtccgaatacggttaattcgcctaaggttttggatattctcagtcaggctggcgttcatgggacttttttcgtcgttggcaagcaggttagtccagagacagcgccggttcttaaggcggaatatgatgctgggcatgcaattggattacatagcatgacgcacgattatagtttgctttatcctagtcgggtgggagccacggcagtaatcgagaatgaggcgaagagtgcccaagccgctgtccaacaggttttgggatcggattttcgcagtcatatttggcgatatccgggtggttatgttagctggaagggcttggctgccgcagatgtcgcgcttagtcggcttggtctcgattggattgattgggatgcggcagtcggcgatgcacttagtccggcgcaggagccgaagactgaggatgcgatgctgcaataccatctacgttccctgaatgtttatccggccagtaacgtgcgagttgtcttaatgcatgatgcccttggtaaggatctgacggttaaaacgttgccgcggatcattcaatattatcgtgacaatggttataaatttggcgttttggaataaagacgcagacaggtgtttctttaccggacagctagtggtgcgtctaaccagagcaacctagacaaaaagaaaagagcaccaacggcaatctgattgccgttggtgctcttcttttgtgctttcccagcaaaagggggttaaacttcttcttttacagcgaatcgggccaacttacctttttgtactgggttgacgacagcggtaatgagcgtgccatcttcgcggtagtcagtggccttgacgacagtttcctgattcagataactgacgagttgaccttgatcaaatgggatcaggtaggtgtgttcttcgtcttggccgaagatgtcggctttgatcagacgggtcagggcttccaacgagtttttatcacgggcggaatacacgatgcgttggccagtgacttcaggatagcgggtgccttcacgcaaatcggctttgttgtaagcttcgatcatcggaatattttcgatgccgacttctttcaacgtcttttcagtgatagccatcatttccggatagttttcgtcggagtagtccacgacttgaatcaaaagatcggcgttggctgcttcagcgagggtggctttaaaactgtcaatcaaattatgtggcagttttgagacgaagccgactgtgtcgctgagcaggaacttgcgattgtctggcaaggtgagttgccggacactggtgtccaaggtggcaaagagcatgtctttttcaaaaacttgtttgtcttccggacggtcggcaaaaagattgagtaagccattcatcgtggtgcttttgccagcgttggtgtaaccgactagtgcaacgacggggatgtcattaccttcgcgccgggcgcggcggacctgatcaccaacactcgcgtctttgagttcgcgacgcagatgactgatccgcttgttgagaacccgtcgatcaagttcaagttgcgtttcccctgaaccacgtgtggcaaaaccagcaccaccaccaacctgctgatcaagccggttggcgctgggatgcagccgcggtaacgcgtattgcagttgggcaatttcaacttgggttttggctgccttgctacgggcacgatcagcgaagatatctaggatcagctgggttcgatcaatcacgtgcagtttggtttgcttttcgagattacggagttgtgatggcgacagttcatcattgatgatgatagtcgttgcgtttttgacgtcagcaagttcgcgaatctcatcgactttgccactgccaaaataggtggcggctgcggcgcgatcgagactttggcgaacttcgccgacgacggtgtagttatccgctttggcaagttcgccgagttcggtcatggtgtaatcgaagtcgggctgctgacgcgagataccggtaattaaaacattttctgattgaggttcattggataattgttcagtcataaattcctttcattgatccgggcttggtcgccgcggatcggtgctagcagatcatcattcatggtgcgcctgacgtaaccgcatggcgattcacccctttcgattcattagaccaagtgtaacacggtagcccaaatctacccaacattcggtgccaggacctgaatatgatcgctaatcaccttcagcgtcaatggcgttttggtactaggatcgccgtcaatcctgctttgtaaggttttcggtgtcttgatggtcaactctttggttgcaaagtaggtcatgccgggcagtttttggaagttgccggtgatgaagtacgggattgctagtagtgatcgccacaaggtcagtttgggggcgaggaaaacgtgcagccgaccatcatcaggggcagcgtcagggacggcgttggtgaagccgccgactgagtttgtcatcgtgattaataggaactgcgtgtctttttgccacttaccatcggcgctatccaactgtaggatccaatgttgatgttgagccagaactttaaagcccttcatgaggtagatgatcgggccgaagtgttgtttttctttctgggtcacagataaagctgcatttgctaagacaccgagggtcaacgtgctgaccatgtagtgattattgacctgagcaacgtcgagtggctgtggggcagcttcaagaatgtttttgatggctaacggcaacagtaacggaatatgcaaaaccttggcgagattattaacggttccttcaggcaaaatggccaacagtggcggatttttgcgcggtgcgagaccagcgacaacttgattgatggtgccgtcaccaccgacagccaccacaatgtctgcttgggcgtgataggcgaactcgcgcgcgtcatcggcacttttggttggcgccatcgtgacctgatgctggcgatcttccagtttcgttttgagttgttcggcagcagttggtcctttagaatgcccggacgccgggttgtagataatcgtatagctgagcatggcggcacctcctattaactagtttatcacggtgaacgatagcacatgctggccggtgataattttaaggataaaaagacgaccgcctgtatgattttgacggtcgcagctagtgacgattcaatttaaaaacggttagtcagtgctaatttgacggcggccgttggcggtgactttggcaacgacaccaatgatgacgagatcaacgacaaaaatgatgctccattgcaagattggattgagatggttgagcaggttgacatgcatgccatatgtggcggcactgaccaatccgagcaaaatgatcacggtgaagccgagccaagttgttctgccaaatgcgagaccgtttctcgcttttcgttgacgttgggcgatccatggcatcaaaacaccaagggccaccatgccaatcggaacgacaatgtttaaaaccagcattaaagcgaacgtctccgcagtcgcatctgtcgggaagaagccaagcgtgccaagcaggaacgtaatccccaacatccagatcccaacgaataagccaaccttccgattttttagataagtataggctggcgtcgggaagcgatcctgatgtaagcgaaccatggtgtaagaccagaaaaggaagcaggttgacaacgggctgacaatgccattgaggttcaacaaccaattaaagatgtcgttgatttttggtagcaaagcacctaacgccatgatcaaagcacaaaggatcgtggtcatccaatagccgttgatcggcaagccgtcttcattcattttcgttaattgccgtggcataaagcgtttggcaacgtcagatagaaagacgcgggttgaagcgtcaagaataacagctagttgggccaacatgtagatgccttggacaacagcgaaaagatacatcaggctgttacctaatccaaactggcgaccgattgcctgaaaagcataataggaaccattcattttcaagtcattcggcaagtgatgagcgttgaaataaacgccgagcgagaaagtgccgaataatgtgagaaacatggtcatgatggcaatcattttcaatgccttggggaagtcgcgggctggatgacgcatgtctttggtgtatggcgctgcaagctcggagccattcatcgcaaaaacgaacaggccgaaagttgataagaaaccaagtgagaagaaatctttgggaataaaagctttgaaatcaaagggtcgcgtggcaattggtgcacctttggacaaaccgacaaaggtcatcaccacgaagagaacggtcatgataaacatcgcgccaccgccgatcgttgacatgatttccagacttttatttttgaagaaatgctgaagccagatgaagatgacgaaaatgacggcggtcagaattccaaaccaagcattgccaaggttggcttgaatgttgccattgccatttgcgatccagccaaatgagatgacgacagagttggcgacatcgacgacgtagggcaggccggtaatccagtagaaccaagccgcatagtagccgacagtgtcgccgtttgtttcacgcatccagctggtgatgccaccgccatgctcggaaaaagtcgagcccatgtgcgcgacaatcaggttgtaaggaatcacatagaagaaagtcatgatgatccaactggtgaaggcgaccagtccttgattctggaagttataaatgatgtcatcgaacccaatgactgtgacaaagtccatgaggccgacaaccacccaagggatatattgtttctgtggtttatctaattcattcatataaaaggctccttaaatatctgaaggtttaaaaacgactggtttttaaactcatccccggcgccttattacggagttttcccactgcgacccaactttcatgtatattttcaaaagccattagtgattatatcagggattgcggcggttttgcggcaaaaggtaaagaaagactaaagcagcttacaaagccgtaagttacaaacaaccatccgttaggccattatcaggaaaaaggcagcctaacccgctatcataaagtttgtaaacaaaacacaaagatacaaatggaggtctattatggacaagcaacctgtcgtaactgttgacaacgttacgaaaacctatggtaaaaaaggggaaaaacaaacacccgcattgaaaggtgtcagtttcgaagtacaacccggtgaattcgtcggcatcatgggcgcatcaggttcagggaaaacgaccttgcttaatatccttagtacgttagatacaccgacttctggctccgttttgatcaaaggtgctgacgtcacaaaattaaaaggggatgccttatcagattttcgagctaaaaaaatcggtttcattttccaagattttaatttgttggagaacctaactggccgcgaaaatattgccctaccgcttgagttgcaaaatgtgagtgcgaagaagcaggcggcagctgttgatagcattgcccaaacattaggaatcaatgaagtgctcgaccactatccaacggagttatctggtggtcaaaaacaacgagttgccgctgcccgggcgttggtgcagaagccagatatcctgttcggggatgagccgacgggtgctttggattccaagtcagcccgtgagttattggataccatggaacagttgaataaggaacaggatgtctctatcttgttggtcacccacgatccgttttcggctagttatgccagccgtattttgttcattaaagatgggcaaatcggttccgagctggtccatggtgataagagtcaggaagccttctatcaggagattcttgacacactcggcacatttcaaaagtaaggggcgtcgtctatgttaacgaaacttgcactcggcggcctgaagaaccgcttccgcgactatgcggttttattctccggtctggttatcgccagcgccgttttctacatgttcatgtcacttgccacaaacacaagctttttaaagaaaaattcaccgattggctttacaccatttatttttggtttcggtgcggtgctactggccattatcacgttggtttatatcgtttatgccaatagttttctacttagcatgcgccaacgcgactatgcgatgtttatgatgctcggtgcaaaagggcgaaagattgcgcaactgattttccttgaaaccgtggcaattggtcttttagcaacagttgccggcattttggtcgggatggtcggcacaacctttgtgggacaatggctcattaacaccctacacgcgccggcaaccggcttctcagcgttttggctgccagccgtattgtggacattaggcttcttcattgtcttattcattctgtcggcgttctataatgctggaaagctattgaaaaccccaatgttacggttgttgcatcaagcgcagacaccaaatcgaatcaaacaacgcaaaggaattttcgtcttacagattgtcttggtactgattttgcttgcggttggctactacagcatgtatgccatcgccaaaattgggattatggcgattccattggccttggttaccattgttctaggaacctatttcctgtttaactcagtctttgtcgcgctgattggcttattgaagcgaaaccacaagtttgcagccaaacagttgcatacgtttaccttgtcgcagctgagtttccggattcgggactatacccggattttatctgtggttgccatgctgtttgctttagctttaggggcgattactgttggccttggctttacgcatgatattccggatttggcgagtcaggcgaccgcctacgatttaacagttgcctcgccaaatgccgcgacccgtgcgcaaatcagtcggttgcaggatgtcactgctaagcaagactatacgattaaatcggatgccaaaacggtttacatcagccagcaagctctcgatgcccatccgcttgaaatcaaagcgaatgacggaggacttgatacgccgaatattaaagtcacgagccgcaactttgcggaaatggctgaacgttacccaagttcttttggtatttttatcggcaataatcgaggtaaacaaatgaaagtcgcagatgccgcgaccttcgcgaagctcgggaatgcagaaactttgaccacgtttaaagttaaggatttcggtcaaaattacgacacaattcagaaaattgtcgagctgcaaagcaagcaatatccgcgattatggagcagtaacggcgatcagaagtttatgatttatgcgctagtgaacagcatgttctctggtctcgcctttatgggtttcttcctcggcattgctttcctcggcatgttagcttcgacgctgatgttcaagattctatctggggccaattatgacaagagtcgttatctaatgttgcagaaaatcggggcacgaccgcgtgcattacgacgctcaattcggcaggaaatcggcgccctgttcttactcccaggtttcgttggcattatccacgtcttgtttggccttcagctttttaagaccatgttgcgcgcaccatacggtcatcttgcgttaccattcggtttgttcatcgttctgtatgcactctattatctggcgacagtttggatggaccagagcattgtgatcaataagagcttagcggaaaaagcctaaagaaaaaatcctttaggtcgcactgtaggctggaacataattctcagctgacaattaaaagcgaacaaattccctaatatcgggaagttgttcgcttttacctgttcatggattattattgtgattttaaagaccggagtttggcacggcaagaagttcgagcctaccatttttgttttcttgaaaaatagcagatttgaacgcttaaagttaaccggctaaaacgtcgtgtgcagacatctattgacaaatgaacaacataaaaatgctcttagagactggttttgtctgaaagggcatttttatttgctcgacaatacaaaagtggcaaaaagttcggtttggacaaactatgcttcaaactcgttataactcaatactttaatgccttcatcacttaaaagaattttactgatggagccgttgcgaggcgaatcggtgaccacatacccatcatttttgccgaacttatcgacgatgctgcgaatggtcgtgccgtggctgaccatcaggactttatcgccttcatggttttcggcccgcaactggcggaagcctttcatcagccgagtccagtaagtgcgcgcatcttcggcttcgtggaaaggatcagcatcgtgcatgaagtcttttgaggtgtcaaccccatatttttccaaaatttctggataggtcttggcaccatgcgggaagccgacttcataccaagttttgctagaatcttcaccctcaaaatagccataaaattgttcgcgaaagtattgggtgacggttagcggaatcttgccagtgacgtttttgctgagaatcagatcggccgtgcgagtagctcgcatggtgtcgctgcaataagcgtgtgtgaaggccacgttgcgtagaatgacacctgttttagtaccatctttaatcccattatcggttaatggcgagtcacaccaaccctgcattttattaaaatggttgaaccatgtctgaccatggcgcaccagatagactgtgatgcctttcattgtattcatctgcctcctcggaagttaattgctaagactagtttagcatagaaaagcatggtggttatgcttaaagagcatcttgaacaacgccgcaatcagtcccaacgtgtgctattctttaattattcagtggatcacatgcggaggtagcaagatggcaaaagggttgttgattgttaatttgggatcgccggtttcgccggagacaaaggatgtacggcggtatttacgggagtttttgagtgatcagaacgtcatcacaatgcctaaagccctgtggcaaccgattttgcgcggttttatattaccctttcgcagctggcggtcggcaactttctataagcatgagtggacccaagctggctcgccattgattgcctatacgcaggtgacccgggatcggcttcgcgagcggctgcctgactgggatgtgcagatggcgatgaactatggcggcgagtatccgattggcgaaacgctgcagacgatggcggcgcgtggtgatgcgccgattgtggtgatcccgctgtttcctgaatacacgcaaagtacgacgaagactattttggataaggtcgcggcttcaggcgtgaagaccgtggttattaaccgtttttatgatcattcagactatcaaaagattcttgcgcaacagattgacgatgcttatgaagcgggggcgtatgataccgttattctgagttatcatggcattccgacagcgatggtgcggcatggtgatccgtatcagcaggaatgtgaaacgaccacagcaggtgtgaagcagtatcttaagaaagtgccccagactaaggttgagatgtgttatcagtcaaagtttggcccggttccgtggttgaagccatatttacgcaatcggttgatggaactggctgctctgggtaagcgcaatgtgttagtcgcaactccgagttttgtggctgattgtttggaaacgctggaagaaaataatgtccagaattatcaaacatttcgtgctaatggcggcaaaaactttacgactgtccgaccgatgaatggttgcgagccgttttgtgactttttagctaagttggctgaggataagattgcggcggaggcgaaccatggcaaggcctgatgaacgcttaacagtgcaacgcgaaaaacgcagtcttgatgacattaaccgcagcgtgcaggtgccgagtgtttatgaatcttcgttttttcagaagtttctggcatacagcgggccgggtgccttggttgctgttggttatatggatccgggtaactggctaacggcacttgaagggggcagtcggtatcactacgccttgctatcggtactcttgatgtcgattttggtggccatgttcatgcaaacgctggcgattaaacttggcgtggtcgcacgattagatctggcgcaaacaattgccgcatttattccgcactggagccgcatctgcttatggttgatcaatgaggcggctatgatggccacggatatgactggcgttgtggggacggcgattgcgctaaaactactgtttggcctgcccttgatgtggggaatgctcctaaccatcgctgatgtgctggttgttttattattcttacaatttggcattcgccgaattgagttgattgtgctggtatcgattctcacagtcggcatcattttcggcattgaagttgcgcgagccgatccgtcaattggcgggattgctggcggttttgtgccacatacggacatcctgacgaatcatggcatgttgctgcttagtctcggcatcatgggcgccacgatcatgccacataacatttacttgcactcttcactagcccagagtcgcaaatacgacgagcatattccggcacaggtgaccgaggcgctgcggtttggtaagtgggattccaatgtgcatctagtcgccgcttttctgattaatgccttgctattgattcttggggcagcgttgttttatggcgtgggcggccatgtgacggcttttcaaggtgtctataatgggttgaaaaatccgatgattgttggcgggctggctagtccgttaatgagtacattattcgcatttgcgttgctcatcacgggcttgattagctcgattgcgagcaccttagcagggcaaattgtgatggaaggttatctgaacattcgcatgtcattgtgggagcggaggttgctgacgcgacttgtgacgctcattcccatcatggtgattggcttcatgatcggttttagcgaacacaactttgagcaagttattgtctatgcgcaggtgtcattgagcattgccttgccatttacgcttttcccgttggtggctttgacgaatcggcgtgatttgatgggtatccacgttaattcgcaactcgtgcggtgggtcggctattttctgacgggtgtgatcaccgttctaaatattcagctggccatttcagtctttgtttaaacgattatacgcaaaaatggccgcggtgatgtcatacctccattattgaggaacatcaccgtggccgtcttttgtatgtgtaagcttatcaagttaaaaagttgtcttttttcaatggctgcccttgatgacgaaaaaagatcgggtctaaactttctggtgttgagaaataatcaacactgaacgtgtaggccctttttggataagttgcccaagaagcaagatatcctaaccaacgattcccgtcgtacagggagtagtaggtggtcccattaacatgactatacttgccgctgacctgataaacaccgccatacaacgatgacgtatcacgggtcatattaaagaaagaactatacagtgctgcgtctgaagctgtaatgagcacgttggcgttatagttcatccaaaccccttgtgcttctttactctcgcttccaagtgctgaattgagataacccatccagttgccgctgccgtcataaagtgaataataagttgcaccattatagtgcttatattcgcccatgatccggaaggttctttgataatttgccgtggtcgtccgcccacctgcaaaactatccaagttcgtgtaaatcatttgaccactttgggtggttgtcaaataaccatcatgtggcaaccatagtccagctgcacttgatgtcgttttcacttgactagcatccacatagcccaaccacttgccacgtacgtcatagatcgaataataaacaacgccaccgaaggcatgatattgacccgaaatattaaccgtttggttaaccaatccagcacctgaagtagcgactttttgttgattaaagtccgcataggcattcacgtttgccgctgtaaaggtcgtataagcattagcaggcaaccatgccccgccatcagaaaccccagctgtgattgattgttgattgatataaccacgccagtttccatccttgtcatacagggacaaataggtcagaccgtttagattatggtacttaccggttgacttgaaggtctgcaacataacatctgttgccgcttgcttcttagtccaattaaagtctgagtacaaggtggctcggttatcagtaaccgtcacataacggtcatctgcctgccaagtgccttcagggttggcaatcgtcacattttgaacagccgcactatttacatagccaagccaatgaccgaataggtcaaagactgaataataaacagctccattgacatgatggtattggccaaccttcttaaagtactgctgatagtaatggtctgtactacccgtggcgtcaaacttaaaactattgtagatcgcatagttcttatccacgaccttagcataaccagaagctgctgcccaagcgccttcggcactattgaccgtttcgaaacctgaaccggccatatagccgagccagttgttatgactgtcatagagtgaatagtaaacttgaccatcaagatgatgataggccccagaaataaagtacgtattgtctaagacgtcatcacttttcttatggttgtattggccttcctgaagatagttcttaaaagatactagacaggttctaacaatacgaggaggcagtgccatgtcagaaacattcccgaaagccaccgaagttcggatggctgccaatttattagcaatcacttttgataacggtcagacccgctacatgcgctcccactttatgaaagattatttggatgcctggtcaccttcacgcggaaaagacaaacgttccaatttgctcgttgatccggcgtgggcatgggaaggcgcagatgcaaaaatttctgaagacggcaccttaacgcttttcgataaggatacgtatacacctgaagagctttggaagaacagtaaggaaaggattgatgaagtttctggcgtttaaagaactgttttagacgattattcattgatttagctcatcgttatcattatttcaatccaaaaatagaaagtagagagttggtggagcggcgatgggctcagtggtgagattggtctaagcggagtggttttctccgcttagaccaaggccgagcttcgagacagcgcgccgggcttgcgcgttggctcgaagtcgtgcccaccactttagctgcgcggtcgccaccccgaatcgccgcggagccaactcggattataagaaactatcgaccgagaatagaaaaatagtgctgcctgcaattgctccaaaacgcgatcgccaccccagaaaacctgcgtgtaaggacctcaggtttctacccggggtggctcacgctcttctctgcttgacacgtttttccgcgatgctatactaataaggaaattgaatcggtgatgagaaaaagggtcgcaacgaaacctattaaagcgagtcggggaaagtgtaagcctgataacggttgttgtgattggcgttttcgaaccaaatgatgaagccgcaggtagttttttctatctgaagtagggtggaaccgcgcataagcgtccctacgccattaattggcgtagggactttttcgtgtcccgaagccaatcccacttcaattcaccgggaaagaggcaatgatgacaaaaaaaatggacatccaaacgatgatcctaacactccaaaaattttggggtgacaagggctgtatgctcatgcaagcttacgacgtggaaaaaggggcggggacaatgagtccgtacactttcttacgcgccattggaccagaaccatggaatgctgcgtatgttgaaccgtctcgacgtccagctgacggccgatatggcgaaaaccccaaccggttgtttcagcatcatcaattccaagtcgttatgaaaccatctcctgaaaatattcaagaatattacttggattcgcttgctgcactcggcattaatccattggaacatgatattcggtttgttgaagataactgggaaaatccatccatgggctgtgccggtgttggttgggaagtttggcttgacggcatggaagtcagtcagtttacctacttccaagtggtcggtggacttgaagtatcgccagttaccagcgaaatcacttatggggtcgaacgacttgcctcctatattcaagatgtgaacagtgtctttgatcttgaatggggcgacggtgttttgtatggggatattttcaaggaacctgaatacgaacacagcaagtatgctttcgaagtcagcaatcaagagatgctgctgaagttcttcgacgcctatgaaaaggaagcttggcgtttgatggatctcggtctggttcatccagcttatgattacattcttaaatgcagccatacctttaatcttttggatgcccgaggagctgtctcggttaccgagcgggccggttacatgagcagcattcgcaagatggctcacaaagttgctcgggcatttgtggctgaacgcaagaagcttggcttcccattactgcaacatcaaacggaggtggaataacatgacgcatcaatatctgattgaaatcgggcttgaggacatgccggcgcatgtggtgacgccgagtttgcaacagtttcacgataaaaccgtcgcttttttgaaagaaaatcatctcaatcacggcgcgattgaccagtatgcaacaccgcggcgcctagcattgctgattcacgacctcgctgacaagcaagcggacgtcgaagaagacgtcaaaggcccagctaagaaaattgcgcaagatgcagatggcaactggaccaaggcggcgatcggcttttctcgcggccaaggcatgacccctgatgacattgtctttaaaacgatcaaaggtgtggattacgtttatctgcataaggcaatcaagggcaaaacagcagcagctattttaccaggtatgctggatgtcattaaaagcctgaccttcccaacccgaatgaagtggggcgcttatgacttcgagtacattcggccgattcattggctggtcagcttactggatgatgcgattatcccgatgaagttgctggatgttgacgctggcagaaccactcaagggcatcgcttccttggcagaccagtgactctcggcaatgcggccgactatgttgcggccttaaaagcacaatttgtgattgttgaaccagcagcgcgcaagcagttgattagcgatcagattcaccaaattgccgctgatcatcaatggcagattgatctggaggcagacttgctggaagaggtcaataatcttgttgaatggccaactgcatttgctggtaattttgatgaaaagtatctcaaaattcctgaagctgtgctgatcacctcaatgaaagataatcaacgttacttctatgcgcgggatgcgtcaggaaagatggtcaatgcgtttattggtgttcgtaacggtaatgctgatcatttagccaatgtgattgcgggcaatgaaaaggtattgaccgcgcgattggaagatgcagctttcttctatgcggaagatcaaaagcgtagcattgctgacgatgttgatcgtttgaaagctgttagtttccacgataaaatcagttccatgtacgacaaaatggcccgaacaagggttatcgccgatttgttggcggatcgttttggcttatctgcgactgataaggctgatctggaccgagcagcttcgatttacaaattcgaccttgtcacttcaatggttggtgagtttccagaattgcaaggtattatgggcgaacattatgcgcaattggcaggtgagaaaccagctgttgcccaggctatcgctgagcattacgagccgatttctgcggatggtgcgttgccagaaagcttagtcggcaccgtacttgccattgcagacaaattcgattcgttaatgagtttcttcgcggttgatctgattccaagtggctcaaacgatccttatgcgctgcgccgtcaagcttacgggattgttcgaatgatcgccaaacatgattggccatttgccgttgctgaactgcagacgacgattgcggatgccttgaaggcagcaggaaaaaccaataatcttgattttgctgcgcatcaacaggatttgaatgcattcatgattgaccgtgccaaacaagtcttgcaaggtcagaagatccgccatgacattgtggatgcagtgacagttcgcgctgatgccgatcttgccggtatcttggatgctgccaagatcctttctgcgcacgcggacgatactgatttcaaacctgtcatggaagcacttggacgtgtgttgcggattaccaagaagcagcaggtaaaagtcgatgtggatacagcgaagtttgagaatccgagcgaaggtcagttgtatgatgaaacggtggcgactgccaagaagtttgatgatgaaccgacggaagccgattatcaggcgcttaaggcactcgcagatccaattaatgcgtactttgatgccacaatggtcatggccgacgatcaagccattcgccaaaatcgcttggcagctttgcttcaacttgccgcattgatcaagcaatttggcgatgtgagtcaagtcattgttaagtagccttgcattccaaacctaaacaggctatactttaatttgtattattatgccgatagactatcaaaaagtcgcatttcaactcagaagtgcgactttttaccgctatttcgggtaacgtgtgttgggcgtctgcaggctggcaaacagctctgcggcacatgtcatgaaagggagtgagctgacatcgccggaatgattcctgaggctactgtcgacaaagtccttaaagctgtcaatattgctgattatattggccaatatgtgcaattacgcaagaccgggcagaatctgtttggcttgtgtccttttcacgaagaacacaccccatcattttctgtgaatgaacctaagcagatttttcactgtttttcgtgcggccgcggcggcaatgtttttaaattcgtgatggactatgataacgccaccttcccggaggcagttaaaaaagtggcggattttgctggcatgccactggatgttcaggtgggtcatgcagcaccggttgatccagagatcagcaagcaacagcatattttgcaagacacggccgatctatttcatcatattttgatgaatacggagaaaggtcagactgcacttgattatttgcacaaacgtggcttaactaatgacacaattgaagcttttcaactggggtatgcgcctgaagaacgtaatctgttagtagcgtttcttaataatcgcaaagtcgactatcaagatcagcgtgccagcggtttgttcgtagaggatcaagaaggaaaattgttcgatcggtttaacgatcgcgtcatgtttccgctaacggacagtcatggtcaagtgattggtttttccgggcggattctaagcaagggcaagacccaagctaaatacttgaacagtcccgaaaccaagcttttcaacaagcgtgatgtcctatttaatcttcatcgtgccaaagccgattttggccgtgatggcggcccgattctttttgaaggctatatggatgtgatcgctgcgtaccaagccggtgtaaaaaccgggattgcttccatgggaacaagcttaactactgagcaggttgacatcattagccacttaagcaagcgattaaccgtgtgttacgatggtgatgaaccagggcaaaaggcgattgaacgtgcggttgccatgttggctgatcatccgcgattacaaacgggtgtggtcgttttgccggacgggatggatcctgatgagttcattcgtgcccgtggtgccgaagccttccaagcgcaagtcaaatccgtattgacgccgaccgcgtttatcctgcaattcttagcgcgcggggttgacatgaacaatgatcaggctaaactgacgtatctgaacgcggctttaaaaaccatcggtaagatttcgaatccggtagcgcgggcagtttatgtgaagcagttagctgacacgactggcgtacctgagagcgctctgaatcaaagcctgccagcgccgcggcaagccgtgcaacaaccgtcgtcggctcctgtgagctatcaaaccgcgccggttaatcaaccagttcggccaattgatcgttacactgcagcccaacgacaattactgtattatgtttggcacgatgatttagtgatgcagcgtttaaaaaatgctgctttcacatttccagcgccacattttcagacgctctttaccggatggctagattttctccatgagcagcctgatggcgagttagctggattcctggatcgagtcgatccagatctgagcggggtggcggcttcggtggcgatgcaggttttgcctgaggcgactgaggcaacgattgacgagttgattcagacgatcacgtccgcttcaactgtcgaacggctgcaggctatcaagcaggccatcacagaggcacagcgacttggcgataagcagaaactaggcgagctaacggtgcagtatgtgaatctcatgaaacttttgaaacaacaacaaggctaggggaggaactttaatggctgataaaaaaacagcaactgaagtagacaagaccacaaagaagacaacggctaagccagcagcaaaaactgctgctaagacaactgctgtcaaggcggcggcaaaaaagactaccgcgaaaaaaactacggtcaagaagactaccgctagcagcaaacgcacgaccaaaacgacaacgaaagcattcgacgatgctgtcaaggccgtgattaaagattacaagaagaagaaacaaattactgaagatgacctgaccgacaagttggttaagccgtttgagctcaagagtggtgccattgacgatctgatgcaaaagatcgaggataatgggattgctattgttgatgaaaatggcgagccagcagcgattagcttgaagaagcaaaagaaggtttccaagaaggaaatgagtgacatgtccgcgccttcaggggtcaaaatcaatgaccctgtgcggatgtacctgaaggaaatcggccgagtttccttgctgacagctgatgaagaagttgcccttgccttgaagattgaacaaggtgatcaagaagctaagcaacgtttggctgaagctaacttgcgattggttgtttccatcgctaagcgttatgttggtcgcggcatgcaattcctggatctgattcaggaagggaacatggggctgatgaaggcggtcgagaaattcgattaccggaaaggctttaagttctcaacgtatgccacctggtggattcggcaggctattacccgtgccatcgctgaccaagcccggacaattcggattccagtgcatatggttgaaaccattaacaaattgattcggattcaacggcaactgcttcaagaccttggtcgtgaaccaacgcctgaagaaatcggcgcggaaatggacatgccaactgaaaaggttcgcgaaatcctgaagattgcgcaagaacctgtttccttggaaacgccaattggtgaagaggatgattcacatcttggcgacttcattgaagaccaagacgccaccagtcctgaagaccatgcttcctatgaactgcttaaagaacagttggaaagtgtgctggataccttaacggatcgtgaagaaaatgttttgcggttgcgttttggactcgatgatggccggacccgtaccttggaagaggtcggcaaagtctttggcgtgacccgcgagcgaattcgtcaaatagaagctaaggcattgcggaagctccgccacccaagccgttccaagcaacttaaggattttcttgagtaatgaatgtttgttagctgataaagccgtctgcctcattagtgaggtaggcggctttttcgtgcgtcatcatgtggcgaagcccctcattcagattcgaataccggaaatctttgatgtttctgaggacgtaacccgcttttcagaaaagttaactaaccgttcggcgtagtttgttataatgaaaactgttaacgagatgaggagaaagtatagtcatggatcatattcatttatcaaaacggcttcaggccattagcagttttattgaggcaggcgaacgggtagcggatatcggcacagatcacgcttttttgccgatttacttggtgcagcagcaacgcatcaattttgcgattgccagtgatataggagcgggaccggtcgcaattgccaagcaaaacgttgcggatgctgggttaactgcgcagatcagcgtccgtcaagctgacggtttggcaagtatcatgcctgacgatgccatttcaacggttgtcattgctggaatgggcggtcagctgatgacggatatttttgaagctggccagccacaactagacggtaccgaaaccttggtactggctcctaatcgacaccaatacgatgtccgtttatggcttgatcagcatggttatggcattatcggcgaggacatcgttgaagatgaaggccatatttacgaactgatggcagctggtcgaacgcgcccggatgtgccttattcggaagctgatttacgcttcgggccgattttacggcggcaaaagagtccaacttttatgaaaaaaatgcaccgcgaagctgagaaaaccgaggctgtgcttgaaggtttggctgatgcacagatggtgccgctagaaaagattcgcgaacaagaaaaaattttatcattaatcaaggaggaattagacgcacatgacgagcggtaaacagattattaatcgatttgaagactttgcccccctgagtttggcatgggaacgcgatccaagcgggctgcaattaggtaacccagataaaccagttaaaaccgtcctcgtaacattggatgtccggccggaagtggtcactgaagccgaagcgattcatgctgatatgatcttttctcatcatccagcaatgtttcgaccagtgcataacttggatttgcgggttccgcagaatgccatgtacgcccaaattctaaaggatgacttgctggtctatgcagcgcatactaaccttgatcgcgtccaagacgggatgaatgactggctggcagaagcgttgggattaagtcaagttgtgccctttatcaatgaaggtgaaggcgccaacatgggccgaattggcttgttaccagacaaaattcgccttgaggcttttgttgaacaagtcaaagcagcctataacgttaaagggttgcgcgtggttgcccgcgatctagaccggctagttcaaaaagtggctattcttggtggtgatggcggtgatgccttcaacgatgccaagcaagctggcgccgatgtctttatcactggcgatgtgtattaccataccggtcacgatatgctagccgccgacctgcccgtaattgatcccggccaccatatcgagtcgattatgaaaggcaaagttgcgactttgatcaacgaatgggccgatgcagaaagatgggatgtcaaagccataccatctaaactatcgactgatccgtttactttcatgtgattgggaaaaattttccagtaaatgcgatttttaaatagaattgataaagagcaaaacacatagcataggtgcgaaaatcttacactcatgctaaaataaagcaaattaactgtcggcttttgccgccaaaggagcgaataccatgccattagtacacattgatttgattgaaggccgttcaccggagcaactgaaagcccttgtgaaagacgtgacagatgccattgtcaaagatactggcgcacccgctgagcatattcacattgttcttaacgaaatggctaaggaacattattcagttgccggtgtacttgcatcagataaggcttaacggctggctttgagcaatcagtaccgggtcacagaagggaagggttcaacgatggcagacaccagcgatcaggcagcctcacaagatcaggcttattttgataaaatgaaacagcaaattcttgatgctttggaaaccgtcatcgacccagagctcggtgtcgacttaattaacctcggcttgatttatggggttgatttagatgaaagcggcaaatgtaccgttgaaatgacattgacaacgatgggctgtcctttgacagacatgttggatgctgatattaaacgggcactgacaacgattgacgggattaccagcgttgaaattcatttagtttggtatccagcatgggggccagaacgcctcagtcggtatgccaaaatggcgctgggcattcattaaccggcgtttagacacggaatgcaaaagccgccgtttaaggcggcttttgactgtctttcaggcagtcaaaagcgatggatcacgagggtgaacatggactattggagcacattaaatcggctggccaaacaatatgtgcgcattggaccgcttaaatcacaactaactgccatgaaggattggcaagcatctattgcggctggtgtcttgccagcacatgcgttaccttggttgggacttagcacgccgcaaattgatgccgctttaacccagccacaggcgcagctgcaagaactgcttcaactagatcatttattgcataatttccgccgctacattgcctttcatgatggcatgtggtcatttgttcatgaagatctgtttgcgacttggcatcgactttatggtcctcagcggtacttggaagtggcagctggtaatggttacgtgagtgttggtttgcgcgcacaaggcgacaaaacgatcacaaccgatgcgcacacttggacgaaagaaaatgtcactggccgtcagccgcttgttccagttaaaaccgccacagccaacgcggcgttgttcctctacgcccaacaagtcgatgctgttgtgatggcttggagcccagataaggatcctaatgatgtccggttcctgcatattatgcaacactattttcccactaaacaattattcgtgatcggcgaacgcaacggtgcaaccaatagccggttattttggcaagaagcccgaaccgttccggatcggcgtttattcgcgcttaatcgtgcgtttggtcattttgatgcgattcacgaacgagtttaccgattacaatagtctctgtactgttggcaaatggcttatttgtgcaggacttgaggaggatgacgtgaaaaaattattcttgattgatcttttatggatcggtttagcgatattagccggtttagtatggtcacagcatgatcaaaatgaatatgccagtcagcttgatcacctcggcatgtcggaaacggctcaggaatatgtcacgacaagttcgcgcagcatcaccaccgcgataagcgagctcgataaaactgatttcaaaggttatcaggtccagtttgttgctaaacaagtcgtgtacgtttatcagcgtggcacggttgcgagcctgccactcgatagtggtcagtggttctcggctggcgattttgcctccagtctgccggtgacggtggttggccgcgatcttgccgataaactgtatactggcagtaataatcaacgttatttgcaagtgaatggtcaatatgtcccagtattgggaacggtgggcacacgcaaaggcagcccgctaaataaagttatctttctcaacgcctctgcacaaactaccaatagtaagctgaaactaaagcaggtcaaaatctatgttgacggcgccagtcagcatagcaaggccttgaaaaccgctttcaaagcaaaaaatattcatcgggtccactttagcgatagtaatgcttcgacttggtggcatgcttatggtcaaacggcattgttcagcttattcttattgctgggtgcaggattgctgacgatgctcatggtggtcttaatggggccgttgcaaacagctggtttgaatttgaatatgcgggcgcgttacttgcgcggcgttttatctagctgtggtggtcatattggcgtcagtctttttcttggtggcctttttgcaaactggtggttctacttcaccacgcgaactaatatttgggtctttcttgtcgttttgaccatcgctgccattttcttcctccgttacttgattcacagaaaggataaagctagtgcaactacctgaagcatttaaggaaaaatatactcgtttgctgggcgatgaagcagctgcttttttagcgacatttgaagcacctgcggaaagtggctttcggcgtgatccagccaagccgtggccattggacgagtcattaactgaaccaattccttggagtccgtggggctattatggcaaggtcgccggcaacgacattgatcacgttgccggacttgtttatagtcaggagccaagtgcgcagtttgtcggtactgttgcagccccaaagccgggtgaacgggtattagatttgtgtgcagcgccaggcggtaaatcgacccaacttgcttgctatttaggcgacaccgggcttttggtcagcaatgagatcaatggtccgcggtcaaaagttttgtcaggtaatctggaacggtggggtactcggcaaattttagtaacgaacaatgatcctgacacgttggcaaaagcgtggccacaaatgtttgatcgaattttggttgatgcaccttgttcaggagaaggcatgtttcgtaaagatccggatgcaatccagtattggcatgcggactatcctgcgcaatgtgctgagcggcaaaagcagattctcaaagcggctgtgaagatgctagcaccaggcggcacgttgatttactcgacttgcacctttagtcctgaagaagatgagcaaatcattgcctggctattggccaataacgcgttcacgcttacgccgattaagcaatatccggggatggaagctgggcggccagcgtgggccgatggcaatccggaactggccaaaacagtccgactgtttcctcaccgattgcgtggcgaagggcattttgttgctaagctgaagttagcaggggcactagcatcacatcaaccagcccgcttgccgcttaaaccgctagccaagccggcgaaggatgaagttgatgcgtttgtagcgacaagcctaaccaggcaacccagcggcctattttattggcatggcgattttctttcactcttaccaacaacgatgatcccgtttgagcacgtgaaagtggtgcgtgccggtctggaactcggaagtttccggaagaaacggtttgaaccaagtcatagtttagcaactgctcttaatccggatgactttcaaactgtgattgaggttgatgcggacggttatgcacggtatcggcacggtgaaacgttgccaagcaaggtaagtggcaaacgttttgtcctgctgacattcgaacataagccgtttgcaattggtaaattggtgaatggtaccatcaaaaattattatccaaaggggttgcgtgtttgatatttagtaaagaagactcggttcggggcataactcacatccggtgaacgaggctgagccattatttgctcatcggacttgtgaatcattaaattccgaatagtcgtaggaaggtgctaggctaatagtcccttgccgtgccaaacttcgcaatctccggccagatggggtggcgacgcgtagctagagcggagacggcgcttcgagcccgcaaagcccgctataaatttactacaagggtcgaagatatggtggcctagttcaacagccactaaataaataggcgccttgatcgcgggatgttaaggtctcgcaatcaaggcgcctattcgtgataagaggtcgacaacgttaacttatttttcaactgcctgaagcttttgattgtcatcaagctgtgaaatgcccattttgtgatagcgttgtagcaagatcatcgtgatccagagcaacaacaatgagccaagtgcgaaggcgatgatgacgatgtaacccaaggtaaccgtgttggacgcaatgccactcgtaatcgcattccggaagttcataatcgaatacgacatcggtaagaatgggtgaatgatgttataaaactggttggtaagctccattgggaaggtcccgccagagccgcccagttgtaacattaacccgaccatcgcaagaaatcggccaggattatcaaatgccattgaaaggaacataatgagatacatcgaggttagcgagaaaagaatcgcagtgagataaaattgcccgacatgatcgacgttcagaccgactgccatgatcagtgttgcttcaacaatggcggttgcaacggcgacaactgcgccaatggtgattttgctgaagaaccactgggtcgcagtgccatcggctttagaaactttacggattggataagcaaagttaaagaccaaggcaccgacgtagagggcaagactcaagacgtatggtgcaagggcatgtccataattaggaacatatgaataatgtttatgcgacatcttggttggtgcggcaaacattttcttggtatcactggtgacggtgatgccgttgacttttttggcactgctagagagcgttttggcaaactttttatcgccatttttaagctgagtggaaccggatttaagggtgccactctgggcggtgatttggctagtgccatccgcgagttggttgacaccggatacaagcgttggaacattggcattcaattgaccaacgccattggcaacctgaccggcaccattggccagctggctgactccgttcgtgagggtcggtacttgaccgttcagggtgcttaagccaccagagacttgactggagccggaatagagttgactgaccccgtttgtgagcgtcgggatttgaccgttcaagctggttagcccgccagaaacctggctagaaccggagtagagttggctgacgccattggtgagcgttgggatttgaccgtttaaggtatttaagccgccagaaacctgtccagagccggaatagagttggctgacgccattggtgagcgttgggatttgaccgtttaaggtgcttaagccgccagaaactttgccagagccggaatagagttgactgacgccatcaaccagtgaaggtgcttttgttgctagctggttgatgccactgttcaagctattcgtcccggtcacaagttgatcattgttagagatgattttcgtagcaccgttttgaagaccagtaatagcagctgttaatgtcggaacccgctggttaagtgtcgtcagaccatctgaaaccttttttgagccaggaatcagtttctgattaagagtcgtcgacagcgacgtgccactgctttcggtctgagtcattaaagcattgatatttgtctcgagttgttcaaaaccggcaaccaaatccggatcttgattggttttggcttttaaggtggcttcatactttgtgaggctttcttgaagcttggctgctgattcgactgcttgcttattttggctatcgacagagccactcaattgttgaagaccgttggttaaatccgatgaaccggttgccaacgagttagtgtctgttgctaaagagccggtgctacctgcaagctgatcaattcctttagagagcgatgtcacaccgtctgtatagttctttacccctgttgttaagcttgccgaaccagtctggagctgggtgatcccgttagccagttggcctgattcggtttgcagggttcccagtccattcgttacctgattagagccggttgctaactgaccgacaccagagctaagggttccggttttcgactgcaaggttcccaatccactcgtcacttggtctataaatttactacaagggtcgaagatatggtggcctagttcaacagccactaagtataagaatagtgttgatgaattttatctatcaacaccaaatatcataggccccaaaattgtctgaccagtgtttggacaaaaaagaccagcttcctttaaaatggtgtttatcacaaacccatttttaggagccgatcttttttgtccgaacagcgtcggattaattttacaatctacctttcatgatgaagtgtttcgatgacaacgcggtcttcaaatgataaaatagtagtgcccataaaggtccttctttctagtggaatgttgtgatgacaccattaaagacctttatgggtttttctgtccactaatatgttcaacttaaattttacaatctatctttagtattcgccccaatatttagacattgtttgtttaccaacgccagggttgaaactattagttggatcatttttcttatagtgcttgattaaggccggtgctgccaaatatagatgcccaacattgtgttcggctggataaacagcgtgacgctcatccaaaattttaagcatttcttttttaagttcatgcgcatcgacgccaggttttagaatataatcctggtgcataacgtgatcaagtaagtgaccataataaattttgtgttctattttgtcttcaatctctttaggcaaatgctcgaaccacttataatcattacttgccaacgcgatatctagtggcaaaatgtcaatactatcctgttttaattcttgatatcgaatcgcaaccccagctgttacatagcggtgagttgacgctttactggtctcattggcatcggcttcaaagtagtcgccactggctttgtcaaaataagatttgagatactctcgcgcttcttcaataccattaccagccattttcaattgtaggtaatggtcgtacttttcgtaataatcatctaaccgctttggcatttgattaggaaataaattacttaatgtttgaagcaaacgatctgggaaataaggtttgaaaaacggaatgtgcttcaaaaagcgttcgccccatgcttttagcgcaaacatttggggcaaatgacccgtaccaattttttcaatcacaattagtgagtctttaccatatttcttggccaatttatatgcatttttatgcatatattcaccagaaacaggcaattctttgaatgtcgtcataatatggcgacgaatatcttccaactcatcgggattattcgttccaatgtaaaacatttgtgtttttttatccattgggaatgtatctaagcggacagccaatgccgcaacgtgaccggacgatccagatacttcatacaattctttaggatttgcattgtatcgaataggcttatcagattcaacgtcacgcacaacctgttcatgatggaacattgaagcatgatgttcagtagctggtacttgattcaaatcaaaattgcggttctgcaaattagtaataatctcttcgggcgttttgcccaaatcaatgcctaaatggttaactaagtgcatttcgtcatgttcatcaatccaaacatacaatgatagctctgtataagctggacctcttctgatcaaagcaccaccagaattgttgttaataccaccaatgaccgatgcacccaaattagatgagccaatgactgaatgtggttcacgtttaagtggtcgcaattcattttctaagtgaaacagggtcgtaccggggaatgctagtacttgttccccattattgattaactgtaaatctttaattttcatgccgttcacaacaactgcagaacggtcataacctggggctggtacggatccctcagtcaaactagtgttggctgcttgcataataatgataatattgttatcatgcaaaacattaagcacacgccacattgccattaaagtggttggaaatacgactgcaactgcatcgcccttacctgagcggtaccctttcctaaaacgtaaagattttgctttgttagtaataacattttttttaccaacaacattgactagttcttcgactaagtccatattaacttctcccctctataacgtttgtaaaaaacgttttaatcattacgctttcaatgatacgctttttttgatgcgtatctggattgaagtcaatatttgagacagattttaagagacattcagaaccgcgtttacaatcataagggaatccgaagccgttttaaatgtacctcacaatcgtgcgcttacttttaaacaacgtaatacttcagacgaacccttacacgccactttctggcgacaagatgccatcaatgtcagaatctttttccaaagttgcaaatcgactgaggtggacagcgattgggcaaggttgacaaaataatatattcaaaactgaaccatttaccttgttctgcggattaacttgacgaccacatcagattgtattttcgtttgtgaagatctaaaactcaggaatagttgcacctgctaatgtctatttatgagaaaagttttcttatcttcatgaaaggattcaaattttataatattggtatgtttatattaagcgcaagaacagaatgcttataacttctcacgttcacaaaaaccgttgattgctcaaaaggtatatgctattttaaattaagagttagtaaacgttctcttaaatagccaagcatcgtactcccatcaattgtctctcgttattttcgttaagaacaacaattgaattagcgagcgcatatgcagttactttctcaataacgcctggaatcgtataggcaacaaaaatagtaactatttctttcacaaaaaaaaaatcacaaactacctcaagcatttttatcggctctattctgatcatctcaatagtggttagtcacgctgttactatcaagcgaagttatatttggaggggcttctatgattctatctgtgcaagatttgacgtttaagttccgcggcaaaacgatttttagtcatgcaagtatgcaaattaaccaacatgctatctatggtttggttgctcctaatggctacggaaaatcaaccttgttgaatttgctgacgggattattgcacccacaatcagggaggattcaattactagatcaatcaatgaatcgtcaattagtctttgaaaaagttgcttatcttcaagataattcagtcctttatccatatttgacgggacagcaacatttagattttttgacggcggttcatcgacttgatcgacaggcagttgcgactatcgctgggcaattacaagcagtcgattttctgaaccaacgggtgagcaagtattcgttaggtatgaagcaacggttgttgttggtcatggcgctggttgttaaaccgacaatcctcttactcgatgagccattgaatggattggatccaactagtcttcaacttgttcgcgacgccttacttgatcttgcccaacaagacgtgacggttttaatttcatcgcataatttggacgaattaatgaaagttactcagcactacttcttcatcacaggacatcagattcatgaagaagtactgggtccgcatgattcagcagaagcgcgctacaatgcgctgttcgcaccaacagtatgaagcaagcgctctttgttttagagtggcggcgtttggcggcaagctttgtcctgagcttggcgctcggccttgccgtcatcggtgcgattgctttctttttaataagcagtgttcgccagcagcaaacccatgaagcgatacgcgctcagatgacggcgaaacaaaccgcgttgaatcaagccaatggcagttggatctacgttgccaatcatccaaatgaaacaaatccgaccagcgtggcacaagcaaggcaaaaagtgcagcatgccaagcaactgacgagtttatatgagcagcaaaagcaggctttttcccaaggtgataatcgaaactatttaaagaccagcttaaaagtgtttgatcaagaaaagattctcaagaaactgagtccagatgattttagcaccgatcttattgccaatcagcgccaagcatacctttttcgaaaactattaaccactcatcaaggttatgaaattaatggcagttctactttaccagcagttttcttaacggacttcagtggcctgttgagccattggtcggtcattctattgatggtgatgattttgtcaacaacttggaccttatcttggttcggcaagcaacacgagtgggttatgttaaatcagcccaacagttggatatggcttggtatgaactttctggttgccttactcacatggttcatgatgctgggtatcgcattaagtttaagcttgcttattagcaagatctggggtcaaccatttatcagcggtcatcatggctggcaaaataccgctactaatatcacgcaatctttaaaggcgctctttcaagaaaacttgcttggatcagttgtccgctttggccttatttattttatttggcaaattctctgtctgtttgccgcccaaatccggaggtgatctgatgctttttcactatctaaagtttgaatttaccaagcgcaatagtcgttggtggatttggctgtttattgccgttttgacgggtgttggcattctcggtaactttcaacaacaggctgcccaaaatgaatttgttcaaaagtatcgccaagcgttaattcagcaaggggctgatcaggcggacggaccggcaacattgaaaaccgagttcaaaaaacttaatggaccacaagccgcctataaccaatggttcgcggcagaattgccaattatcagtggtaaggagcctgctaccaaagaaaacgaaggtgccaattaccgaattgcgatcctaaacggcacagcaaaaccagattatctggatgcgatcaatcgaacctatcagcaaaatgaaatcctcgcacagcacaagataactgcatactatccgcaagggctgttatttacggatcaagaattacaagcgatgccagatgagaccgagaagcttgtgcgtgagtggttccctactttttatgtccgcggctttgactatttacaatatcttttccagcaaaacgtgccattttaccttctgctcatcggcattattgtttcgggtggtttttttgccaaagagttagcccataaacgtgcccattcaaattggttacagctacagggcgaaggtctattcaaacagatgatggtgcagtttttaacgatcagtctgaccttagccgagattgtttttctcccactggcgttaacaacattagttaccggtttgctacgcggttttggcagctgggaatttcccgtcctgaataacacctatcaggatgctttcaacagcttttctgaaacttttacaactaggggacaactattgattcgctctgcaggcctcttgttgcttctgattgcactgattgcagcgtttaatattgccgtggcactcatctccaaaaacgcctggttaacgacaagtcttgtgttgctcgtggtggctagcgcactgctgatcccgccaattagctggttgccactgagtttctttcatgtgtggggcattgcgaatggcacgattgcccagtccgtggacttgccgggattacaactgggacaaggagcactcgtcatcgtaatttggttcatgattctgttgcttgttgaggtaatcagttcatttaattttacgagttggtatccattcagagattcaactaaaagcagtcgtgttgaacgggtctgatcgctatttttctggaacgtactagactgttactttcatgacgtctagtacgttttttggcggcggcacatatttgatccattcaagaaaacgtaatttccttatgatatagttattaataattaatcctgtcgctgtataacctttgcacaccctctgtttatcgttaaaacccacaaaaatcgaggaggcctccgtcgtgaaaaaacgcgtgttagttctgctaattagctttttaaccgtcttctttttagtgccgcgacaatcagccttatccaagactaatacggatgaaacgaaaccgtctatcgtgaaaaaagtaaaggtaacgactggcaataacggccttaaacttagctttcatgcccagccaaataccagctatacattgaaagatttgaataacaatcaattggctgctgggatggttaaaaagggcacggtgagcttaaaccgactgcggcccacctcaacaaaactgattttgaaaacttcacgtcaccgccatactagcaaaaagatcattcctctacctgaatcatacgaaattccgcgccgatcagtttatcgaaaaccagttgctattggtagcaaggtaacttattacggcgctaacagccaactgctatttacgattcaaaccaagtatctacctaacatacctcaaaataagaccggcatttcgctcactttccataactatcattacgccattccgctgacgttttctccagcaaatttcactgcctattcaaacaatcaacaagtcgcgctgcagccgcagtcaccgcttccgatgatcaagtcgaatgaagagaaaactatcaactttttgattgatgttcctcgagaaaaggccattcaaaatggtttcacatttgacaactctgacttaacgttaccaattaatttttatctttaataacccttttcacccatatgaaaagcccggccgttatcgcctgcaacagtagcccaaaaacttgggtcaatacaggccagccataaacagtaaatggtttaaagtaggttgagaatggcaggttgccagcatataacgtcagtagatttagaagcaatgataaaaactgggagaaaaacagtatgcgccacatcttctttgtctcctccctcataattaagcatattgatagagatatgcttaattgcaacaaaaagtatatcaatacagggccgtcagaaatatactggtaatctaacaacagtgcgataccggcatacggaagtgcatttagaatgaggcaaatgagagctttcatgagtttgttggactccttcaactttgtgtgtttttcatattagcttaatttgtatgcccatcatactgtccacaaagatcatactgtccacaaagacttatacgcaattagttcagctattaaactattggttaagtacttaattcgtcccaccaatgctccgcgccaattgtccaaaaccagccagcgcccctttttgcacctgttctggcgattctggctcatcttgcgccagccagacgcgcagaatattcgtgaagccaccgagggcaaaggccatgatgtagttcacttcctgatcggtaccggcgacatgccaaggcgcaggaaacgcgcggtagtgagcaaccgcgtcttgcagccaaaccccgtttaaacgatcaaacagaccttgtcgaatcaataatcggacaaggtctttttgctgccaccagaagttgaagaagtttgccatggttgtttcaaaactaatcggttcctgatcgcgcgtggctttttgcaaactttcaaaatagccatccgtcaattgggcacagagataatcgattaagtcatcttttgttttaaatgcccgataaaaagtctttcgtgaaagatctgctgtctgcacgatttccgtgattgagatatccgccacatcttcgcgttgcatcaacgcaatcaaggcatcaaccaaccactgtctagactgcgccgccattcgttgtttaccgttcatcgctcgcatccccttatctgacacaaatactgccaatttgtagcacttgtctgcaacctattgccgcttctcctaagccccagtatactcaaagtgctctcgaaagtcacacatgtgtcacatagacacaaacgtatcagatgaaaggactggatgctatgacgcgttttaccaaagcactttgcttcattggcctgacgatcgcgatgttcatgggaaccctcgacaccacgatcgtcaatattgcgattccaaaaatcatgacggatctcaatggctcgcttgctaatacgagttgggtcatgacgatttacaccttagccatgtcagtcttcatgattaccgcttcgaaaattgctgaccggtttggccgcaagaaaatcatgttacttggtctccttctctttggcggcttctccgctgcttgtatgacggcgacttctctgtccatgctcaccaccttccgtttcttccaaggtctcggtggcgcgatcatcaccccaattgtcttgcctatgggaattgaggtcttcggtaaagagaaaatcaaccgcgttgcttccgttgtcggagcagtcacggcactagcagcggctggcggcccgccaattggtggtatcattctgcaagtcgcttcttggcgctggattttcggtatcaatgttcctttagccatccttgccttcgtgctcattgccgtttgcgcaaaagaatcctatgatgaatccctcgctggcggtatcgattttccggggcttgtctttctaacggccgcgcttggcggtgtcacatttggcctgttggaaggtcgccaatacggctggacatccttgctgattctgaccagtttaattggcggtgtcctcgccctcattgcgttcatcgccaccgaaaagcgcgtgaagaacccgctgttggagctagatcttttccgtgaaaaaacgttgagtgcctctagcattgtttacttcatgaccggctttgcgttagtagcaccgagtctgattctgaactatttcctccaaaatgtattaggcgatagtcctttgcatgccgcactcatcatcattccagtttccctaacgatcatgattgccatgccacttggcaccaaactactcgataaaaccggtgctattcccgttaccttagccggcatgctgctcatggctgccagccttttcctgctgtcgctcatcaaaacagaaaccgcaaccgccttaatcgtggtgctgctcgtcattaacggtttcggttttggcttcgcttcagtctcaatggtcgcctcggtccgttatctacccaaaaataaaagtgggattggttccgggattgtcaacgcggcccggcaaattggtacctgtttaggtattgcgattctggtcaccgtattggataccaatatcgacacagcaaaaacgcagattcatcatgctggcgaccaaatcatagcggcaaaaaccttgtcgccacatgtcaaaacagttgctcaccagcagctcgctgcggtctttgccggatcatcaaccccgacaaagcaccaacagaaaaagatgaggcaaaccatctcagaagcagccaaagttaaaactaatctaccaaagcccgctgctggcagtgatcttcgcaagttgtatgatgccagtgcaggcttacaacaaggcagtaacaagttggcaaacggctcggaagcactggcaaaagcggctcaacaaacccgttcaccgcttgccaccagtatcgtgcaactaagcacgggtgctgcgaccatggcgcaaggacaagctgcctttttgaccggcatcaaacaagtcgcccagaaacaaaccctgcaaaccgcttttcacgacattacccaacgcaaaaacacccgcttagctcaggcttttagtcacacgtacctgattggcgctttgattgtcctatgtctatcaccagtggctttttggacggatcggctgcatatcgacacattgcgaagcgaataaccacctttagacatttctcatccttgaggagaaatcaaaaaaagccatccttcttcgggtggcttttctcaggtaaacctaacgagtggttgtaaatccgtacgacgaaatagttgttaatctgcagaatgcttatgcttcttccggcgctttccgaacccatagtctgcaataaggacaccaatagcgccaccaacaaagatccaccatctgaatggcatttttaaccaaacagagacaacatatgccaatgccaataccaagacaacgccaaacgttaagaagaaattccgccaatatttcatatcttccctccgttcatcgttttaactgttatccagatcaggccttaaaagttgatgatcccgttatttgggtacgcatcgtgctgatcccaccactttgcgataaagccccccggagaggttaaagaaactgcactagaaacaaccagcgttattaacgctgccctcagtttcatgtttgttccttcaaacatagaagcagattcacaagtgttctcgttattcttacgctataacaatacacccaagcatctattcaagccaactgaaatgcgtttacattctcgtcaccaacagatcacgatccgttacttatttcacaatatgtttgtatgtgaggaatgtcagacgattggaataaaatcgttgcataaaatttggtccatgctaggctcatgtggacactttaaccctattacttttcatactccaatcttaccgaagttttgacaggatcaaaagtttccaatctcagctgtcgcaaggcttccacagagctaaaaacttatactcccttatacattcaaaaaacatcagcaatgcagttgacctgcggaccgcacactgcctgctgatgttttttgagtatggaccaatttttatttttgactggggcgagtaaagttgtgagtcatgctcaattgtgatttaagtctggtccaacactaattttgccatcctgaatcgacactgattctgctcccgttgcgccgccttcataatttaccgttgcatagttgatgctacgagtcagtgccacagaataagtgtcagtcccgtgcggtaataaataagctgcgacttcgtctgtatggcgctggtctaataaccgaaaaacctcaaaaacttgatcaggaatctggctttgcgctgcctttttcgtaaaaatggtcacaccgttagtattcacacgcgccatctttgtctttgataggaatagatacatattgtcatacaagtcacctgctaccaacgattgctgggtcaacttagcatcttgcttgaccaattgtgtctgtcgcagggagtacgccgtgtttcgatataactcttctccttgcaagtgacttagattttcaactttgccgcgaacatacgacttgttctgaatggtcaccaattgattatctcgcacggtagcctgatcgcctgcagcgctttgccaagtgccggccacttcactgaaagtcagctgcttagttgtcccgtacttgattttccgcgagtaaacattgccgcgattgacggtactagcattaccccctgtcgtgtaagccatgatcacttcatacaaatgatcgccttcaatgagatagccatcattactaggaaaagtgtgaccatccgcttgttgtgtatagaccaaatccgttaatgctttaatctgtttggttgcccccatcgctttaagcgtcgcattcacttgcttcactgtgacgaagcggagtgtcttaggctgtgcttcatttttctgaatagcctttttgatcgtggcataatcgctctgtttgaaagtagcgacactgtaaaatttaccggcattcgtgatagcaggtgacaacttgttgtccggttttacttgctcgtttttcaaactcccctgactcgttaccgtggcagaaaccgcctcattttcgcgccacacttgatccttttggtttaaaacggtcactgtatgctgcttaaccttgctcacaacgttactcggttgacaagcagccagtaagctcaaacatccgagcaccaacactgccacgctcaactttttgttcatcatcatttctccttctccacgtctaggtgctgctgctattgttactgagtctaggcttctattattctcggaacaaggcagcgctaactcattaaagcctaaaagtgaatgcatggtttggcgcctttattagtggtccagttaccttagcatgacatccatagtcaaaaaacatttaagaaattacccaactattataagatagtgagaagcattgaaacttgttaaccataaaagcggccgggccgaccattaggaaccaagcgcctatcaggcctaaaatatcgagcaaaactatgcgccacatgcagctgagaatagcaggaaggccggtgtaaaatgtatcgcacgaattttgcagacaaggtattgaaattcactaatgatctctcatccgtatcaattgatttacctgacaaatttaagctcatcaatccttatagtggcaaacaacaagctgctgtttgccagataacgacagcgttttatcaaaaatactttgatgatacgaagcctcggcgattaattttgggaagttcccctgcacgaagaggaacagctatgactggcgtaccttttgaagacgcaaaacatcttcaaactgaaaccggtattctgattgatcaattttatattaaccagtcatcatcaaactttttatatgacgtcatgaccaaatatggcggcagcaaaaaattctacaatgctttttatctagggtttgtctgtccactcggcgtggctagcatcaatgccaagggaaatgaagttaattgtaattactatgaaaataaaaaagtacagaaccttttgcttccgtttattgtgcactcactgcgccgccaaatcgactttggcatagatacatcagtatgctactgcatcggaagcggcgaaaattataaggtgctggtgaacattaatcatcagtatcatttttttgaaacaatcgtgccgttagaacatcctcgttttatcacacagtatcacccaaaagaccacgataagtacctagaaaaatatcttaatgccctacatcacgagtcatgttaattgccaactttgcgaacctgttcaaacatctttacaaaagtacgcattaaaattgttgacatttttcaggagagcctctaatattcaaaccaatcattaataattcgtccatgaacaaaccgatgatgtggagatcaagatcattgtgcgcgcaaagagagttgccggtgcggcatgcccatgatcaaatacaacataaagctcggccaagcacagtattacaagcgttactacacgcctcaggtggatgagcgcgattgcggggttgcggcgcttaatatgctgctgcaatttaatggctcggattattcgctagcgcatctgcgacaattggcgaagacggatcaggaaggaacaacagcgctagggattgtccgcgctgctcaggcgcttcattttgaaaccaaggctgtcaaggcggatatgacgctgtttgatcttgatgatgttccttatccgtttcttgtccatgttttgaagcgtggcgagttgcttcattattatgtcgtgtttaaggcgacaaaggatcatatcttgattggcgatcctgatccatcagtagcgatgacctggcttcccaaagagcgctttgcgaaggagtggtcgggggtcgctatttttattgcaccagaaccgcaatatcaactacgcaaagaggataaaggcagtctttttgcgtttgtgccgatgctggcgcggcaaaaagggatcattgccaatattattgtcgccgctgtgttgatcacgttgattagtattgtcgggtcttattttcttcagtcgattattgatacttatattccaaacgggatgcgcacaactttgggaatgattggcagtggcctcatcctcgcttatgtcctgcagtcggttttaacctatgggcaaaattttttgatggctgttttaggacagcgtttgtcgattgatgtcattttgggttacgttaggcatctttatgaattaccgatgtccttcttttccacgcgtcggactggggaaattgtgtcgcggttttccgatgctaataagattattgatgcgctggcaaacacaattatgaccttgtttcttgatatttggattgtcttaattttagggatcgtgttaggcattcaaaacaccaccttattcttggtgtctttaattgctgtgccttgttatttggtgattgtgttcgcttttcagcggccatttaatcgactgaatcaagagacgatggaaagcaatgccattttgagttcatctattatcgaagacttgaacgggattgagacgattaaatcactgaccggtgagaaagtcagttatgaacgggttgaccgtgaattcgtcacgtatttgaaaaagtcgttcaattatacaaaagctgatcaactgcagcaggcgatcaagggactgctgaagttggttttgaatgtggtcgtgctgtggattggtgcgagtttggtgatggctaacaagatgagtctaggacagatgctgacgttcaatgcgttgttggcatatttcactaatccgttagaaagcatcattaatttgcaaccaaaattgcaaatggccaaagtcgcgaataaccggctgaatgaagtgtatttggttgaatcggagtttaaagaacagcgaagtttgaatgatcggcatttaattgatggcgccatcaatgtgaccgatgtgtcctttaagtatggttttgggcaagatgttttgaaacaaatcaaccttgaaatcccggagaatgccaaatacaccattgtcggcatgagtggatctgggaaatcgaccttagccaagttgctagtaggtttctatccagtggacactggcaaagggaaaatcacatttaatggggttcccatcagtgatgttgatctaacaacgttacgacaatatatcgagtatgtaccacaagatccgtttattttttctggctcagtcattgaaaacttaacgttgggtagccgttcgaatatcactgaagctgatattgaagctgcctgttcagtggcggaaattgctggagatatttcgaatttgccgcagatatggcagaccaaactttctgaaagcggcagtattttatcgggtggacaaaagcagcgcctagcaattgcccgcgcgttattatcaccggcaaaagtgttgatttttgatgaatcgaccagcagtttagatacgatcaccgagcggaaaattgttgatcggttgttagcgatgactgatcgaaccattatttttgtggctcatcggctaaccattgctgctaaaacggaacagattgtggtcatggatcatggtgcgattgttgaacaaggaaatcatgctgagttattggccaaacaaggctattatgctcggttggtaagtgagtgaggaggccgcgatgattgatctaaagaagttagagacaaccgagttttataaccatcgctaccgtaatttttcaacagtcattattgtgccgaccgcgatcctctttgttctgttgttgctttttctgatcttcgccaagcgcgaggtgaccgttttaacagcggcggaaattgcgccggtcaaaacggcggtcacggttcaagggacggcggcgaatcgaattgtgacgaatcatatgaaggaaggcaagcatgtcaaacgcggcgacacgctgctggtgtatcacgatgtagctcatcctgcacaattgaaagtgcttgaacagcaactggcgacgttgaaagatcaaaaagcgcagctcgaagttctcaaccagagtattgctgccaataaaaacctttttgcgagtcctgataaattcggttatcagcaacaagttcgcgattatctcagccaacgtcgggtttacgaactggaatcggaagccttgcatgcgacccaaggtgtggccgatggtaagagcaaagaaatcgatcaattgttgcaaaccagtatgcaggcaagcgaggctaaaatgacggcgattcgtgaggcccaaacggccatacgaaccgatcgcccattaagtgacaatcacgcatacaactatctttatttgcaatataaagccgaggctaagaatgccgatgctgctaatttgaacaacttgaaaggccagtaccagtcacagttgcaaaacttattgacaaccgaaaaggaaaccctcgcttccttgcgcacccaacgtatcaaccagaagcaggccgatctttcagcgcagcagacggggcagaatgaggcaaaactggcctcgttgcaaagccatatgcagcaaaccatgactgcagaacaggtgaaagtccaacaaggtacccaagaaggcgaggcgaaactggcggcactaaaggacgaaagtaagaattaccaagtcgaagcatctgccagcggcgttttgcatcttgaagcatccttaagtggcaacaagtacattccggctggcaccgttttggcgcaaattttgccagacttagccacgcaaaaagaagttgagttgaagctggcagtttcgccagcggaaatcatgagtttgaaacgtggtcaaagcgttcggctgcgaattgcggagaatgtcccatcaccgatgacgctgaccggccggattgatgccattgatgtcgcaccaactgtgaatgctaaagttggcaattactttaaagtacaggcccgagtgccactgagtgaacgacagcggcagaccttgcactacggtatcgcaggacaggccgccgttatcacgggaacgaaaacttactggcaatattttgtcgataaaatgtttaatcaccagtaaaattaaggctcatttttaggtgaaatatgaaaaatacgacgttaatcggccaaaacacgacgttaatcggcagattgcgtcacacaacgcgggagatggtaatcttacaataagcaagtgcttgttaaagttgggatgggaattatcttttgttaagggaaaggtaaaggggtatggaatatcaacttgaaatggaagctaggaaattgattatgattctccgtcatgaaattcatcagttgcatccgcttaatcggtcgccggagatggcgtatgtcgttgatagagtcgccggtgatatggacaatgaactgccgcatggaccggagtttgatcgcaattgtttagatttgcccaaaaaattgatttcattttgtcaacccaaagtatccagttgagtcaattggggcgggatgcgattgatgacattcgacggttggcgaacggagaaccacttggcaagccagaaccggaaaggcgtggcatacaacgcttttttgcccatttgtttggctgtaactaaaaacattggaaacacactggttgtcgcttagcgtgtcgatagtttgatcggcagcaggatcacaagtttggggtgttgaagatagacgctttggttgatgcaggtatggtgagcttgatggtgatgggcggtgtcatttgttacgcggtgccggtcttttggaaaagaatacttcgcagacacctgattcacgagattaagaccctgaatcaaggattgcagttatcaagcaaagccatgagccaattaattgatccggaaaatccttatatggtatttgctgatgaaaatggtgaactggatttttcatttttgtggctaggcaacttgcgtcaattgaggcgtgaactgcgtctaattaaagaacagaaagctagggtttgacgacgcgttggtgatttaatcaaaactagcctagaggcacccgatccatttttgcggctagtggcatagacgaaggaggttaagttttgaatgatgggcatatcatttgttatctcgtagctgctgtgttagctgctttaaaaagtgtcatttgagtgccgtatttcagcgtaaactgtcggggtaagagacgaggcctggtttgatcgccaacgcgtgtacgtcagatgtgctaaaatagtgaatgtttattttcattttttcaagataacacattcctataagaagaaggatcggcacaagttatgacggcaaaaagtaatcagacagcgcgaggaacgcggccactttcagaaaaacatcacatgcagattccatggtatgacgtgattgtcagcgaagaacggcaggcagatcatgccacgcttgaggaacgtgcttcactcgttggtcgggtggggattatgttgctggcgtgtggaactggggcatggcgcgtgcgtgaagctatgaacacggttgcgcgtgctttgcgaatgtcgtgttctgctgatattggcctcatttcgttatcctacacttgttttagtaacaaccacgcctactccgaagttctctcattatcgcaaagcggcgtgaacaccgacaaacttgatgcacttgaacggtttgtgcgcaattttgaaaagcaatataccacggaaacggtgcgcgagattcatcatcggctcgatcagatccagaaaatgtcgggtaattatgatccgctgcgagcaggattggctgcggcgctggcgtgttgcgctttcgtttttctgcttggcggtggtccagttgagatggtttgctgttttgttggcgcgggtatcggcaattggttgcgtggtattatgattcgccgcagctggaccttgttggcctgcattggcgtcagtgttgctgttgcttgcttagcgtacttccttgtttttcgtggattagaaatgagtccgggcatcgctgcgcggcatgaggccggttatattggtgccatgctgttcgtgattcccggttttccgttcatcacgagtatgttagatatttcgaagcaagatatgcggtcagggatggagcgcctgctgtatgccttgatgattacgattgtcgcatcactggtcggttggttagtcgcgatgattgtgcacttgcgccctgaaaactttgttgatctgggattgaatccgatgcttttgctgctttttcggttgattgccagtttcagcggcgtctttggtttctcggttatgtttaacagtccaaagcgcatggcggtacaagctggtttgattggggcagtggcgaatacgctgcgacttgaactggtcgacttgagcacgattccaccggcggctgccgcttttattggcgcattggtcgcggggttacttgcttcggcgatcaatcgaattgacggctacccacggatctcgctcacagtgccatccattgtgatcatggtgcctggcttgtatatttatcgagcgatttataacatcggcttaaataatatcggcgttggcgctgaatggatgacccgcgccgctttgattatcatgtttttaccattgggactgtttacggcccgcttgatcatggattcgcgatggcggaaaagtgattgagagcatcatttggttggacacaaaaggcccatttccgtggtaccatggcgcgaaatgggcctttttgtgttccgaaagacttttaagaggtgaaggaagaatgagtattttaaaatggtatgctggcggtcaagaccgagcagaacaagcgattagtattttaactgaactggtggcagacctaaatcatagccagcagaaaatgccgttacaacaagtgttaagtgattatatagaggcgtttagaaagaaggattcagctgttccgttcattctgagccgcatgaatctcgacatttccagcgctctgaaaaaaccagattgtgttaactgtttcagagtcggataagcttgatgcattgacggccctggcgaatattcggtatggttactaacaatagctatccagtgttttgggggcggtaacagcagtcaatcatggttcagttcacatgacaatttgaaaaattaaaaccagccgttatgtttggcatgtcggtggttggtggctgatcggtcatccgtatcaacattgcgccgcattttttgaagtgttaaactgccgttatcattaggagctgatcgtattgggtggaaaggaaacgcggttatttcaggccattgatggcgcctataatgatgccgcagttcagtcggatgatgagattaaacgttttttatttgaatcagcccagcgattggcaagtggtgatcggttcggttacgtcgctgcccgccttgacagcttcatcgcgtcttattcgcaggttcgtcactttcagtatccgtctgcacttgagccagtttataaattggtagcaggcgctagtatgcgagcgcgcggaggcggcgggttgagcgtttggctttgaatatttgtaaggaggacacgttcatgaaaaaacaagaaacacaattgtttgaagcaatcgatgttgcttatgcagaccctgagattgccaaacaggatgatcttcgaaagttgttgttcacatcagcgcaacatctgcaaaatggtgatccctatcagatggttgctgtgaagttgaagaacagcatttcacgctacgtggccttgcatcagttggatgcacctgacgcactgaacaaactttatatgaagattgggccaatggacgatcgagactggggattgactcagatttttagatgaacttgacgacctacagaagggcttttgcacaagcaagggcttttttaatttgccgcaatcacggattttggctcaggatgatagaaaagcagtagtgttgcgcacaggacaccagcgattgctaggccgaccgttaaactggatgctggtaagaggagaccgagcaaggcgagcagccagatgccagtccaactaattaggagtaaagcaatggtgcgaaagtagccagccagacataagttgaccagcccgatgccaacacaaaggctaatgaggagtgggcgggaaaacgaaaaggcatttgttttagccgaaaaatagccgattagcaaagggacgatgataaaaagagcaaaggcgattagaaggccgaaaatggttttagaagagactttgttgaatgaaatgccgcgggcaaagggaacgccaatgaaagcaaacacgacagcaacaggtgccgcgatactgcttaatgaaagtcgatgctcttggccaactagcatcgtgaaaatgatggatgcaaatagaaacatgacaatcggccagtattgatcaaagagataccaggcaggcacacgcggcaattccttcaaaatattgtccgccgcggtctgcggatcgtcactaaagaatgcagccacgcgatggccggctgtttgtgcatcggtcaatgtcgttagtaggtcattgatagcttgttcaatagcgtacggatctttgcgtaaatcagtccgcaaatagccgatgacggtttcggtgtaggtagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcatccgttctggtgttcactaagtcaagcccaagtgaacctttcaagaaggcaaacttgcgctcaatggcaccgcgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccatatatcgcagatctcttcggatgtattgtagctgagcctgaagctgtttgcggcgttccttgttttgacgccgcggtttcctcgaaaaagcggtccacttaccttttgcttcacgtctgtacgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgtgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaaccccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaataaggcttacacttattatacgcttaactattggtaaagcctattatgaaagtgcttttagagtttttcaccatcaactaggtatagtcagtgccgtgaatggcttttagttgttgatcgtttgcagttcggagttgttttaactttttcatgagtagcctccataaagcatttggcaccgttgtcgtgataaggatcgtcaggtcaggatacttccagatgtgactgtgactcaggacggtagaaaagtagcagcaaacaggcgcctaggccaacaaaggctaagccaacggataattccgaaattggcaagaaaagcgtcgccgccgtgaaagcccagattgctgaccacccaaggaataataaagcgctttttcgaaagcaggctgcaagccctaaattcagaaagacaaagccgccacagatgggaatcagtgtggtgctagaaaacaataggttgaaaacatgatttgacacatagccaattagtagaggcaagccaacgatgaggaataggctgatcaagacacgacggattgttttacgagaaagccgattaaacgagatacctcgaccaaatgaaatgccaaagaggcctaacgaaacgatcaacatggggaaaaagtcggttagtaagaggcgggtttcgtgatcgaccaccatcatcaagatgccgtcaatcagcggaaacatggcaaaaggccagaataggctgacaaaataatcaagcggggcaggcggcaattcttttaaaatattatctgctgctgtttcaggatcatcgccaaagaaggttgagactttgcgtcctgctgtttgagcatcaatcaaagttgtcaacaaatcgctaatcgcatgctcaaccgcatatggattcttgcgaagcgcaccacggagatagataaccaccgtttcggtataagcgtaatctgtgccgtgaatttgtttgagctgttgatcgttggccatacgcatttggttcaactttttcatgttgtgcctccttggttgagcttagccatcgcttgactcagttggtgccattgttgctgaaaatcagccagtgtttgttggccagcctcggttaagtgatagtattttcgatccggtccgctttcagatgctcgccgaacgcccacaattgatttatttttttgcagtttcagtagcaacgggtaaatggtaccttcaggaatatcgccaaagcccagcgcacctaactgttcgtgtaatccgtagccataaatatcgccttgttggatgatctgtaaaatggcgccttcgagaatgccttttaacatttgcgatgaaggttgcatggcttaacctccttttggtaccttgttaagcatagtataatcgtgagtgagtaccttgtaaaacaagatacacatttaagaaaaaagtcagcaacatatgctgactaattgggcgtatcagcctgagctggtgggttacttagtttcttttagctcaccatagccaaaaatcatgaagatgaccccggctgtttccatgagtggcttcgcaacgctgccaatgtaaaaaccggttaaataagcggcattagtttgctggggattagcgatctttccgttaatgagaaagaaaatggtgctccctcctataatgagaagtaaaagcaatatgcgatgaggcaaaccgttaatccatgcatgatagtctgggtagtgagtcgcaagtacgatcaagttaatcacaaatgcgagtgtgagccaaccgacaacagacctgaagttgtttgaaacagcttgcagtccccagaggactaagaaaagggtaacattcaaataataggtaacttgaaaatacttattatcccgttgtgcatgtttgtcaatcgcgtcgtaatgatctgtcatcgtctgatcctcctgtaatagttgatccaaagaaatatcataaaaatcgctaatcctgacgagtgtgccgatgtcaggaaaactgcgcgcattttcccagctggaaattgtttttggggaaacgtgtaattgctcggcaatttgtgtttgtgtgagttgttgctgttggcgagccagtttgagtttgtcgctgaattgcatgtccttcaccacctgctattattgttgaggcaggaataaaattacacaagcttttttcaattgatagaggtctgagaatcatagagtcattgatatgacgcgattttgatgcacattgctgatggatgattgttgacactagtgcgcaggataagttgaatgcttgctaaaatgtggggtagcttttggccagaatgcagatgatttggccagctttcacgaccatgggtgtaatagaaaagcccggcatctgccgagcttgtgaccctcttaatgcgtttgaaccagcgagccagccatggcaccgaggaggcagcggaatgagcggccaagttgttgccgatgatgtttatcgaggcgccggaacgccccaagatagtggcgccaatgattttttgttttagctagatcatctaaggtgatggcattgccgctgcgcaaaatgcggtaaagtgcgtccacggtaaccgcagtggctttggcatcaaggccagctaaccaaagggcaaaagttttttggaaatagcgcgatgcccatgttgtggttggcaaatgagcgaaggtcgtgtcggcaatgttccaagtgagaacatcgtgttggccgaacaacttcacgcgacttttgaccacctcaaaattcatcgctggatcgagactgacgccaattaaggagctttgtggaacgagcttggtgacacggtcacgatggcttggatcaagcgggacaccgctcggcccatcgaagctataaacatgagcaacttgactggctaatggttgtggcaagtggtcaaacgcataggtggcgatactgccgcctttggaatggccagtcaggtaataagtgccgggatgctgactgatttgtttaatcaagtaacttaatgcccgacgctgcgctggaatcgttggcatgaagctcatattgagatcttctttccaaccaaccagtttattggttgtcccccgaaaactgacacaataaaccccgggggctaatgtgaatgtgatggccgcgaagtcttcttcgttgcgatggctgcaagtttccagccaattttcccaagtaacccgggcaaaacgttcactgtgacgcatggcgtctaacatgatctgatgagttggaatcgcccaagttgtcaaggtagccctgtttaggcgggtactgtcatttaaatcggcaaaacgcgcatagggctggccgatcaggtaattgaagttcaaataaccaagttgcgcaaataaacccgcaccaagttcagtgagcggtgtttgttgaaatgacgccaagctatggcgttgagggtaatcagcaattgaaggcatttcaatactcctagttcttgaataactttttcgagaaattgactatctctagtgtaaccggtttactggggtaaagtatgtaatatgctgtcaattgttgtgtatatttaatgttcttttttaaaatgttttaaaagtaccgacaaaatcaagtcacagcagcgtttgcacgccagaatgctgtattgttgttaacggaggtgttcatatgccagatttagcacagtcaacgtttattttgccgcaagatgcgacactgacctcagaacagtcagcattggaacagcgaatttggacctttatcaacgacaatcacaacacaacgtcaacacatctattgatcatttcgggtgatgccggtgctggtaaaagtgtggtgttggatgctgcttttgcgcagttgcaaaaagctgcccgtgcgacaagcggcgagttggctggcacagacaacaagttgttggtaaatcacaatgaaatgctgaagatttacaaagaaattgctggtacaaagtcttattttcgaaagaaagactttatgaaaccaacaccatttattaacgcgtaccgcaaagccggtaagcgagcagatgtcgtgctgatcgatgagggccatttactactgacgacgcctgatccgtataataaatttcgtggccataatctttcggataaatcaattctcttatgtttctgtccgaaattctagtacagacccttagctgcggatcatttttaaggataactactagcaatcgaaaaatgtttttcaaaggagaaggctatgcttggtatcatcatcgaactcagcgtcatttgtcttgtattggcgatcattcttttgttgatcatcatcgatatccgccgtatcaatcgcgaactcacctatattaatcacatcgagactaacgctggggtgacaaccaataccaattttcctttggtttgtaaactcgcagctgggattaatgacaatctgaatgccacccgccagttgcggcttgagcaaattgcgcaagaaaaaaagattcatcagatgttgctgaatttgacgcatgatattaaacccccgctgaccgtcgcaactggctacgttcaacttctaaatcgcgatccgcacgccgacgccaaacaatcgctggcccgcgtggcacacaatttgcggtctgttaattactacttacattacctgatggacttcaatctcattcaggaaaaatccacggcgttaaagctaaaacctatcaacttatcaaaattactcgaaactgaattatttgattattttgaccaattgacggccaatggtatgcaggtaaccccaaaaatcgcgcccaatcttgttttaacaaccgatgagacgatgatgcgccgagttttccaaaatcttattggtaactggctgaaatatgccaagaatcaggctagtgtcacgctcgttcgccaagatgagcagcacttgaccatcaccttcaccaacaacaccgacaaaccgcttgcgaatgctgaccagctcgttgacaggttctacacaaccgattcggctcggacaacccaaagcgtcggcttgggtctgagcatcgtgcaatcactcaccaccacgcttggcgggaaaatgacgctgcaagcagacaggcaacaatttgctgtcacgctcacctttcgcgaccacaacgtctaagatcacgcctttgcctagtccattcgtgaactgggtttttaagctgtcattcaaaaagcatcagttcatacaaaacacttgctttttgtatggagattgctattctagtaacagcttacaaattggaggggcatgatttgaaaacacaacaaaaatggcttgtggttgctgctgcagcactcacttttgtactgactgcatgcggtacccaatcgagcaaggacagttctagttccagcaagcaacaggtctggcaccgaatggaagccgatgtgttgcaaacgcttgatccaagtaaagcatctgaaggtgtctctggacaggctatcattgataccatgaacgggttatataaatactacggtcacgacctgcaaccagccatggcgaccaaaatcgtgaagccgacaaataatggtctcacctacacctttacgttacgcaatgccaagtggagtgacggcaccccggttacagcccaagatttcgtttttgcttggcagcgaaccgttgatccagctaccaagtccactcaggccaacatgtactctggcatcaagaatgcggacgacattcgtgcaggcaaaaagccggcaacagatctgggcatcaaggctattaatgataaaactttagaagtcacgcttgaacacccgattccttacttcaatagcttgttaaataacgttgcgtttttcccgcaacctgctaagaaggttaaggcatggggcgccaagtacggtaccaagtcgcaatatactttgtcgaacggcgcttttaaatccaaaggctggaccggcactggcgataaatggacagaagttaaaaataccaactattggaacaaaaagaatgttcatttgacgcaaattgacgttcaggtagttaaggataccaatacggcacttgacctatatcgcactggtaagcttgacgatgccaatttaaccggccagctcgctgcccaacaaaagggcaagactggctatgttgccactaaacgggcccggacttacttccttgaattaaatgaaaataaggtcccggcattcaagaataccaagattcgccaggccatctccatggcgatcaatcgcgactcttttgttaaaaatgtgttagccgacggttctattgtcgcccgtggcattactccggctgatctcagccagttgccggacagcagcaccgattatgcaacagcggtcgccaagaacacgaaggccatcacaacttacaataagaagaaagctcaaacattgtgggcagaaggcctgaaagaaattggcaccaaaacagttgatgttgagctgctaggtgatgatgttgatgcagtcaaggcaactcaagaatatcttcaaggtactttgcaagagaatttgccaggcctcaaaatcagtatcgccagtgtgccagctaagaaccgtcagcagcgcgctgccacccacgattttgacatggtcctcagtacttggggggcggattatccagatcccaacacctatctcgatttgttcacgagtagcagtgaatacaaccatggccagtggcaaaatgctgactatgataagctcatggctaagagtaacggtgcggatgctaacaacccgactgcccgcttcaaggacatgactgaagctgaacagttgctggtcaatcaagccggtgccatcccgctgtatcaactcgttgcagcacgcatggttaatccgaagatccatgatctgaagacgagcccgggcaacagtttcaactttgtttacgcctatctgaaataagcgcttcacggcgttttgaagaaacaatctaggctaaaaaatcctttgccgtgccaaactccgcaatctccggccagctggggcttgcgacgcgaagctagagcggagacggcgctttgagcccgcaaagtgcgcggtctcaaagtcgcctaacaacatcagcgacaaagcccggtcgctgtgttgtttccacggcttttgcacggctgagccccatctggcctacgattgctccgccttggcactacggtctttaaaatcgcaataaataatccatgagaagtcaaaaacgaacggttttccaataacggaaaaccgttcgtttttaatagctgactaagaattatgacccagccactttattttgctagtattcagcctctccaaataagttgccaaacttttcgcgacgaaatatcacgtcatatatcgcaaaaatgttataattaacattaatgaataggaggtggccgtcacgcaactgacccagcgccaaaataaaatcattcagctactgaaagcggaaagtccgatgacaggggaaacgttggcgactaagctcaacattagtttggcgacaattcgcgctgatttacggctgttgacaacaattggaatcttagatgcgcgacctaaagtcggctatgcgtatcaaggcgagaatctgttgcaaatggatagccaaaagttctttcagaccactattgctgctatcttactgccgccgacggagattaaattgacgacatcaatggaagaagccgtcaccaaactgtttttagccgacgttggttcattgtacgtattagatgatgatggtgctttagttggcctcatctcgcgtaaagatttattacgagcaagctttactaatcgcgatacaacgttaccagcgagcatcgtcatgacccgcatgccgaatgtgattaccgtcaccgctgatacatcgatcatcgcggccagcaaactgctccttaaacacaatgttgattcgctgccggtagtccaaaatgctggcgatacccatgtgattggaaaaattacaaaaaaccgaatttttaaatatctcattgaaacccttgtcccataagctgttcgtacattgttgcgagcggcttttttgttgtcattaatgattcaaaaaataattaggccaattttatgtgtaaacgcttgcattttgtcttcaaaaataatacattataaatcgaacatatatcacgtcacattaaacgaaaggaagactttatgatgaaacagatttatgcatttgctgaaggcaacatggagatgcgcgcacttttaggtggcaaaggtgctaatttggccgaaatgacgaatcttggcctgccggtgccgccgggattcacgattaccactgctgcatgccacagctatcaaaccaatcacggtctctcagatgatttgttgcaagaattagatacacacttgacggccttggagcaggcaactggcaagcagttcgatgatcagacatccccgttgctcgtgtcggttcgttccggcgcgccgatttcaatgccggggatgatggatacaatcctaaacatcggcttgaatgatcaaaccgctgtggctttggcaaaactcacgaatgatccgcgatttgcatatgacagttatcgccgcttgcttgcgatgttcggcaatgtggtctacggcctttcggaaaaagcgtttgatgacgttctaacgaccatgaaacgtgataagggctatgcttcagatttggatctgacaacgactgatttgcaggcaatcattgcatcatttaagcaactgtatgagcaggcaggcaaaacgttcccacaggcgcctaaggatcagatgttagcggcaattgcagccgtctttgagtcatggaataaccacagagccgtgatttatcgtcgggaaaatcaaatccctgaagatcttgggactgcggtgaacattcagaccatggttttcgggaatgctggtgaagattctgggaccggggttgcctttacacgtgatccggcaactggcgaacgcgccttgttcggcgaatatctattgaacgcacaaggtgaggatgtggtttccggtgtgcggacgccgcagccggtcgccgttttgcaggcacaaatgccagcagtttatgatcagctggcaaccatcgctacgaaactggagcaacattatcgtgatatgcaggatttggagttcacgattgaacacggccatttttatctgttgcaggcgcgtaatgggaaaagaacgccagccgcggcggtgaaaatcgcggttgatttagttaatgaaggactgatcaatcagcatgaggctattctgcgggtggcacctaaatcgatcagtgacatgctgcatccggaatttgatcctgaagtgctggccgcgcatactgttttggcaactggtttgccagcttcaccgggagcggcttctggtgaagtttacttcactgccgctgatgccaaaacggcgcacgatgccggccatcaagttattttgatgcggcaagatacctcgcctgaagatattgaaggtatgattgtcagtcaggcaattgtgacggcgcgtggcgggatgacgtcacatgcagcggttgtagctcgcggcatgggtgcgactggggttgtcggcatgcacgcactaagcgttgatgaacatgcgaaaactgccacggttgggtcaaccgttctccacgaaggcgattgggtatcggttgacggtaccactggcaatttgtatcgtggtcaaatcaccacaacggcggcgatggtcaaggaaagcttagccactttattgacatgggcaaaagatgcaagtagcatggccgtgtttaccaatgcagatactcctaaggatttggagcaagcactggcatttggtgctgatggcatcggcttaacccggactgaacacatgtttttccaaccagaacgactgttgcagatgcgccgattgattttggccaaagatgcggctggtcgcaagacgccgctacaagcgctagaaaaaatgcaggagcaggatttttacgagctataccggcttgcgaatggtaaagcattgacgattcgcctcttggatccgccgctgcatgagttcttgccacatgatagccgagaaatcagtgaagttgcgcaagatcttggcctggagcaaaatcagctacgcgaacggatggctgccctcaaggaagtcaatccaatgttggggcatcgtggtgatcgattagctatgactttcccaaatatttatgagatgcaggttcgggccatgatgcatgcggtattccggcttgccgacgaaggcatgaaggtcaccccgcacatcatgattccactgaccaactccgagactgaattgatctgggttcggaaattggtaacagatcaaatcaagcaactagtcgcaacaaaagggatcaaagtcgattacgaagtcggcaccatgatcgaaaccccacgtgcttgcatcacggccgataagattgcgaatgctgccgatttcttcagttttgggactaatgacctgacgcagttgacctttggctattcccgtgatgatgttggctcgttcttgccggactatttgagtaaaggcattttaccagcagatccattccaaaccgttgatacggaaggtgttggggccttcatgcagatggctgtcgagaaaggccgggcgacaaagccgcaactgaccattggcgtctgtggtgaagtcggtggcgatcctgactctgtgaccttctttaaccaaattggcgtcagctacgtttcgtgctcgccatatcgggtgccggttgctcgtctcgctgctgctcaggcaacgttgcgtgcagaaaaacagacgaagcagccttcataaagccgcttgcagtaaaaagtttcgaaaaagttcgattttctggtccacatgacaagtttataaaaaacgaaaaccgacttgatggataaaaaagaagctatatcgcgcccagcagaatgctgtgcatcagatatagcttctttttagtaacgcgacttaatcgtcttcgtcttcgggttgagcttctgcttgggaacgcgttagccgattgagtttggtaatcggaattttaccaagaaccagtggcacggtttcatcgatggtatccgcatattccaagccgaaccattgcgcgggtgaaactgcgatgtgctggagtcgtagccgcgcctgaatgatggccttctggaaacctttgatctgggtctgcggtgaaagctcttcgtgcagcaagacaaaagtccagtcgccaacttgtcgatccggaatggttgtgtatttttgcggttgcgttggtaattcaccttcacgcatcatgtcattgacaatttgccgtaagaacacgttgacctgttgttgcatccggaagccgagatagagttggacgttgaccatataatcggtcccatacgtatccgttgtatattcggcagtatacggttcatccgtaacattgacagtaacaaaccagtaaacccgtgcgcgttttggccgtttatccaaaattgagtagagaatttcctttttgatgtaatggtcattcgcaatttgggtcatgtaaaccaagttggtggtgtatgttggataatctggatcgttgcgaagctcggacagttgatttttataggcaaaaagcgaagccatttcggctcgataagtgttgtcgtcgcgaattctgccaccgtattgccaaacatacatcacggccaaaatgataaacgcgatcatggcggtgacataaccaccgtgcaagaacttaaccgcgctggagatgaagaagactgtttcaatggcactaaagaagatcaatgtcccgatcgcaatcacagcaggcgcatgacgcgaacgcaggtattggtacagcagtagggtggtcatcagcatagtaatggtgatggccaagccataagcaccttccatttcaacactggttttgaagtagccaatgatcgctaagcaagccaaccataaaatggtgttgacgactggaatataaagctgcccctttaaccttgttgggtaaatgatgtgcagtcgtggcaagaagcgcagtttaatagcttcggaaaccagtgtataagagccggaaatcaatgcttgtgacgcgatgatcgccgccaaggttgctaaaataattgcgcctaaccggatgctttctggcaacatctgaaagaacgggttgaagtcagtaatcttgttgaacaccgttacttttgaattttgatccagccagacagcttggccaaaatagttgagcaccaaacagatattgacatatggccagctgagatagatgttaccgcgaccaacatggcccatgtcagaatacaatgcctcagcaccggtggttgccaggaaaatactgccaagaatgaagagccccattttattgtctggactgaccagtaaatggagtgcgtaataagggttcaaggcgcgcaacatggaccagtcctttgacaaggcaataaagccagcaacgcctaagaatgtaaaccagacaaacatgatcggaccaaacgccttaccaatcagatcggtaccaaatcgctgaatgaagaacaggaaggtaatgatcaaaatggtgacccaaatcacctgttgctgattgtcgattaagatgttgccgttaatatggacacccttcaaaccttcaatcgcggttgtgacggtcacagccggtgtcagcatcccatctgccagcagagcagcaccgccaaccatggcgggcagtaccaaccaacgagcgcgctggcgaacaagcgtatacagcgcaaagatcccgccttcaccattgttatcagcccgtaatgcaatcaagacatatttaaccgtggtgataatgagcagggtccagaaaatcaaggacactgagccgaccaaaaagtcagtatcaaaatgtcccatgccgccgttgccagcaacgattgatttcattacgtatagtggtgacgtcccgatatcgccatagacgacaccgagggttaccagtaaagccgcggcagtaattttatgtcgcagtttcttattagcagtcaagcctgacgccatttttgagcctcctgaaaagtaataccgtcattgtagcagaatcacgacatattgtaaggcgaacttgcggcattcgttcgcctgaataataaatttagttatattgtcggccactaatgaataagaaacagcggcatgagttacgttatgttgtttttatttcattgatcagtttcgtaaaattcgttgaaataagtatcaagatcgagtggcccaagtttgaagggaatatggtgggctgctaaacccaacagtagttgattgaaatgctcacctggcaatttttggattggcagcaccaacataccgttgggataatgttcccacggcatacgtggtaaacggctggcattttcttcagcaacctgcacatataaaggctgctgttcgtgttggtcgatggttttgatgatcttcccgtcacgcatgaagtagatgaggtcggcgtacccttgcagattgttcagcaagtgggagaccgtgataatcagcttgccttctgcgcgtaagccgcgcaaaatgcgagacattcgcgcaacattgatcgtgtcaagtccgttcataaattcatccagtagcatgatcggggtgttagccgccatgaccataccaaaacataaccgctgtttcatgcccattgaataggtacgcaccggttgattgatgtagtcccgcatgtcaagcacattgataatctgtttcacgctcttcgaacgattgtgccaaagcttggcataatactcgaggtgcgctttgccggataaatctggataaagatcatcttgaactgggaaaaggcacatctgccggtgcagcgcaaggctttgtttctgactaccataacttttaccatctaccagcactttgcctgcttgtggttttagatcattgagaatcaatctaccaaatcacggcataacatgacaaagacggctccccaaatggagaaccgcctcaaatgataaatttattcttcaacaccagttgacgtagagccaaaagatccccgaatggtgccagcaagcttcgacttttgccgggcaaatttaaacttgccttcaagctcagtcggcaccgccatgccatcgctaagtttaaagccaaccgcgcgttttttggggtcggacaagctatacatcacgttgatggctaatccgtcttgatagtaaacctcaacccagtgcaaatccggtaagttcaaatcgctgacttccaagggcttggcagaaatttgtaagtcgcgttcggcgagaatttcattaacccacgcgagactgtcaggtttttcggcagccggataagtgatataaggttccttatacttattccagatgtaacgcgcttcatttgcgcgcaatcctgccaatgctgcagcaacaggcgagctttcaagaccaatggtgctgaccgttttaaaatcaactgtataagccatgctttcatactccttcgtcagaaaaacgcgtcgctaactgcggcgcgttcggtgatattagtcgttaaaagtcccattttcaacatcagagatgaattgcttcaaatgtttgaagtaaactggggcgttatcaatcatgtgatggtggccgccgtctggggtggtgaccagtcgggcatgtgggatgacctcagccatacgttgggctgacttcagtggcatggtttcatgttcgccgaatgtgagcaaggttggaaccttgatattgtgaatctgatcactgatatcccagttcttcaacttaccggtcacaacaaactcattgtcgccttggaaagcattgtagacaggcgtggccatggtgctaatcaggtgtgaaattgctggtggctgtttgcgatcaacataaccgcgattgaggacatccacatatttttgatactgcgggtcgtcccagttaccagctttttcaattttcttcatgtacttaaccgctgacggcggcaaagcttcttcacggacgaggttgatatgatcaacgtattcgttgatgttgtcgaccattgaagagataattgcgcctttaagatgctgaccatatttcagggcatatagctgggttaaggcaccgccccagctttggccgatgaggtaaaaatgatccagacccagcttttggcgaacttcttctacttcgccaagaaagtagtcagtggtcaggtattttttagcgatttccgggtcggtataatccggctgatcggaataaaacgagccaagttggtcgtacatatgtacctgaacgccaagatcggccagctcttcgccaaagttttcccaatactcatgagtgccaccagggccgccatgcaagcaaagaagatggatatcgccttcaccttgtgtgttggtccacaaatgatacccattgtctaaggtcaggattgttgtcccttgtttcatttgatcaccttttttttcttagaataatctcattgtaccacgcgatgcggtgagctttaattcaatttctcgacttgttcgcgaatgtcgcgaatcacgtgtttgtcaccggaaaagattaaatgatcgccgagatgaatttgggtgtcgccatgcggtgcaacgaactttttattgcgatagatttgactaacggtaatgtcatcaataaatggcagatttttcaattcaaggccagcaaatcgcgaattgcgaacggtgatttcgtaaatgccagcaacggtgtcatctagaatttgcaaggttgacggcgtttcaatgagactccgcaacaaagcaacatttgcctctaaggcgttaaacacttcgacaccttgggctcgcaagcgatcatagcgatcactggtagcatcttttggagcgaatcgcgcaatgatccgtggcactttttcggctaatgccatggtcgcgagatcgtagttggtgtccgcatcgaaatcgccaagaaccatgatgtcacagtcataagcaccagcggctttcaaagcggattcggtataggctgccaaggcaatgttgatttctgaattatacgtgtggtaattttctggcttatctgtcaacagttttacttcatagcgatcaggactgagatgttgggcaatcggtactgtcagcagattgccaccgatgaaggtcacttttgtctttttaaaatgttccggttccggctggaaaaaggtgttgaagagaattggaccggcgacacaggcaatgacagcggcgagggtgaacgcgccggattgctggtctgataaaatatcgagattgcggccaactgtcagggtcgggatgaccagcgtgatggtcgttgtcagcaagaaaccgccagccaaggcattttgaggcttaaaccgccggcgcagcactgggatcaagccaatcttagcaataaagaagccgatcagaactagtggaattaatgaaagactttttgggtcggcaaccagtgcttttagatcaagattagcgccggtgacaatgaagaaaataggaatgaagaacccataacctaatgaggtcaacttatcctgcgtttcttgccggggaccgagcagtttcatcaccatgccagctaggaaagcaccgagaattgattcggcgccgacccgtgatgccacggtgactaaggcaaaaaccagaaagaaggccagccgaatgtctaactgcgtcgtacttttatcaatggtggcaaggaagccgtagatgcgcttaaaccggcttagaaggaataaggcggcaagcagcaacaataataatagccacaaattacgatcagatttgcctgctaacgctgagtaaaccgtcaaacttaccaacggcaccacttcaccaagggcggcaattaataaaatagtttggccaatcggctgatgcagcaactctttttccttcagcgcggcaatcacgacacccagcgcgatggtggtgaacaaaatcgtagcaaaaatcggatagttaaagaagtgaatgagttgcaggaagtagctaaacccgagactaagcacgatgacagtcaaaaatcccgtgactgctagcatgaccgggtttggctgcttgggtccatcagttgttttggactgcggtttgaaaagcgagaagtcaatttccatgccggaaagaaaaatcagaatggtgacacccaactcactcagcgagcccatctcaccaccagtcctgacccagcctaagacactttttcccagcacaatgccaaccaaaatttccgcaacagcagtcgggatactattaatatgaaaatgtgccatcagcagcggcgtcaaaaacgccgctgtgagcacaattaataacgaaatggattccataatgtcctccaatcagcgataatagatgggtcaatggtaacgaaaagtgcggataaaagaaaggaaatatcatgtcacaaaataataaatcaaaaaaacaagaccagcgtttctttaatcggcgctctgtcatcgttggtacatgcgtgttgctaggtcttttgattagcttaccattcaagcaaatattattaggcgtcgcgattggcttggcggttgggtacgtgcttgaagcatggacgccgttgttgaggggaaagctttagaccgcttccattgacggctagtttgagcaaggccgtgtgcaattgtctttctatctcagtcggaggatgcccgatagtccgagttggcggagcggcgatgggctcagccgtgaaattgttgttggcggtttaccgcctacaacaaggccagactccatcagaagtcttcatgggtaaaaagttgcacttgagttgacaattcgtcgtaacaaaaaagagccgctggctggtaacctgcgactccgtggagcaacaatgctgcttaaccggtgacctatagtcaaattaagctgtcacgataagcctacccagctagctcgtgacggctttttggtatcaccgatcgttcagcttcagaaccaaggtaatcagtccgagaataaataacccgaacatgatcataaggctcaaagcttcgtagatcgacatcttgctcctcctttcaaagaattttgtgatctctacagttctaaaaccatagccaccacctccttcttaagaaagagccaccgtcgcgtagcattgtcgtttccagtctatcagttgctattagctcacgccatatataccatttgttatatataaaaagagacactcatatgaaacatactaatccgttgattcatatcagcaagacatgatagcatttgagcgtaccaaaagcgttgctggtgggagcaagcgctatggttcaacaatgctacttaacggcagctcgtttattgaactaagtcgtcacgagccgagcaagcagcaacccagtttaaagataagccgtcacggagctgtacaagctttccgtggcggcttatttatgtctatctacctacttcaacctccaacttctctggaaacttcttcatcttcaaaaagcaccgaagcatcgtttgtctacccattcaacaagctgatcacatgcatctttttcaatgcagccgtagaatgagctcaataaccaaaacggaggcaactgacatgctgaaaattttgttcgaccatatgcacggctgggcacgggtaagtttttttctcgcgccgttagcgatcatgggcgaagcattgcttgacctgcaacaaccgaccttgatggctagcatcgtggacgtgggattggctaagaaagatatgacttatgtttggcataccgctattctcatggcagtgattgctattgctgcattcgctttaggcgctatctgtaacgccttctcctcctatgcagctctgaaaatgggccaaaacctgcggactcatctgctggctatttcactggccgatcgcgatccccaagcactcaaacccgaaacactcatcacccgcatcacaaacgatgttacgcaaatgcagacgctggtaagcatgctgacgcgcggactcgttcgctcgcctatgctgctgttcggcggcattgtcatgtcgattatcgtatcaccacggctgtcatggatcattttgattgccttacccattcttgccatctatatctacgtcatcgttcgacgttcgctgccactttacacggctatgcaaggacaagttgacgtcatgaaccggattatgagtgaaaacttgactggcgccaaaacgatcaaggcgtacgtactggaagaccaccaactgactcaatttaacactgaaaatcgcaacctgcagacgattagtcaacgcgccgttttggcaacggtcactttggcgccactgatcatgctggtgctgaatctggcagtcgtcgctgcactggcttatggcggcaatctagccatcagccgcaccatcaccactggcgaaatcagggcgttcgtcaattacatgattcaaattacgacggcgatgaccaataccgttaacctcatcacgaccttttcacgggcaattacttctagtgcacgcgtcagcgccgttttggccgaagaggcaggcactgaggccagtgggacattacctgccccagctggtagcgccatccagtttgagcacgtgaactttggtttttcgcaaagtcgaccgatccttgatgacatcaatctcaccgttccaagcggtcagtggctgggcattatcggctccactggttctggcaaaaccacgctgatcgccttattaacccgactttatgagcattatcaaggaaaaatcacggtcggtggcaccgatatccaacaaatcaccttaccggctttacacaaaaaaatcacggtcgccttacaggactcactgcttttttctggcactgtcgcgcataatctgagttatggcgcgccgcaagccacgccgacacaattagccagcggcgttgctatcgctagggcaactgagtttgtcgggactaattatgatgcccccccgtcgaagaagctgggaaaaacttttctggcggtcaacggcaacgtctgaatcttgcccgcgccatcatccccgatcctgatattctggtcatggatgacgctaccagtgctgtggatcaggaaaccaacactgagattcaagatgccttggtcaaggcccgccgcaaccgtacaaccatcatcatttcgcaacgcgtcccgaacatcatggactgtgatcaaatcatcgtcatgcaaaacgggcaaattacggctcgcggaacgcataccgagttggtcaaaagttcgccattttacgcgcaactggttcaaacccaactgggaggtgactacattgattaatctcaacggcagacgcgggccacgtaatctgcaccccgaaaaagtcaccttagttgattggaaacaaaccgtgcgaaggatttggggctatctcgatacagatcgccgcaagttgctgatcgtttttggcctcacattattcacaacgttggccaccattgttggcaaccgggtcaatgggatcgtggtcgaccagtttatcaccaaaggccgtctgcgcgaattgttcattgtcagcggtttgttggctgggatgtattttctgagcagtatcttcacgtattttcaaacaagtatcactaccaaagtcgcacaacgcactagtgctgcgattcgtcacgatctgtttgccaaaatgcagcgtttaccgatgcggtattttgatacgcatgataacggcgatatcatgagccgattgaccaacgatgtcgacaacatcaacaccgcactgatgcaaacttttgtacagctttataccggcattatcagtgttgtcggtatgggtattgccatgttactactcagcccgctactaaccggcattgtcgttctggcgtctgtcgcgactttcttttactcgcgaaccgcagcacgcatcacccaaaaagccttcacgattcagcaacaagaattgggcagcttgaacacccaaattgaagaaaatgtttctggtaaacagttggtgcaacttttcgatcatcagcaagataccattgatcgcttcaatgaaaccaatgcccgctataccgctgcggcttatcgcgcgcaactcttctccggggtcatcggtcccttcaacaatatgaccaataattttgcctacttgctgatcacatttgccggtgcgcttgccattcttcgcggtgggaccagtatcacagtcggtgtcattttcaccttcctgatctatctgcgcaactttactgggccgataaacaatattttgaaccttatcaacaccttgcaactttccttagcctcggccgaacgggtcttccaagtcgtcgatgctgaccctgaaaaagatgccccgaatgccgtcgagttagatcacacagcgggcaatgttaagttcgatcacgtctccttcgcctatgacggtaaaaccgaggtgctacacgatattagtttcactgctcatcaaggggaagtcgtcgccattgtcggtccgactggtgcagggaaaacaaccattatgaacctgctcaccgatctatacccactcaccagcggcagcattacccttgatgatcacgatgtcacccaaattacctttgctagtttgcggcggctcgtcacagttgttcagcaagaatctttcctttttaccgcaaccattcgcgaaaatattcgcatgggtcggccagacgccactgacgccgaagtcgaaacggccgccaaagccgcaaatgctgacggcttcattaaccaactgccagacgggtacgataccatgctcagcgaaaacgctagccgcctctcgcaaggccagcggcagcacctcagcattgcccgcgcctttgcagcccaagcacccgttctcgttcttgatgaagcgaccgcctccatcgactccaacaccgaaactgatgtccagcatgccatgaaccgcctcatgcaacagcgcaccagcttcgtgatcgcgcaccgcctatccacgattcgcaatgcaagcaaaatcctcgttattgaccaaggcaaactcatcgaatctggtacccatgagcaactgctggcggctggtgggttctatgctaagttgtacaatagtccgctggcggatatggataagatgaaacgataaacaagcttgcgttctagaacttaatgctgcttcaataaaacgtaagcgcacgattgtgaggtacatttaaaacggcttcggattcccttatgattccatcagaagtcttcatgggtaaaaagttgcacttgagttgacaattcgtcgtaaaagaaaagccactcccgaagaaatggcttttgatcttaaatcttgttggggtgattttgtgagtgaacgcgatacgagaaaatgagttcgttatgtgcgcgaatcaatcggcccgatactgtctggtctgacatcaccatgccacctggcagtaatgcatggtggtactgataaccagggaaaaaaggtgccgttagttcgaactgatgacctgtctttgtgtgcaagacctgcacatcacgtaagtcttgttgatgttcatccacatatttaatcaccaatgttgctggtatcggctgtgacgttaaagaggcggttgcgctgtaaataaagatcagttgttgttcatctttggtcataactccgaccactgtaggatcgccaacctcactgccatctggtagaacagccttctgaaagttatagccaatcagagtcggtgccgttagccgaaaacgctgacccaccgcgttcgttaaatggttctcaggcccaagggacttgccggtctcatcaacataatgaatggttaattttacttgtgccaaaatgtcccttcctctgtgatgtccagaaaatgttgcggttaagcattgcgagctgtgaagcgtgcttgtttgatggtcgggttttcgagctcatctagcaaggcaacggcaagtgtgtcgctatttaagacagatttgccgctatcatctttcaacagctcgtctttaccacgtacgtaggctgtagctggtccaggctgaaagttagcgcttggcgaaataccaagccagtttacattatcggtccaccgtaacaactgcagttcccgaaattgattcaatggtgtattaataaaagcagcagcgcgtggatctttttttaatgtatcatacaatgtctggtcgccattttttagactgcctgcgccaagaataaaaatcacacgtggcttatcagtgttgcgtaactcatgaattaagtggtcggccagatcaatgtggagataagcttgctcaacagttgtcgcaaaagcatcaataacagcgtcataacccgtcaactgctcgcgcgtcaacgtgaacgcatcttgttgaatcagatctgcatccggtggcaagattccaacacttttatctggatggcgaacataaccggtcacttcatggcctcgtttgagggcctccttaaaaatagccgaacctgcatgtcctgtggcaccaataatcgcaatcttcatctaaaacaacatcctttcatgacgattcgtttctttttcatgatacacttacaaaaagtagatggacaatcattttaacttagaaaacgattctgccaatgatctcatttagcatcaaaaaatgctttacagtgcgatagtgctcctgtataatcttacttgttgttcagcaatggcccgttggtcaagtggttaagacaccgccctttcacggcggtaacatgggtttagtggctgcttaaaaattctataattcaggcagttaagctaatatatgcattattgcggtataataaatccattggaattagctgttttcctgcattttccttgcattttttgggaacctactcggaggttatcgtatggtctatcgtcacagcccgcttcaattgtcatttgaatcctttggtgccggtttaagtaccccacttagctctaacaatgagtgggtccagttggcggaggtcatgccctggaaagctctcgatgaggcataccaattggagttcaccaaaaatgcgggacgtgcggcaaaaccatttcgtttactctatggggcaatcctgatccaacaacggatgggtttaactgatcgtggggtggttgcggcaattcgtgatacacccgcacttcaatatttcatcgggttgtccgaatacaaagcggttgagccgttcaattattccagcctggcacactttcgcaaacgaattgccgatatctccgagctgattacgaatatcatgaatgatacagtacgcgccaagatcgaagcgttggtcccattcaaagtggacaccgtcatcacggacgcaaccgcagtgccagtcaaaatcaagtatcctcaagacaccgtcctcctcaaccaagcaaggctgaatcttgaggcgatggcgatcgatatggcacaccaacttggtgtgccaaacccacgcatgtacaaacgcgaggcgaagcattgttggacctcattttcacgacatccaaagcaacagcgtggtggctttcataaacaggtcaaggcccaacttcaatatgtgcgccgtgatttgcggtacatcaacgaattcatcgatcagggtgcgactctaccagatgaacaagcgattcgcttaggcgtgattcgaattctatttgaccagcaatggtacatgtatacccacaagactcaccacgttgaagaccgaattgttagtctccaacagccgtacattcgcccaattcaacgtggtaaggccaatgctaaagttgaatttggggcgaagattgactgttcgttaagtgaaggcgtagtcgacattgaacgttttgatttcaccgcattctctgagggccaagacttcgcggaaactttagaccactattacgaccttcatggacattatccggatgaagtactggccgatacgctgtaccgtaatcgggagaacctaaagctgtgtaaggatttgggtatccgaatctgcggtccgaagcttggccggcatccaaaacacgttgatgcagcgaaacggcgtgaggatactgatgccgagaatcgaagaggtaccattgaacgccggtttgcttttatgaagggcacgctggggcttgacttggtgaacactcggacagctgaatcactggccgtcaagattgacgcggccatcgtcttgagcaatgtgctgaccctgttaagggtatttgctataccaattttaattttggctaaattcgagggtgaggcctatcaaattcgctataaatttactacaagggtcgaagatatggtggcctagttcaacagccactaagaccactatcaagaattcgttatcatcgttgcacttgacttgaaaattgaggatcaacagtttttatgcgccggttttgattgttttctatatgcttgcgttaacaagtacgcagttatcgtcagaactccaatacggcactttaaaatccttactttatcgtcgatattcgtcaagcaaaatcttggcaagcaagtgggtgacgctattgctatgcacgctcgttttatatgccagtagcttaataatgagcttatgtctcgcaataacagtttttaatggcaagattgatttagtcgcaaagggcataaaaggacagcaagtttggcaaatatggttaatgaacaacatttcctcattcttaacgctgatattcatattgagttttgtttgtctactcgcaacgctgtttgaaaactcaacgcccgctatcatcattggcctcagtacatacttcattgtttcaatttttaatcagttgatgtttatgatgatcaaacaacatgaatggataaaatggaatccggttaacatgatgaatttaggcaatcaattgcagaacgctgaactaagtaagttgacgcggctgccccttagtcaaattagccttggttatctgatttatgcagctgcctttttggctttaagtctagtggttttcaagtatcgtaatgaacgctaaataaaagaagcatttggattgcggatgcgtacttgtcatgacttcaggtttgggttttaaacaatctaaagaacattgctttgtggcacgtagacggtttttaaacactcgaaatattagttaattgataaagacttttagactcggttctatgaagtctttttttgaattgcaatacggcaattgaaagaggctttttgtgctggagctacatagaaaaatgtcaagtgttatacttgtcaccaatatgtaatatttactttgtttttttcggttgagcgcgtctcggcttgggtcatgagaagggggcaaaatcattgcaggcatttagtaacgaaaagtctcagcataagatgtataaagcgggtacgctatgggtggcagcgttgattggcgtggggatttgtgtgggtggtagtcaaatccagtcagttgcagcatcgacatcgcatattcattcagtggtcaccaacgcgactggaacaacgccgactaatcaagcaacggtattgaaacagcaagaaactggcgtgaatgcccagatcattgccggtcatcaaaccgatcaatattcgactaagggtgtcacagacgctggcgatgacacaacgagcgctgtgccagacaccgatgtttatcagaatcgtagtttacccataactggcaatgccgtcgtggtcaggtgtgttgatttagagggtaatatgttggcacctgataaggtgatcactggcaaagtcggcgatccttatacgatgacagcacctgcctttgactattatgaaaatccccaattagccacagacatcgcaccagcaaacgggactttcaccaatgacgtacagacggtcacctttgtttatacgaagacaccaattccgcgtggcagtgtcaacgtgaagtttgttgacgtagacggcaaacggttggcatctgataaaatactcactggtcaagccggtgatccttacgaagcaagaccaattgatatgacgaattaccaatttgctcgtttggcgacaggcagtgcgccggaagatggttcatttacggacggtacgcaaaccgtcaccttcatctacactaagaatccagttgctcaaggaactgttgacgtgaaatatgtcgatgacaatggcaagcagattgcgcctgataagattctgaccggtcatgtcggcgatccgtatgctgttacaccaacgatgatcgcgaattatcactacttacgattagcatctggcagcatcgcggaaaatggtgcttttgcaacaggcagtctaaccgtgacgttcgtttacgcaaagcaagcgacacctgtgaccccatcaacgccagtcacgccatcaacaccaacaacaccgtcaactcaagttttgccaagtatgtcggatacgccgacagaatcggcaccgctatccgataatgacaccgcgccaatcgaagttattatcccaaccaagcaaataagccgttacttgccgaataccggtgataaccaacggaccggcttaattgcgatcggggtggctttgctgcttgccttgatcagttttggatcatttggactgcgtcgtcgggaaaagtagttattgatctgtaaaaaagagtttgtaaagaatctcacgatgacatttcttgcgtgggactttttttgtgcgcttatcgccttttgagttgtgaattgttgactaagtgagcgttcagcgttatatactaactataacaactagaacagttagaaggtgaagacgtgcaactgacaatcgatttcgattctaagattccgctgtatacgcagattcgcgatgctatcgtgagtggcattgccactggggacttgacgaatggcactattttgccgtctatccgcgcgctgggcaatgaacttggggttaatctgcatacggtgaataaagcctataaggaactacaaagggaaggttttgttgagatccagcgaggtcgtggtgtcgttgttcacgcgcatggctccccgaatcaagcagtggcagaggtgctgcgacctgccttagaaaaggttgtcgcggaggcagtggcccgacatttagatcgggatgcactgcacaccatgattgatgaactttatgatggtctgaaggagtgattaaagatgcaagcagaaatggtgattttagttgttacgtggttgatattggttgcgattcaggttgtcacaccatggctgtcacggcgaaatgttttattcggcgttgtatatgcccgtaacagcatttggacaacgccagcagctaaaaaattacgccgtcgttatctcgccttttcattaacaggggcggcaatcctttcagtgattggcattgggattgcggccgccatgcactttgcggcgactgcgcttgcttggattcaaattgctgcctttttgctttcgatcagtctgaattatgccttgattgtggcggcacatcggaaaagtttgcaactccttaaagagatggggaatcagcaggagcttacccaaagcaaggtgactgttgacctgaataagctcaagccccaaacgctggttccggcagcctatgggatcgtcttggtgccgcagttctttttagcccttgtacttggttttcagcaaacatcagcagattcatgggtcataattttggcgctggcggttgaaacgctaactgtgctgggtgctttttatctttcccgcagagcgcgcggggcagttcgcggcaatccggatgctgaaccgcgagctggtaaggtgcgcaattccgttttgtattatctgctgttcacaggttttctgagtcaaagcttactggttctccaactcatgctgccgaatatgtcagctgaaggtcaatggtggtttgtgatcatcacactaaccctgacactgctctccgtcagctttttgccgttggtgtatattctggggactcgccgacttgcggccaaaggatctgtgttgaatgataatcagcattgggtctgggggatgttttactataatccaactgatccggcgctctttgttgaaaaacggttggggattgggttcacgctcaatatggccaaaacgatgagttgggtgatccttgtcggttttctattgatcgtcgcgggtattgtcatcatttcttttatacttgattgaggggtgttcagaatggataaagttgtgaataacagccctgtcagccaattcacggttaacatgatgggcgttgagatgctactttgttttgccttaccgattattttgttaatctgggtgattctgcgttacagcaagccccaaaaaggtgctgttaaggttttctttattggcatgggcgtttttttcctgttcgctggtgtattggaaggacccttccgcggcatcgctaaagatttccaacatgtgccgtttctatatgcgttgtatggcgcgctgttagctggtgtttttgaagaggttggccgttatctaggacttaagtttattaataaacgcataccaaccaaggcggcgacacccgaaacaccattcctatacggattaggtcatggcgggcttgaaatgattctgattggcagcctgaccatgttcagcaactttatgtttgcaatgctgattaatggcggcaaagtaaacgaaatgcttgaaaaggtacccgctagctcgcgttcggtgctcaatacgcaagtgaaacaattgatggcaacgacgggctggacgatttcgttatccttgatggaacgactactcgccttggcggttcagatcgcattatccgtggttgtgtggatcatcattatgaaacgcatgcgctggttctggctattgttgccaatcggcttacatgcctttatcgactttccggcggcactgacgcaggttggtgcgctgaacggtgcggttgaagaagtcctactagttgttcagacaattttagtcttggcctttacgtattggttctggcgtcaaaatcgtcaggtgatgacgagaacggcgaagacggcatagttgcagacttttcctagttaaggttgaaacatacttaatacttgcaaataaagagggatgatttttctgtgctgcggaaaaatcacccctcttttcttaggagaaatggcatttttgaatgataagagtcggcctaagacgaatacttaaatcttagtctccgcaatcaatgcttcatgagccttaatatgtgccatgaaagttttatcctcagctagaagcaacaagaataaggcttccaccgccgtcatggcggctacgcgtgagaagaaatattcggactcgaaaatttgctgccgaaccgcggtcaaaagctgataatcggcggctaggccaatcggtgaatccttgcgattggtaatcgcgaccacagcaataccacgttggtgagcggctttgatttgggtgatgagattgcgcgtttcgccagaatttgagataaccagcaacaaagcatctgctggtgcattcatggtttgggcgagcgccgtttcccaagaactgtctgtgatggctagtagaccgagttgattgaatttatagacggcatcatcggcaaccggctgcgtatcgccagcagcggctactaaaattacactagcttgttttaacaaatccaaaatttttcgaatgtcatgtgagctggcgttttttagtgtgccttcgatttcggcgactttgttggcactgatattgcttaaggcttgctgaagattgtcggcattaatttcctgataatacgcactacggttttcagcaaccttagcaagctcaatcttgagttgatgaaagccttcaacaccaattgtccggcaaaaacgagaaattgaggcttcgctaacgttactttcttttgcgagggcggcgatggtggtattcacgacagcaccgggattcgtcagaataacctgcgcaatcttacggtcagtcgcggtcagtgttggcagcatgctataaagacggtcaataatactcataacacagctccttttcaactaaatttctaaataatctgttttatgaaactctatggcctttattctacgcgattaatttcaaaagacaatcctcacaactagatgttgacaaaactaaatttcagtcttacattatatgtgaaatataatttcatcaaaaataaaagagaggaagcaactttcatgacagaacaaatcgccgctgctctagcacttattcagccgcatcaggtagtgagtcttggcggtggtcggcacatgcaggctcttgctgatggcattgtcgcgcgggcattgccgggtattcagatttgcagtccctctgaagtaacgccggcttattgtcagatactggggttaccaacaacaacacagatagctagtgatattgcctttgatggctgtgacagtgccgataaggacttaaatttacttaaaagtaatggcggcattcatttttatgaaaagttgcacgcgcaggcgagccatgcttatgtgattctcactgctcagaaaaatgtcaacgctcaactgaatgccgcggtaccgctgacattggaagttgttagcgcggcaagtgaacaggtgatggcatctgccaagctgctaggcttgcaggcaaaacgacgggtggctaccacttacatgggctacacgcgaacgcgcgacggcaatgaattaattgattgtaagatggcggaatggacggatatcgcaaaagttgatcatttgctagcctcattaccgggagttgttgcgacgtcatactttgctcacttagcgacattactcttaatagaaacaccagatggtcaggtacatgaaattaagcagagcgtgaaccagcccggttagaaaccggagtgtaagtgaccttaggcgtgatggtcggactctgactattgcgaccaaggttcttacacgcaggtttctgggctggagaatgcgtttaaaagaaaggatgagtcatatgacaaactataactggggtatgatcggaactggttggatcgcacatgaaatggccgacgctttaaaccgggaaaacggtagcatctacgccgtcgctgatgtcaatgccgacatgcttaagaagttcgctattgaaaaacatattgccaaaacatatacagatccagatgccttgattgccgacccaaacgttgatgtgatttatattgcaacgccgcatacctatcattatccatacatcaaaaaagctttgaatgccggcaaacacgttcttgccgaaaaagcgattacggtcaatgctaagcaatttgatgatgtccagcagttggccaagcacaagggcctgattctatctgaagggttaaccttgtaccatatgccggtttatcaacaagtcaagcagctgattgcaagtggcaagttaggcgacattcatcttgttcaagttaacttcggtagcttgaaagactttgatccaaagaatcgtttcttcaataaggatctggctggtggcgcgttgcttgatatcggcggatacgcaactgcctttgctcgtacgttcttagatgctcagcccaatgtaacgctcaccaccgtcaagtactttgaaaccggtgttgatgaacaatcagggatcattttaaaaaatgctgatcagcagttggccgtcatggcactgtcattacgcgctaagcagccaaaacgcggcgtgatctcaggtacaaaaggctacgttgaaattgatgactatccgcgtgccacaaccgccaaagtaacctacacccctgatgcccataccacgaccagcgaggtattaagcgcaggtgatcaggccgatgccttagtttatgaagtccgtgattttcagcgctacattgatgaaggtcacgatgacggtcagttgctactatctcacgatgtcagccatatcatggacagtgtgcgaaatgcatggggcatgagattcccgtttgattaaggcaatgatagattgcaaaggttgcgtcgtttagtagaacgatcagaagccaactgacatagattcaatctcccacatcagcccaatgaacgtcccttctgtggtacactatcagtgcatgtttacagaaaaatggaggctaagacattggcagatcgaccaattcgggtgcgttatgcaccaagtccgaccgggcatttgcatatcggcaatgcgcggacggcgttgttcaattatttgttcgcacggcacaacaacggaacgttggtgctgcggatcgaagacaccgatacaaagcggaatgttgcagacggcgaaaagagtcagatggagaaccttcactggctcgggattgactgggatgaaggccccgacaaaggcggcgactttggcccataccggcagtctgaacgtaaggacatctatgacaagctgatcaagcaacttgttgataaaggctttgcctacgagtcttatcggaccgaagaggaactgaaagccgatcgtgaagcccaaaaggctcgtcacgagatgccgcattacgaatatgaatatgagggcatgacggacgctgaaaaagctgacgcgattgccgcagccaaagcgaagggcttggagcctgtgattcggttccacattccaatggacaagacctacgagtgggacgacatcgttaaggggaaaatctcgattgatgccaacacactgggcggcgattttgtcattcaaaagcgtgatggcatgccaacgtacaattttgcggtggtagtagacgatcatatgatgcaaatcagccacgtgttgcgtggggacgatcatattgccaacacaccgaagcaattggccatttacgatgcatttggctgggaaccaccaatttttggccatatgaccttgatcatcaatggcgccaccggtaagaagttgtcgaagcgtgatgaaaccgtgttacagttcattgaacaatatcgtgaactcggctatttgccagacgcgatgttcaacttcattacgctccttggctggtccccagttggtgaagatgaaatttttaccaaaaaggaattcatcaagcaattcgatccaaagcggctatctaagagcccagcccgttttgaccagaagaaattggaatgggtgaacaaccaatacatcaaggccaagcaaaagacgaacccgaatgaattgatgagtttgtccttagctaacttgattgaagatggcaaaattcatagtgatccagatccgaagaccatcgagtgggcgcgccagcttattagtctttacaccgatcaaatgagttacactgctcagatcagcaagcttgccgatattttcttcgacaaagccactgacctaaccgatgacgaacgcaaagaactggcagatgacaatgctaagccagtcatcgaagccttcgccaaaaagattcgggcactcgacacgtttgacgcttattccattggcggtattgtcaatgaagtcaagcaggaaaccaaggtcaagggccgcaagctttacatgccaattcgaatcgctgcaacattgcggatgcatggtccgcaacttgctgaaaccattgaactgatgggtcgcgatcaagtccttaaaaacgttgatcttgtcaccggccaactttaattgatgcaggaagcccgcgcagatgtgcgggtttttgcatgcaaacaataggttttggtggaacgcgaagggcaacgtttgttgttaataattgagtgattgtgcctaaaggacgacgttaatcggtgatttcctaacgtttatatttattttccccagaacttgtcgacatcggttaccctaaatgacagggagaatagctccttgcaacgtaggaagggtaggaatgaaaaatgaaaggtaagcggcagcacttacttttatattttgttctgggtatgatgacaggactggtgacggcagcgatttttcatatcatttatgcctggctttttcattgacctgatatgccaatccccggcatgattaatggacagcgcatgtttttctggttttcgtcgttgtcttcctaatgttgagttcatgttgtgatttttcacaactgcaggtgtttgttcaggaccgacgatggtccgtgaacaaacacctgttttttgataaccgcaacacagacgcgctttttcaggcttacttggagaatctggcccaatggctcggattgaatcgtcagcaaaaattcggtaaatcttataacgtgcgtttttatggatcaagcgagtatcattttaattatatcaagcataattttgacaggagtgaccactgatgcgtgacaatcgcaataacgacaaggaaccgttaggcacattgaccacaaaaccaacttttgccttgcaatatttgccgggatcagctgcagccggctgttttggcgggaaagtcggcctgcatttactaagcaaggaacctgtggccctggcgtcaccgatcttctattacatattgccgcgtttcgccagctttgacggttttgatccgcgaactcaagtccttggtcgtccaaaggtggccgttttatctggttttgacacacatggccggcatgtcgttcgactcgattatcgcggcaactgcgaaccactggtggtaccacaagaacagaccattaatttggtccgctttcgccatttagcagacgctggtgtggacacagatgtcttgacgatttgtgttgccacaccaacgccaataacaggcagcggccaaccacgtcaaccttatcgcttggcagccatggcaccagaaacgacttggctaggagaggctgttattaccgttcatcccaaggaaaccattgctgttgagacaaaggcaagacagtcaatctcatcgcagggtcaatcggcgtcttaataggcacaccaccgagcgtcttactaagccatctttaccaaaatagtccataataaagtcgacgcttcagaggcgaatggccaacgctgccacctgcctttagaggtgttgaggaggtttttgtgatggcaatttttacagcttatgataactcggaaattctggcagccttgcaagacgcggccccgcatgccgaaatccacattgatgataaaattgcgcgcgaacatagcgccaatggcaatgcccagcgtgagattgccgggaaaattctggcatatgttgcagtcagtgatgttgcagatattcaaggtgtgttaagaatcgcgcgtcaatatcatatgccagtggttccccaaagcgcagatacgagcaccgtgatcggttctgacggcataaacggcagtcttattttgtcgacagcgcgaatgaatcggattaaagagattagcaaaggcgatctgttggcagtggttgagcctggtgtgatcaacggggacctggataaggcagcgcgtgcgcaaggtcttttttacgcacctgatcctggatctaagccaatttcaagcattggtggcaatgcggcaaccaatgctggtgggatgagtaccgtgaagtatggggcgacaaccgacaatgtacttggccttaaagttgttttggcagacggccgtgaaatcaaacttggcggccgaacttacaagcatgcgtttagttacgatttgacgcacttattcgtcggctcggaaggcacattgggcatcatcactgaagtcactgtcaaactgaacccgattccaattggcacgccggttgttggaattgcttattttgacaacatgacagcattggctaaaggggtggaggatttgcggctttccggtatctatccggtcatgcttgaagcacttgatggtctgacagttgctgcgttggatcgttatgaaggcactcactatgctgaaggcgccgaggcaatgctcctgttccggttagatgctggtggtgaagctagtctgaaaatggcggagcagattttaaatgacgatcatgccaaaaacatcaaggtcaccagtgatcccaaagaagcagcggcgattatcaagttacgccaggacatgttgccggcggttttcgctaacggccaacatattatggaagacatggcggtgccgttgtctaaactgcccgaaatgatggactatattgcgtcagtcgcacaggacttaaatgtcgaaatttacacggcaggtcatgcgggcgatggtaatgtgcatccaaccgtcatctggccggctgatgaggaagaaccgcccaaagaagcgctccaagccattcgtctgatgttccgcaaagcattggcactcggcggcaccatttccggtgaacatgcggtggggatgagcaagaaccaatggaacaatgaagaattaggctttgatgttgatgagattcagcatcaaattaaaggattgtttgatccgttggggattctgaatccgaagcggaaaattgattaaggctgctgaaaaacaggaacgtcatgcgcagctccaaaaggaatgattgccgtatttaggaaaatcattcctttttattttttgatagatagtctgctaagcattaaggtcgtagtgccaaggcggagattgcggcgtttggcacggcacagaatgttgcaatcgcccgccccgttcctttataatcacggtcgtttcctgtaaaatgcagttaagacgctacaggaaggaaatgagccgatgttaacgttatacaatacaatgtcccggaaaaaagagacattcacgccgttgcacccgggagaaatccggatgtatgtctgcggcccgactgtttacaattacatccacatcggtaacgcgcgcagtgctatcgcgtttgataccatccgccggtattttgaatatcgcggatataaagtaacctatgtttcgaacttcaccgatgttgatgacaagattatcaatgctgctcataaaaccggtgaagctccgctggacttggcgcaacggtttattgatgcgttcatggaagacacgacggcgctggggatcgaaccggcaacggctcatcctcgcgccagtcaaatgatcccggatattattgattttgtgcaggatttgatcgacaaagaatacgcttatgctgttgacggcgatgtttattaccgggcccgcaagtttaaacattatggggagttatctcatcagaatgtggatgaacttgaagaaggtgccagtcaacatattacccaagacgaattagctaaaaaagaagatccgattgattttgctttgtggaaagtcgccaaacccggtgagatcagttgggagtcaccatggggcaaaggacggccaggatggcacattgaatgctcagtcatgagcaccaagctgttaggcgatacttttgacattcacggtggcggccaggatctggaatttccgcatcatgagaatgaaatcgcccaaagcgaagctaaaaccgacaagcagttcgttcggtattggatgcataacggcttcgtgacgattggtgaagacgacgagaaaatgagcaaatcgcttggcaacttcatcactgtgcacgatattcgcaaaacagttgatccgcaagttctacgttttttcatggcgggtacccaatctcgtatgccgattcgctattctgaaactaacctcaaaaatgcggccaacagtctcaatcggctaaaaattgctcgtgagaatttgacctatcgtcgtcgtggggccgaaaccggcgttgatccacaaattaccaagcagctgcaaaccttgaaggatcgcttcgtgactgctatggatgatgatatcaacgttcaaaatggcctcaccgttttattcgatctggcaaagttgcttaatgaatatgctaatgaagagacggtcaaaagtgaaagtatcaatgaccttttgaatgaatacgatgcttggctgcaaatcttcggtgtggtgtttgctgatcagaagaacctggatgcagacattgatgccttggtgaaggctcgagatgcggcacgggcagcgaaagactttgctaagagcgaccaaattcgtgatcagttggccgcacaaggcattattttggaagacactcctcaaggaacacggtggcgcagacaatgacatttgatccaaaacaattgaacggtatcgcgttagcctacatgggcgacgcggtttatgaagtttatattcgggaacacttactcaagcgcggtttagttcggccggcatcactgcaacgggcagccaaggattttgtgtccgcaaaggcacaagcggcgctgattgccgggatggaggaagctaacctgctggatagcgacgaaaccgacattttcaagcatgggcgcaatgccaaaagctacacgcacgcgaaaaataccgatgtggtgacttatcgagtttcaacaggattcgaggcactgttcggctacttacatttgatcggccgcgatgaccgtgttgctgaattagcagcatggtgtatccaatacgttgaagaagggaagacgggacatggcaaaaaagccgcaagcaacaactgaacatgatccagatgagtttatctttggccgccatgccgttgaggcggcgctgaaagctggcaccgctgccaccatcaacaaattgttcgtccaaaccgacctgaaaagtgaaccgattcagcatttggtcggcatggcgcaaaagaagaagattttagtgagcacggcacctaagcaaaaattagatctgatgagtgaccaaggcaatcaccaaggggtcttattggcaatgacgccttacgcttatgcaaccttagatgatcttttcaaaaatgccgctgataaaggcgaagatccgtttttcctattgctggataatttggaagatccgcacaacttgggctccattttacggacagcagatgcaagcggggtgcacggggtgatcattccgaagcatcgcgctgtgggcctgacaagtgccgttgccaaagtcagcacaggggcgattgagtatgtaccggtggcacgggtgacgaatctcgcccagaccattaagacgctgaaagaacgcggcatgtgggtctttggcactgccatggacggtcaggattatcgaaaatgggatgcaaaaggcagtactgcgttggtgatcggcaatgaaggcaagggcatctcgcctggcattgcgaagttaatggatgcgacgattgcgattccgatggtcggccacgttcaaagtctaaatgcaagtgtggccgcgggcatcctgatgtatcaggcattcgccagtcggcatgagggaaaataaatgcgcgaacacatcatgatcgtcgacggttataacgtcatcggcaactggccggaacttgcaaaactcaaagctgaggatcattttgatgtggcccgtgatcgcttgttggacattctggcagaatatcgcagccacgaaaacgctaaaatgatcgtggtctttgatgcgatgtacgtgcctggtattggtaaaagttatgcaaaatgggatctgcaagtcgtcttcaccaaagaagatgaaaccgctgatagttacattgaacgcctcgcacaggacatgaactcgccgctagtgcagcttgtcgtcgttactagcgatcaagctgaacaatggaccgtcttctctcgtggcgccttgcggatcagctcgcgcgattttctcaaagaagtccagcgctctgatcgagaattcaaccacgacacagcaaattacgccgcccatctcgcccgacgcaacagtccgtggaataacgaccagctattcttgctagacaaaatgcgccggcatttggagcggcggccgaagccgaaagagtagttatggggatgacccagccttctcaaatttgatgacattaaaaaaaggcacagtggacttcagttttgtcctgccaggatgagcagaacaagagaagttactgggtcttttttttgcaatcaaacattagtagtcaacaaactttcgggatcaaggtccagcaatttcagccattcaatattgatcttgtacaaggggatgcttcattggctagttaaaaattttatgaagagaaatgaagcagcttctacaagggctcctagtaattggattaaccatcgccgttttgttttaaagaggcttggcaaagtctcttttttggcgtttgaaatgactgtaataatgctggcaaagaagatcatgagacatatgacgacaactgaaagaactgcccaaagtcttttgtaggagatgagcatattcatgaaggcactaaagggaagtacgaatagaagtgtacttaaaagacagtatgttaagggacgcatgtgcagattagcattgggggtcaacaaaaatccatgttgccgttgaggtagattcatgaatttgctccttcgttgtgatcaatggaagactgcttggttaatcaataagctatcacgaaatgaacgacttgtgaagatagagtcaaactcgatatctgaagcattcgaaacgcataccgcagagagacggtaagtgtgtcttgtgagcgcgctctcaatatcatttggggagccagaaacgtaaccagtaggccggtatattcgtgtttagggttgttgccttcttgttgatgacaagacgctaacagtagtatcgcaggtgagatctatcaaacgagaaaatgccggtattaatgggatgtattggttcgcattgctttggtgactgcaggcttctcctcaacttggaagtcacttttctatagccggcttaatcctatatttgatcgtgtgactggttaccctctaaaaggttgccatgcaccttaaaaaagcctatgataatatcatcaacttacaaaaagtaagcattatcggttgggaggcttttcgatggtagacattgagcatttacaatttggactggaaacttttggtgacatcgtggcaaatgaagacggcagcttgcaaactgcagcagcgtctattcggcaaattgtgcgcgaggggaagctggccgacgacttgggcattgatgtttttggtgttggtgagcatcatcgaccagattatagtgtgtcaagcccggaaacggttttggcggctatttcggcggtcaccaaacaggttaaacttgcaacagcagtgactgtgctgagttcagatgatcctgtacgagtttatgagcgatttgcgaccttggatgcactgtccaatgggcgagcacaagtcatgttgggccggggttcatttactgaatccttcccgttatttggctatgatttaaccgattatgacgacttgttcaacgagaaactggggttgtatgatgctttgcgcaatgaaaaggcggttacttggtcgggcaaattccgagctgctttgaaaaatcaggaagtctatcctaaaaccgaaaacggcaaactcgaaacttacattggcatcggcggttcgccggaatcggtgattcgtgccgtcaattttggctacaaagtgatcatcgcaatcatcggtggtcaggcgagccagttcaagccgtatatcgagttatatcacgcggcggccaaggaactcagcaaaccggaatttccgattgccgtccattcccacggcttcattgccgatgacgaagacgaagccgttgaagttgcgtttaaaaatatcaaagccaattttgatcgtattggcttaacgcgtgggtgggcgctgatgagtcgtgaacagtttgaaggcgaaaccaaagtcggctctttctacgtgggcgatccagagaccgtggcccgacgcatggcggcgaccattgacttgcttgatctcggccggtttgatcttgtttacggggctggtaatcaaacggcggcacaacgcgaacgaatgattgagctatatggcacgaaagtcattccgcgggtcaaggaaattctggcagaaaaggcggcggtgaaatgatggctattcaacgcgtcggtatcatcggtgccggaaaagtcggcattgtccttgccggtctagctttagatgccggctatacagtacgtatttccggttcgggatcagtcaaaaaaattgccttaaccattaaaacactcgttcctggcgcaattgcgtccgaaaatgctgatgttgtcgctaacagtgacattatcttgttagcaattccactcagtcgttacaagaacattgatgccgacttgttgaagggcaagttggtaattgatgcgatgaactactggtgggaaacagatggcattcgcgaagaagtcttagacccaagtacgacttccagtgaacaagttcagacctatttcaaagatgccaagatcgtcaagccattcaatcatatgggctatcaaaatttgcaagaagaggcgcggcccaaaggcgatcctaaacgcaaagcattatttgtgaccggcaacgatccagaggcagtcgccactgtggcagcttttgtcgatcatatgggatttgataccgttgtgcacaataacttagcagacggcatcatgaccgaaccaggcagcccactgttcggcgcgagtctgcgatacgctgagcttaaggacatcatcgatcattttgatcaaaccgagtttggtaagcaagttgcagcgcagacccataagtgatggaattgttataaaggcaaggcatacggcctattgaaggctgaggcgtcttgtctttttgctactagtgtaaatcaaaagttgtctgtaaaaatcaatcatgctatgctgagagcaaattttagcaaaagctcttatttgtaaccgatcttttcagcgagagggggttcactagtggaaaataaaaataaggatcgaggcttcaattactgggcgatgagttatagtggcaagcttcgtcggaccttgtggatgtttccttttggggtgctggccattgcattgattgcatggacatcaggcagtgttttcataacggtgatcttggctgtatttctaaccattatctgggcgttacaggttgcttacacctattttatggcacaacgagaaaagcacgacggcgacaatcaataatgtcaaacggtgatggttatcggtttcatagataaccagagcgagtcagacagtcaaaatgaggttcactcatgaagaaaacccttcgatggttttggcagcacaaactaatattacttggggtaacaagcgtttatctttttacgttctatgacacgcactttacctcatttgatttggtcgtgtatgtgatcgcgctgccagccactgtttggataagtgatcaatggcgaagagctttatcttaagtatggggaaaatggctgacggcgagccattcatccaacaaaattaaaaaggcacagtcaaaagtatgctgctagcaaagagcaactacttttggctgtgccttttttgtttctgcatggataaatttaaattactaagacagctttaaagacgtcagtgccaaggcggagcaatcgtaggccagatggggctcagccgtgcaaacaacacgaaccaagattccgtcgagtcttggttcgtcactcatgttagtctgtttgattcgttcgacgctttcgcatcgctgaagtccaaaccgctgagatcgctcagatcaacatcggtagcatcattgctggttgaagccggtgctgttggcgcagatgcggccgtgaccggcactagtgcaccgtaacgttgactcggtaacttgattttaatttgaacgcggtacaaccagatgaacccgagtgtccaaagcaccgccaacgcgattgcccaccactgaccattgaaagcttgcgcgaagaacaagcggaagtccggcccttcaaatgtggaccatgaaagctgctgaccagcctgaactttaacagtgccggttgatttggccaggttcgtgataactggcgcaaagtacgtggcaccatataagaagatcggcgtagtaatgatgcccaatgtgatcatccgcaacaggtttgccccagtcagtaacaacgcagcgttaacaaaggacaagttgatgatgccagcgaatggcaagacggtgttgtgcggcaagatcatggcgaagaccaacatgatcggcaccagaatgatcaccgtaacccacaattcgttacgtccggcaaggattggccagtcaagaccgatataaacctcacggcctttaaagtgtttctgcatgaagccgctcatcgcatcagcaattggtgataaggcggtcatgaaaagtttggagatcattgggaataaagtcatcgcagttgccgctttaatcgctaagttcaaggagccagaaacggaatacccggcaccaaagcctaatagcaccccaatcaaggcacccatgacggtattgtcaccccagacaccaattcgcttttgcaacgcatcagcgtcaaacggcttgttcataatcggaataaagtcaagcaacttattaagcggttgcaagatgaccgcaaataaggtgataaaatgcggtactgtgacacccggcatgcctgtcaaatcctcaatatgccgttgccacatatcacctgctttcagttcgaaaacaatttgaatcccggcaactaagaatccgaagaaggcattgtgcgtaaagtacaaaacaacgacgtaagtgaaaatcttgttccaaacgttccacatatcaacgttcagggttttggtccagttgaacgtcaacatcacgaagttaatagctaataataacgggaaaaataggaacgcggacttgtacgaccaagtgatggcagcaaccccggtccagccggcatcaatcgcattcagactcaaatggaagagcttggacatggattttgccgctggtgaaatagcctccatcatgtagttaacgaccaaggtcatgccggagaaagcaacccccaaggtcaaagcggccacaattgattttttgaacttcaacccggcaaccagacccagaatcaacatgatcaatggcacgaagaccggtccacccaaattcaggatataattaacgatgtcttttaagattgtcacgattttccacctcctctagtagaatgggctgttatcttccagcagcctgcatgttcttcaatgcttgaacaatttctttgtaggatttttcaggattcatgttcatgaagatcggcatcccattcacaacagcgatgttattttccttggccagttcctccaactgttgattcggtttagcgatccagacatacacatcatagttatgcaaaatttccggtaactgtttgaaatccgtcgcatcaaccgaaatgcctttaacgttattggtttcaaaaaaatctttgattcgactagcggttgcttcgctggaagctacaccggaaccacatgcaacaacaattttagccataatattttgccccttattttgattggatcagttatttgttagcagcttgtgtcttgaacgtatcgacaaagaattgatacattgcttcaggatcagtcgttgccttgaacttggcgacaaacgctttgtcttgcaacagatccatgaaaacctgcaataacccgacttgttgactggcatcggtaattcccaagaaaaacatcgccgttgcatcctcaggctcgttgtaacccatttgcagtactcgaactggttgagcgtttttgacgatggccataaacggctcattcacgttctcaggatcggcatgcggtaacatgaccgagatctcaggaaaaacaaccccagtcgggaactcatcttcgcgtttgttaagggcagcttcataagtgtccttagcatacccagccgcgcgaatcttcttggcaacatctctaaacagtgtttttcgatcggcagcgttttcgttgagaaaaattaagtctttgtgaatcattgtgctatagtccatctttatatcacctcatcttttcgagtggccttagcatttggaactttttgaaccttttccttgtttccaaagctaatgataaagtgcttacagccttttgcctacgctgtaaagtggaagtcatcaaggttgacaacggttcatgaaagcggttaaaatttgttcagatagattcataataattcataaattggaggtgttaactgtgtcacaaaaaccggctaagtttgaaagactaaatgacatcatcagaattttgcgtgaaacaccgcaaattagtgtggctgaactcagtcgacaaatattcataagtaagtccaccttgcgtcgcgatttgattgagcttgaaaacactaacatcattcaacgccaatacgggatgattcagctcctgcaatgtaacaacattgaattcacctacgaaaagctccgcaacgaaaatgcgcggctcaagcggattatcagtcatcaaattgccgacaagatccctagcaatgccgcctttttcattgacggcagttcaacttttttcagcttgcccgagctgttacacaatcaagttggtctgcatgtaattacaaataacgtcaacatggggttacaattcaattcactgaacggtagattgtaaaattaatccgaacgctgttcggacaaaaaagatcagcttccttgaatcaaacagactaacatgagtgacgaaccaagactcgacggaatcttggttcgtcacttttcttttttgataaagtggtgttgaagttgacatgccgtaggtctttttggcgctttgacgtcgtaaatcaaactggcaacttcgcttgatccaccaagaaactcgttcgcagtctgttggcgcaagacgccgtgtattgaaaattgggatgagtgaatcggtgaaacaacttcaaaggtggtgtttgttgtatggaatgtgtatttggtattgatgtcagtaaagagaacgccaatgtagcggtacttgttgataacgtcgttatcaagcaatttaaaattgggttagatcggttaggattttcgctattaagtgatgaactcaatagcttcaacgcacccctaatcatatacgaggcgaccgcgatgtactctcgtcgtttgcgtgcctttctacagcgagacggctggaaatatacagaactcaatccattagccgcaaagaaagtgatggaagaattcaggcatacaaaaactgatgcgctggatgcggtgggtttagccagagcgatgatcaaaaatcacttcaggccaacctatcaggaaagcccagtttatacagagttacacgatctagagcggacgtatcagcagtttaataaagacattgtaaccaacaagaatcgtctgcatagagcgctccagctaacctttccggaaatcgagcattttatgagctcgactgacggtgttctctactggcacatcgttcaaagatttccgcacccagcgatcgtactgtctcacgaagagaatgaactgacagaaatcatcttaaccgagacctctaaaaagataggcctcaagcgagctatgaaactggccaaccgtttattggccttagctcaaaactcagcgccggcaaaagagccacagtcacacgctgtcagagctgttatagccttggctaaagaagttgaacgcatcaatcagttaaaggcccagataatcgtagaaatgacaactttgggagaaaacctcagcgaagtgccgctccttgtttcgatcccaggaatcggtataaaaacagcactatgcttgatcgcagaactgggagacgtgcgacgttttcacagtgccaatgcgattaatgcttatattggaattgacttgattcgctatgagtcaggacaatacgaagcaaaaatgcacattagaaaacgtgggaacccgtatgcccgaaagattttgtacagggcaatcctaaacattatcagcgtctcgcaatatcaaccgacgctgatcagcgcaaactacaaacgaaaaaagcaatccgctcagtcccacgggactaagaaaattgccatcgccgcaatgagtcagtttaaccggctcatgcaccacctgattttaaacaacgagttgtatgattcaacaacattcatgcccgaatagtaaatcaccactcgcttagacgaattgtaccgcctcagaaagtcaatatctgtgaggcctagtttagtgtacgccaaaacttaggtagaaccgacccaagtagagcgtgcaattcaaaatcaaagtgcaaagaaaagagaattgtgatcaaatcagctttttcttgactaatggtagaaaaaaatgatgtaagcggtcaaagtgggttcacggtatccggtggcgatggcaaaaagtatattggcacatacagcgacttcacacaggccgacagcaccaatccggctgattacaaatgggcgctttttaaaggtgaagatggtgatgtgggacccaaaggcgatcaaggtttgcccggtgccaagggtgctgatggtcgtactgcctatgcccactttgcttacgcaaatagtcaagacggccatgccgacttctcaactactgaccctaaccgtaagtacattggtttctacagcgacttcacatctggcgacagtacgaatccaagtgactataactggtctctgattaagggtgcagatggtgcgaatggtaaagatggggtgccgggtaaagcgggtgctgatggtaaaacatcatacttccatattgcctatgctgacagtagtgacggtagaacgaatttctcattggatactccgggctctagaaaatacattggtagttatacagacttcacacaggctgacagcaacaacccagcgctttattcttggcaactagtacaggggccacaaggtgatactggtccgcgaggtcctcaggggccacaaggccctcaaggtgttcccggaagcaaagatgtgccatacacttacattcagttgggcacgcccgctagtcccaagaagggtgacttgtggtggcatgggacaacgcttaacgatgcgacagcactgcaatactacaatggatcaacttggattgaccaaagtatccagcaagcggttcttagcatcaaaaagctgcaatcaatcgagattaacagtgcgatcattaattctccaatgataaatgtgcccttcactcatgcttctattgaaggcggcggcatcaagtcaacggggaagctgtctctgaatggaacttcatactctattgatgggaatattgaagattccgatggtaagccaaatggtcaaaattaccatactgagttaaaccctgatggcttactatcatatttaacagaaactgatggtacaacgcagaaggatattagcagaatctcaatgggcactcttgagttgagtcacttagttagtggactaggaactagtgcaaactatatcacgagcagccttaacgcattggcaattgctagacttaataatgttggtgccctattgtgggaaggtgtctcgcttatgggctggtcaggtaatgcccagggagcaacacccagcaaacccatcagcgattgcttaaatggctggttgctggtttggtctgaatacaaagacggagtggctcaggattacgattacattgtgactccgatctatcgagtgtttgtgcaggctcatccgggcagacagttgacgcttccgatggtcgcctatggcgcggcttcttttaacaagaaggttttcccaacaaatacaaacatcgtaggtgataagaataactctggaggcgctggtaatccttcaattgctggaaattatgcacttgttaacatttttgctttttaggggggtcaaaatatgaaagtaagacttgatacacaagccgatggcttcatttatgcatgggggaccgactacacaagcgataatgtggttgatatagacgagaatgaactcaaaaagattgtcgcaggtgcttctaagctggttgatggcaaaattgttgtcgatcagcagcgagttactgatctttatccggctgatgcaatgccaacaccgacacctgaacatcagatgatcgctgcattgtatgcccgcatggcaaagattgaggatggtggaaaaaatgagtgactttgaaatttgcagtatgctccattcttgggggtgcccgatagagcagtacgtgggtcggcaaataacggaggatcaatacaagcaaatcacaggcaatgactatgtcgccagcaaaagctagcggctatttttgtggaaggaagtgagaaagtgacattttttggatacacgattggtgactgggcggagttcatatcaatcataggggtaggcgtaagtgctggcagctggctgttcaaaaagattgccttagatccattgcgttctgatattcgcgtagctagagcggagacggcgcttcgagcccgcaaagcccgcggtctcgaagttgcctaacaacagcagctccgaaaaccggtcgctgtgttgtttgcacggctgagcctcatctggcctacgattgctccgccttggcactacggtctttaaaatctcagcaattaatctatggataggtaaaaacgaacgattttccgatattaggaaaatcgttcgtttttacttgtcgactgagaattgtgttgcaacattattcccttcgaataaaaattccagaagtcaatcatgacttggattgttttagggtcaaattcccggtaagccacgagcctgacgataatgttccaaatcagcacttagcacgattggggcttcttgcagctcctgccaattggtgacgcccaataacgcgtaaagttggcgcaattggtgcagaaaattctgaaaataggtcagcgtcgcttcatagccagtttgaattaagtgatgaagcaccagaccactcatgccgactgcatgagcgcccagccgcaatgccttcacaacatctaatggtgaacgaacgccgccagttgcaagcatggttagaccgagtccgcgcgcttcaagcaatgattcaaccgttgtctgtccccagtcttgtaaataagcaaaatcgtggcccgaacgacgagcattttcgatcgtggcaaagtttgttccgccgcgaccgccaacgtcaacaaattgaacccccagctgttgtaaggactgaagatcttcgcgaataaagccattgccgacctcttttacgacgatagggacttggctagtcgcaatgatgctcttaatgttagcctgccacataaagtcgcgatcgccctcaggcatgaccacttcctgagcagcattgagatgaatttccagtgcattcgcttttaacattgccaccgccgcctcagcagcagtcgcatgatgaccggcgccaacattagctaaaataaacccgtttggatcatgatcacgcagcgttgcaaaagtcgggactagttgcggatcacgcaacgccaccgattgcgatccgctggcaatcgccacccccaaagcttgggcgagctggcctagctgggcgtttaacttgccggtttgtggcgagccgccggtcatggcattgatataaatcggccattgccaattaaacgggagatcaggttttagatccaccgcagccatggttgtttccggcaaagctcgatgcaaaagacgaacctgatcaaaacccgcatgagcaacagattgaaagtatttttcagctagaaaaacatgttcatccttgcgatgcgattgctgactttgtgtcatcaaattgctcctttgtgatgatgctggcatccggaccaaggcgtgtgctcaaaatccgatcaccgaacacagggcgcaaggcggttaataaaatgtccacgtaaggttcagtagtcagaattttgacatttggtcctgcatccatcgtggcaaacgcgggaatacccaaagcccgttgttcttgcactaattgccacgcccgtaatgtttccggcagaaagtaggtgaatggcggttcctcggccataatcgccgcatgcatgcgcatactggacaattctgtcaatttgccgatcagcgctaagtcgtcttcagccaacgcggtaatcattggttcaattaaactttcatttgaggccacccaggcatcatagtagggacttgtggccactgtgttggccatgccttttcgtgaactgaccgcctttttttcagcagataccgtgaccacaagcattcgtaatggcaaactaggttgaatcgcgagtggttcagcgaatgaagaggcgtcgtcatggccgcgatgccagataacggcaccaccaaagatagagcgcgttgccgaacctgatccgcggcgcgctaatcttgatagttcagtcggagaaaggtttagacctgccgcgcggctggcagcagtggccaaggcagcaaaagcagaggctgaacttgccagcccggcagcagtcggcacgtgatttaaggaagtgacttgagcgtacgtgctaatttttcctaagtgccgaacccgatccaaaaagcggctgaccgcaaccgggttttgttcttcaccgttaagcatgaagcgatcatcatttagactaggatcaaatgtaactgctgtgtcagtataaaagtcatttaaagttaaagaaatgctgcttgtggctggcagcatcaacttgcgattggcttttccccaatatttaatcagcgcaatgtttgtgtgcgcgcgtgcataagtcgtcataatagcctcatttcgattcaaaatggtattcccacactttagccgcattagcagctttaagcgccgtggtaatcgctaccgcttgatcactggctgctaaagcaatcatgcaaccacccatccctgagcctgttaatttagcgccataagcaccgttatcaatcgccacgttaatgagacggtcaaggtcaggactgctaacgccaagtgcagacagatcggcctgatcgcgattgaacagttggcctaaggtaataatatcatcttgcgccaacgccaatgctgcctggcgaacggtgttaccgatatccttgatgagcggccggtacattttgggatcctgctttaaacgctctgccactgctccaactgcaattttagtttgtccggcaacgccagtatcggcaattagcaacacaccgtttcgtggcatcatgatcgagcgcggcgccttaccacggacgaaccattgcggccgctcagcgctagccgtggcagcatcaagaccgcttggattgccatgcaaagctttttcagagacagcggcccagttcagtaatgtgtcgtgtgatagcgatgtttgaaatgcatcgtaaaaagcgcgaacaactgccacagcggttgcggcagatgagcccataccgcgctcggaaggcaaagcactcgtgatggttaaatgaaatccttgattcttggcgttaaagaagatcaataaacgtcgaataagcatggcaataccggcaaaattggtcaattgaccagcatttaaatttcctgtgaaaaaagaagacgtcacagtttgtctgccatccggctgaggcgtgacgcgagctgacaagccgacactcttcactggcagtgcaatggccggttccctatacacgaccgcgtgttcaccaagcagaataatttttgcataactttttcccgtcccgatttccatataaacacctcgtcaatattctttattaatgatagcgcaaacgcccgtcagacactacttagatatgctagactaaagcataatgtaacagagcgtgagaagccacgcttagaaaccggagcataagcggcctcaagcctaaatggctgggttttggccatttaggcttgaggtccttatgtgcaggtttctgcggcagccaacgcgtttagacagagcgtgagctggcccggtgagaaacccgagtgtaagtgaccttggccgtgatggccgggttttggccattgctgccaaggtgcttacatgcaggttgctgcgctggggagcgcgtttaaggaggtaggtagcgcatggggctgcaattcattttaggagacgcaacgacggatcatgctggcacgatggcgacaatggtccaagctaatctgcaagccgattcacaaaaccaaattttttatttagtccctaatcatatcaaatttgaagccgaagtcgacttgttgaaacggttgcgggcgcaaacagcatctgtcaatggtgtatatgcgcaaaatcgagtgcaggtgctgtctttctcacgacttgcctggtatttccttaaaaacaccgcgctttatcaacagccacgacttgatcgggccagtaacacgatgttggtcgcaaagatactaggtgaaagcaaggaagaactaacgatttatgctggcgaagcgcataacactgggtttgtgacacaactggcggatcaattaagcgaattagtgaccggtcgtatcacagcagaagatctgaatacgacagtagtcgctttaagaccaggcgatcggcaccgtgctaaattgcgagatctggggatcattctggatcactatgaagcggaaatcggcccttatgccactaatgccagcctactaagtgggttgcaacaggtgatgcgcaatcaggacctgagccacacattcatttatctcaatgacttcaacgtcttttcagcttcggagactggattggtcgaaacaatgattgaaacggccgctgaggtgaccgttagcttagtgctggacaagccgtatccggctgcgccgccagtggcacctaatttattcttacctgcaggccggttgtatcaccgcctttatcaaaaagccaaaacgatgaaagtaccgatccggctagatcgttttgctaaaccgcgtccgctaagcgaaggcatgaagcaccttgctgattggtggcaaacgagtaccaatttacaaccacaggcgcctgcacagacagcacagaacaaagaagttgagttggcagtggcgactgatccatatcatgaattacggacggttgcccgccaaatctatcaagccgtccggcaaggcgcacgttaccgcgattttttgattttagcccgtcgcttggatccatacgcagcggtgattccggccatctttgaagaattcaacatccctcaatttactgatctcgaacggccaatgaaggatcatccgctagtcgtactcattgaaagtctttttgccatacaagaccacgattatcaatatcaggatgtcatgcgccttttgcataccgagttgttactacctgagaatatggatatcgcggcttttcgtgatgctttagacacaacagataaccatcttgttcgcactggcattaccggcaaaaaacggtggacacagaccgacccatggcgctattttcagcgcaatcctaacgctgacgattcgcaacttgatcccgaggcagataaaactgcccaaattaatgcaatcaagactttggttgcggacacggttccgcaattgctgcgtcaatggcagactgccaaaactggtcgcgaagccgcggccagcttatatcaatggctgcaaacgactggtgtgattgatcagctgaatgtgtggcgacaaaccgctaacgctgacggtgatttaagtcgcagtcaagccaacgagcaggcttgggataccttcacccaattgttaaatgactatgcgaccattttaggagaagctgacttcaatcgtgatcagtttcgagaactgttggcggccggctttgctagtgccacctacacgcagattccgtcgacgctggactcggtggttatttccgagacgggtttggttcgtttggccaaggcaaaacacgtttatgtgattggcgcaacaaacaccgcgatgcctgatgtgcctaacgatagtggtgtcttaaatagcgaagagcggcaactgttggcggctcagcttccagatgaccgttttttacctgaacaaggtccgaccacaaccttaggcgatcctttcatcaattatcttggatttatggcagcttctgaaaaactgacacttagttaccccatgcaaaatacgcaggaaaacagtgaaaatcaagcctcgccgtactttagacaattagcccaagcactgcaattgacacctgctacttgggcaccggctgggttggggacatctctaaaagcagttctgggtagtccgcgggccatgctcagtgattttgttcgcgcggctggtgaagctcagcatcagaaattgcctttgagtcgaagttggcaaggcgttttggccagtctcaaacaaaccaagctggcaccgttagctcagaagctagcaggcagtttgacctatcaaaataaccctggacgtcttgatccgacattagcagtccaattgtacggtcgggacatgaatgtctcggtatcgcgattagagacgtattatcgtaatcagtttgaatactttttgaagtatggtttgcttttacagccgcgacctgaatttgagttatcgccagccgatactggtggtcttttccatgcggtgctggatcaatatctgactcagttgcgcgacgccggccagacattggccgatgtcaccgcggcagatgtcgcggcggcggtcccgccattagtcgcggctatcacgaagcgcccgggttatgaaattcttggcagtacccatcggatggcttatttgacgagtcgcttaagtcggttattgatccaagtgctgacgaacatgcgccagcagcaacgccggaccgggttccgtccgatgcgcactgagttgcagtttggccgaattggggataccaggggcttacctggcttgtcttggccgctgccgcatggtggtcgcgttaatgtacgcggcaaaattgaccgactagacgtctatcgagaatcagatgcgcagcgatttatggttgtcgattacaagagcacgcaacatcggttcgatgacagtgacgcgtactatggcattgccttacagatgttgacgtatgttgaagcaatggcaaatgtcccagctgatccgccatttgtgccagccggagcactgtattttcacttacaagatcctaagttcaaattcagtaccgatcttgacctcgatattgatcgactaaaggcttttaaatatctaggtttcttggtagctaaagatggggcagacttggcggcggtagacaaaaccatttcagcagaaaccggtggacgcagcatgatggtgccacttggttttaaaaaagacggtgctttcaattataatcagtcaaacattctgacaccagaagatctaagtgcctatcttttgcacaatcaggcattgattattgatgctgccagtcggattttagccggggatatcgctttggcgccgtttcaatatggacaggaatccaccgttatcagcaacagcgattatcaaagtattatgctgttcgatccggcaaccgggtttgatcattacaatcatgtgccaaagttgaaacgcaaagaggtgcttgaccgcgtcacaactgatcccacacaaattccgcatcatcgtcaggaggattcgcaagcatgacccaatttacaacctctcaacaagcagcgattacccacgacgggcatgacgtgctggtttccgcctctgctggtagcgggaaaaccaccgtgttggttgagcgaattattcaaaagattctcaaacagcatgccgacattacccggatgttgatcgtgacatttactcgtgcggcaacagccgaaatgcgaaccaagattcagacggctttgaagaaggcactcaccgagcgacgacatgagcttagtggtgaggatcggcgtcatcttgccaatcaaattgccatggttaatgcggctaaaatcagtacgctggatgcctttagtttgcaaattgtccaaacttactactatgtcattgatcttgatcccggttttcggttgcttacggatgaaactgaacgctacatgctgcaagagcgcgtttgggacgatttgcgtgaacaattatatgccagtgacgaagcacctgcgtttgaacaactcacggctaattttagcggggatcgagatgatagcggtttgcaagacttgatgtttgagttgatccgccaagccggtgcgacaactgatcccaaggcctatttggaaggattggcaacgccgtatgcaccggaaaaatgggaagcgacctttagccaacaaatctggccgcgagttaaaggccaattgctgcaaatagccaccagtttgactcaggcgtcagcgttagccaatcaactgccaaacccaatttggtatcagcaaattcaggctgatcttgccccattgcaaacactattagaaacaaatgcacccacatacgatacagtccgcagtgtcttgatttcccatgaatttgctgcttggtcgcgcatcagtaaaggactggatgacgcagataaggacactaaaaacgcggcaaaagatctacgtgatgctgcaaagaaaacttggcagaacaaactggcaccaacttttgccttagctgctgagcaaattggcgatttgttgcgggaagctcaacctttagtggccacattagctaatgtggccttaaagtttgaagacgcgttgaccgctgaaaaggccgctcggcatgttcaagactatagtgatattgcgcataatgctttacgcattttgcaacaaaaagatccacaaaccggtgcaccaattgccgataactatcgcgcgagtttcgatgaagtgatggtggatgagtatcaggacattagtccgttgcaggaggctttacttgccgctgtcagcaccactacgccaggtgatcgattcatggtcggggatgtcaaacagagtatttacggcttccgactggccgatccgcaactatttattcataaataccaaacatttcaagatgcaccgaccgatcccgccgcgccagaacggattattttagctgagaattttcgttcgaccaaaaatgtgttggcgtttaccaatctgattttcagtcaaatcatggatccggaagttagcgatttgagctatgacaacgcagcggctttaaagtatggtgcgcttgattacggtgatgcgcatccggcagtgaaagtgttgttgtatagcaaagcaacatctgatgaagattcttctgatgcacgtgagttaccggaagatgctgatgataacgagccagtggacattgcgactggccaaacgcagctagtcttggccgaaattcagcgattaatcaacgatcccgatgcgcaactatgggatcgtcaggcgcaggagtatcggcgcatccactatcgcgatatcacattactgacgcgtcaaactagtcaaaacagtctgattcaaacacagtttgctgcagcaggagtcccattgtttgtggccgataccaagaattttttcaaaacgactgaattgatggttatgctggcgcttttaaaagtgattgataaccaaaaacaagatattccgttagtggctgtgttgcgttcgccgattgttggtttgtcagctgatcagttggcactgattcgtttagcggcaaaacaggtgccatattatgatgccgtgacagcatttctacaagcagaaccaaaaacgccacttgctcagcggacgcatgacatgctgacgcacttcttcaaccagctcagccattttcgcgacttggcccgagaaaatgacttggtcactttgttgtgggttatctatcaggataccggatttcttgactatgttggcggcaccccagggggcagtcagcgacaggcgaatctccaagccttgattgatcgagcccgcacttatgaagcgggtggcttcaaagggttatttgcctttattcactttattactttgatgcagaagcaggatcaagatttggcaatgcctgcccaagtcgatccagataatgatgcggtgaagttgatgaccattcacaaaagcaagggtttggaattcccggttgtctttttgatgcaggcaaacaaacattttaatatgcgcgatcaaaccggcactgccattttgacaaaacaaggtatcggtattaaatggctagatcctgaaactcgcgttgaatatgaattaccccagtatcaagctgccaaagctgcacggcaaaatcagaccttggctgaagagatgcggttgttgtatgttgctctgacgcgtgcgcaacagcgactttacgtggttggcgcaacgatgagtggcaatcagctgacgtctgctgataaaacggtcgaaaaatgggctgcggcggcggaaggtgaagcgcgtgttttggcgccgcaagtccgcagtggggcaacgagctatctcgactggatcggaccggccttgatcagacatccacaggcccgtgggttagccgaaacaactatcaaacctgcgctcgtcggtgatgaaacggagtttacaattgaaattgacgtgaatccgcaagtcacaccgactgcaactccggaaaaagtttctgacgattcaggaacaatggtcgacttatctgcgtggtttaaaaaggcctatcctttccaagcagcaacaactacgacaggttttcaaagtgtttcagaaattaaacgcgcatttgatgatccagataccattgatctggtcaatgcagatcgtttcctcggtcccaagccacccatgcgggatttaacggcgccagcgtttctgaccgaaacccctagtggcatcagcccagcagctattgggacggcaacgcatctattgctgcagctagtggatctcgccaagccgatcaccatggccagcttgagggctttgcgcgatcaattgaccaccacgcaggtcattgcggtcgatgtggcaaagcacattgatttgacggcacttattcgcttctttgaaactgatttaggtcggttgttattggctaagccgcagcaggttcatcgtgaagttccgttttccatgctgctgcctgctgaccatgtttttgaagcattggccgatgacccaggcgaggacgtcttgattcacgggattattgatggatacgtgagtgatgaacaaggcgtcacgctgtttgactacaaaactgatcataacccgaacacgaccgttttagtggatcgttatcgtggacagttaaacttatatgcacaagctttgcaggatttacaacccaaaccggtgctgcatcgctatctggtctttttgcgcaccggaaccgttgtcgatctggtagcatcaggtgctggtaaatagtatgatatgaacagtatgtttagacgggaatgtttaaaatgaatgctgagaccatttttgctgtggtcgatttagaaacaactgggaccagcgtcaaagacggcgaccggatgatccagtttggatgtgccttaatgcagcacggcaaaattatccagacaatttctcagttggtgaatccggatcggtcggtaccagtggcaattcagcgactaaccggcttggatcccaatcgattagtcgcggccccttattttgaagaaatcgccaaaacgttgcatcagctgttgactgatacggtttttgtagcgcacaacgttaatttcgattatccttttttaaatgcggaatttgagcgagtggggctgccaaagctgcaattagctgcgatcgacacggttgaattggcgcaaattttattgcctgagattagcagttttcgcttgcctgatttaacgagttacttacaaattgagcacgataacccgcatcaagccgatagtgacgcgattagcacggctaaattgttgcgccagctggcggctcgctttcaggccttgcccagtccgacgcaacaggcgttggttgcgcgcggcagtggcttgttgcgagaaaccggcgattatttgaaggcaattgctaaaccgttgaaaccgttaaaacgcgggtttgttcaagttggcccgttggtcttgcgccgagtgccgacagcaacgcaggagacgtttgcgtcagcagcttatccggcaacggatcttgaaaaacggcacttgctccaaccgcgctatcgcttccgcaaggcccaggcgcggatgatggatgcggcttttgcacatgcacaagagggtggtccccagccacttttcattgaggcaggaaccggtcttggcaaaacgcttggatatttgctgccttatgcttatgtcgcaaccgccgaacataagttagtggttgcgacatcaacgcttgttttgcaaagccaactaattcagacggccattccgactttagccgctgttttaggcagagacttgccagcagttgaggttaaaagtccgcaacattatattgatctcaacaagttcgcggctagtttgcatcaagaatcaccaagtcggcaaacacagttattgcaaatgaaattgctggtttggttgacacaaacaaccacaggcgacctcaatgagttgcacttaacaacttatcgggcaccattgttcatgcaaattcggcatactggtgattcaggcacaccatttatcaacccgtattacacacttgatttttatcggcggctgcgtgcttccattgatcgggcggctatcgtggttacgaatcacgcttttctgtcacgccacgctgatttgttggaccttgaggcgccatttctggtcgttgatgaagcgcaacattttgctgataataccgccgctgcctttgcgcaacggatcgacttagcgcagattcggcggcagttgcgacatttgtggcgattgagtgatcccgatgaagatcgctcattggttaacgtctatcaaaatgatcggcagatgctgcctgtgttggcgcaacttaacgctctaacaacaacggcccaggaaacgattgaaatcctgcagcaccaaatatatcggcatttctttaacggcaagacaacggctgatcaagggtttgtgagtctgagcttggatcaagctgctattaattggttagtcacgtcccaaacagacaatattaagacattgataaaagtcattggtcgcattcaggtcattgcgactaaactagatgcagatttcaatggccggcaacatttctttttaaaaagtgatggtcaacgatttcaagccttagccgcgttgacagtcaccctgatcgatcaacgtgaccgcttgaaattactgttagcgcgcttgccagaactggttgccggccaaactgccgtggcttctttgacgttgcggcaaatgcatgatgttagcagtcttggcctaagttgggacatctttcaggttggatcagccattcagcagttgctacagcggtttacggcaccggtgtttgtcggggcgactttaaccactgaccgttcgtttgactttttaaccgctcagcttggttaccatgatttaccagagacagcttttctaaagttacgcagtccttttcattatcgtgatcaggcaaaagtactagtcgccacggacgctcctgcggctggtgcggtgagtgcagaagcctatgccgattatcttgccgcggcgattgagttgttggctgataaccgacaccaaacgattgtattgttcaattcactggcgaccattgccgcggtttaccaacgccttgctcatcgaccgattgccgatcataaagagttattggctcagggggtgactggttcggcggaaaagatcgccaagcgttttgcggtcggtgatcaaagtttattgctcggtgccgcaagcttctttgaggggattgattatccggatcggttgctcgaaatggtgatcttgacccggttgccgttcgatgcgcccgaagccgccatcaccaaagctcgatacgaacgacttcaggcagcaggccgcgatccatttactgaggatgctttgccacgcgcaaccttgcgattacgccagagttttgggcgcctgattcgaaccgaaaccgatcgcggtatcttcgttgtcctcgacccccgattcatcaccacacgctacggtcgaaaaatgcagaaatccttaccaaatattaagccaatgacgttgccactaactgacatgccggggtacattaagatgtggctagacagagcgtgagcaggcgcgtttagaaaccggagcataagcggccttaagcctaaatggctgggctttggccatttaggcttgaggtccttacgtgcaggtttctggactggcgaacgcgttttagccaaaagttgcgagcaggccatccgtaagcgccagagattgatggccgagaaaactttggtcattactttcaaagcctgatatgcagacttttgtgccagcaagtgcttttttagaaattttaattaccccacgtatctcgtcagctatcaaaaatcatctgaccatacttcgaaaggaggcaccccatgcgtcatcgtcgatttgactgggttaagttctttgtgattactggattgattgttttaattattggtgccattggcgtctacgcgaaaagcctctcaccttatcaacaactacgtgggcaagctgagaaaatcgcgacaaaccgtgcaaatctgaaaacgattaacggtttttggtggtataaccgcgacaaaagttatctgactgttgcgggtaataccaagaaaaatcaagctgtgtacgttgtgattcaagaaaaaacgggcaaagtcaatattttaaaccagaaatctggcatcactcggcagcaagcgttgcagcaaatcaatcaaagtgcttcgccaaagaaaatcttggatgcttcattaggaaaacgtgggtcagaattcgtttgggatattggctatctgtcaaagtctggtaaactaaactacgtgacgtacagttttcgcagtggcgaacagctgaacgcgatcaaaaacttataaataaagtatgattcggcagcgcaaacgactgccggaagtgtaggaggcgcagtcgtgcatttagcaaaaagaatcctcaacgtcgcaccatcagcgacgcttgcattgagcaatcaaactaaggctttgaaggcaaaaggagccgatgtcattgatctgtccattggtcaacctgattttcagacgccgaaaacgattgatgaagcggccattgctgccatccaagccgggaatgctagtttctatactgccgcgactgggatcccagaattgaagcaggccattagcgaccgcattttcgcgcaagacggtgtgcgttatccagctagccaaattgtggcgacgactggggcaaagtttgcgttatatgctttgttccaagtttacttaaacccaggcgatgaagttttgattccggtaccatactgggtttcttacgaggaacaaatcaaacttgctagcgggacgccgcatttggtcatgccatcggaaggccacaaagtcagtgttgatgatcttgaggcggcgcggacggacaaaacgcgtgccttaattatcaactcaccgcaaaatccaagcggggttgtctacacgcgaacagaactgacattgattggtaactgggcactgcaacatcatatcttggtcatcaccgacgatatttaccgcgatttaatttacaacggcacaaccttcacggcaatgatcagcatcaaccctgacattgtggccaacaccgttttgatctctggtgtttccaaatcgtatgcgatgactgggtggcggattggttatgctgccggaccagaaaaactcatgcaggcgatggcgacctttatcagccacaccacctcaaatccagcagctgtgtctgaatatgctgcagtggccgcattgacgggcgatcagcagattgtcgaaaccatgcggcaagcatttgaggaacggctcaaccttttttatgatttattagccgaaattccggggtttgacatgggagataaaccacaaggcgccttctatttattcccgaacatcaagcgagcggcacagttgagtcattatggtaccgtcgatgactttatcagtgcgttgcttgcggcaaccggcgttgcaatcgtgccaggccgcgcatttggtatgcccgaccatgcgcgtatcagttattgcaaggatctagacagcttacgcgaggccgcacgacgtattcgagaatttgtgggcaagtaattatttaaattagaaatagggagttaacgcatgacggaacagattcgcatcattgatgccaaagaacatgtgaacgaagaagttaaaattggggcttggttgaccgacaaacgcagctcagggaaaattgcctttttacagttgcgcgacggttcagcttattttcaaggagttgtttcaaaagctgatgtcccagaagacgttttcagcttagctaaagaactgcgccaagagtccagtatgtggattacgggtgtgattcatcaagacagccgcagccactttggctatgaaatcgaggttcggaacatcgaactggttggtgattcgcacgactatccaatctccccgaaggagcacggcatcgaatttctgcttgatcatcgccatctatggttgcgttctaagcgccaatttgcgattcaacaaattcgcaatgaaatgatccgagcaacgttcgagttcttcaataacgaagggtttatcaaaatggatccgccgattttgaccgattccgcaccagaaggtacgaccgaacttttcgaaaccgattattttgacaaaaaagcttacttgagtcaatcaggtcagctttatgctgaagcaggggcaatggcttatggcaaagtcttcacctgtggtccagttttccgagctgaaaaaagtaagactcggcgccatttaaccgaattttggatgattgaaccggaaatggcattctgtcaccaagaagagagtttgaaggtccaagaacgctacgttgcctacctcgtgcagtccgttttggataattgcgcctatccgctgcacttgcttgatcgcgacccagaagtactcaagcaatacaccaaattgccatatccgcggatcacatataagcaggccattaaaatgttgcaagatgccggtatggacgtcaagtatggtgacgatttcggttcaccggaagaaacctacctgtctgatcaatttgatcaaccggtgtttgttttgaactatccgaagacgatcaaaccgttttatatgctgacagatccggaagatgatcagcaatatgtttgtgccgacatgctggcacccgaaggctatggggaaattatcggtgggtctgaacgtgaaaccgactatgacacactgaagaatgctatcgaacatgctggacttgatttagacgaatacgaatggtatctcgatctgcgcaagtatgggagcgtgccacattcaggctttggtcttggacttgaacgggcaattacgtgggtctgcaagcttgatcatttacgtgaggcgattccattcccacggatgatcaaccgtttgaaaccatgatgacaatcaaaagtcggacgcctgtgcgccggctttttttggagggcaagcaccatgacggatttcaaaacttatcttgaggcagggcagttcagtctgtcgaacctactgtttgatcactacgccaccttggggttaacccaaaccgagttcatgacttatttgttcattgatcagtggcaggcaagccatcatcaggcaccggatttgaaagtgttagctgcccgaatgaacgttgccccaaatgcgatttatagtgccattgagacgcttattcaaaaacaagccattgctttggaaagtgtcccagatggtcatggtcggatgcgtgatcattatgatctcagtccaatattggctaaactgccaacctcagctggtggcacaccaaccccggcaacttcgcaagcaaatgttgatgcgcaaaccaatgtattcaaccaaattgagattgaattcggacgaccactatcgccaattgagcaagagacgattcgtgattggcttacaaccgatcattatctaccggaagtcattttactagctttacgagaggctgtattgaactcggcttattcgctaaaatatatggatcgcattttgttgaactgggaacgccgcaatcttaaaacgccacagcaggttcaggcagatattagacgtcatcaggagctgtgacaaagccgcaatgacaagcgccaggaaaatcttatatgaaaattcacccatcattagcccaagaggaggcaccatttgtgaccgatgctgaagccaaacaactatttgatcagatcatggcactttatcctgatccgcaaccaaccttgcacgccgaggatccatttcagattcttgtagccgtcatgttatcggcgcaaacgaccgatgtggccgtcaatgcggtcacgccaaagctttttgcggcttatccgacgcctgctgacatggctgcagcgccggttgaggcgatcgctgcgatcattagccggctaggtctttatcgtaccaaggctgcgcatttgaaagctttgagtgatattttggttaaggaatatgcaggtaaggttcctaacaaagcggctgacttggtccgtttgccaggcgttggcaagaaaacagccaccgttgttttaagtgatgcattcaacattccaggtgtggctgtggatacgcatgttagtcgaattgtaaagggattaggactcgtcccgcaaaatgcgacaccggttcagattcaggcgcgactggaagccttgatgcccccgtcagaatggattaaacttcatcgcagcctaattcgttttggccgggagtatctgcgcgcccgtgatccgcaagtgccagcagggacgcaatgggcgtttttagaaacacattatttacctttagggggcaaatcatgacagatagcattgtgccatccaaacgaaccgttcatcgggaaagttgggatcagtattttttggagttagcggagaaggtctcggaacgatcaacctgtgagcgagccacagttggggctgttctggtgcaagaacatcggatcattgcgactggctataatggtgccattagtggcgatccgcactgtgatgaggctggccatttgatgcgagacggccattgcattcgcacaattcatgccgaaatgaacgcgattatccagtgtgcggctaacggtgtcagtacccatggtgcaactgtttacgtaaacttttttccctgtcttaattgcaccaaagccttgattcaggccggtatcaagcgcgtggtttatgcgcaagattatcgtaacgatccatacggcgaagccttgctaaagcagcatcatttggatgttgtgcgactcagccaacaataatttccatacaaaaataagcctcatccgattcttgcattgccgtcgttaggcaggtgcaagaagcggatgaggctattttttagggtttactgaagcagcttagtcgttatcaggggttgttactaccaccgctgccgctaccagaacccgaaggcgtgcttggttcgcttgaactggcacttggttcttgatttgaaggttgagaggaggcagaggctgatactaccggctcagagctggaaactgaacttgagctttcaatactttctcgtgaagaggaactaacagaactgcttgagctcgaggaagaggactcgactgccgctttgcggctgcttgggccgtgtccgcggacgtagagttctttagtcgtatcaccagatccgccggtaatggcagttcctggattacttcccttgagaatattataagactcaactgtatcaggcttggtccaatcacgattggtcagactctgtgacgtataagtcattagtgctttgtatatttcttgtgaaatggtctgttcagcatagctaatcccgtgtgaagtcggtttatcataaccggtccaaaccgaaatgactcggctacgtgtataacctgtgaaccaggcatctttggcaatgccagttgcgttcaatgcggggttttgttggagttcggcatcactatagtcagtcgtcccagttttaccagcttgatacagtccagaaatagccgccgaggtcccggttcccttggtcagaacgccttttaacatgtcagtaatcatataggcggtactggacttcatagcccggttgccttgactattgaaggtttgggtattgccatcagcggtgacaactttgctaacatagtacggtttatagtacgtgccgccattggcaaaggcgccataagcaccagcttcttgaacggtattgacagaagcaccgatcgcacttgagagatattgttccgaacttggcaaattgatccctaaaccactgaggaatttaaccgcattcgccatgccaacagtactaagggtcttgaccgccggaatatttcgtgactgttcaagtgctgtccgcatagagatgcgtccttggtacttcttgtcccaatcataaagtgaaatgctcgtgcccggatacgtgtacggttcatcggtcatctgctcgtaagtggagtaattcagatattcaattgctggtccataatccatcaacggtttcatggtagacccattgctacgtgtattttgtgcagcacgattataggccaagcggacgtcgccagtttttcgaccgccgatttgtgcgagaacctgaccattgtttggatcggtcatcgtgacaccggtctggaaggcatcatcagggaagttaacgtattcgtcagtgttaacaatgtcataaagccgacgctgagcgcccatatcgatattagtataaatatccaagttgtcggtatatggattaaggccggtctttttcttaacttcggcaatcacttgagtgaggtaagaatcaatcactttgtcattggttgcggtattagtttgctgctgttttggctttaagccatcagtgattggtgttgctttggcttgtttagccgccgtcgcggtgatctttttatcacgcaacatggcatcaatgacggcattgcgccgttgagttgctttttgcggatattcatagggatcataaccggctgggctttgcggcaggcctgcaataaacgcagtctgcgcaagcgttaaatccttcagtgacttgttaaagtaaaacttagcaccagtgctcatgccatattgaccatagttcatgaaaactttgttaatgtaatactctaaaatctgatccttgctatatttttgttggacctgcatggccaaccaagcttcttgtgctttacgccgaagggtttggtcggaggacttggtactgaaaaccgacaatttgatcagttgttgcgttaaagtcgagccgccctgtaaaccatcgctagtgcctgttagattattaaacgctgccccgatgattcggacaggatcaacccctaatttctcatcataaaagcgccggtcctcaatggagacgacggcatcttttaattgttgcgggatttccgaggccttcacataatcccgactttccaaaccaagtgtcgtaatttcattgccagatcgatcataaatggtactggaaccgcctgactctaattttgcctgagtcacttctggcgcgtctttagcgtaccaggaaaacaggccaacgccgagaatgaaaaatgccaggatcgcgagcaacgtccacttaagaattcgccgccataatcgttttggcggtttaggggcagatcctttcctgaacttatcttcgcggcgtcgggccattcgcgacatattttgattatcagccacgcacattacctactttcgtttcaatcaaccagtcaaccccatcaagaaaggggatgaccggctgtagttgtggatgaagctcgaatccgtttgtgacaatatccttcaatggaatcgatttgcgaccgccgtctggttgtcggtcccaacagtcaattagtcgaccagcagggaaaacaaagagacgtttcagggttgcaaaccgaatgaccacaaaacagatcccgctttgtttcaaacagcgccgaaaatgctcaatctgatgctgatgaaagttttttagcgggaagctcgctttatttttagtttccttggcttcaaagtcaaggtaaaatccacgataaacaccattataatctgttgttgacggcgttttaaaataggcctcgcgaatcacagcctgacttcgcttagggtagtcaactttcacaatctgaactggggtcggtttcttgtagacgaccgctttatcaatactgcggtaatattgattactgatgttcaattcttcttccaacgtcataccgcgtccaccatagatagttggacgcgaaatagcttgtgatgaaaattgcgtcccgtctttgtatggattaccattagggtaatgaatggtcatgcgatcacactccttgcgctattataccaatatcagccgctttggcctaataatcggaggtaagtcatggttggaaaacgattatgggtcacggggtaccgtgcctatgagctcaacgtttttggcagtaatgacccaaaacttaaggtacttaaaacttcattaaaaaatacgctcatgcagtttcttgatgaaggcttggaatggttaattactggcgggcaattaggcgtggagcagtgggcagtcgaggttgctttaggactcaaaccattgtatccagattttaaaattgcgatgatggttccattcacagattttggcaagcagtggaatgaagataaccaaggtcaactggcggccctacgtggacaagtggacttttctgatgcggtttcgcaagcaccgtatcaacaaccagcgcagttgcagggctatacccggttcatgaccatccatacagatgcagcgctgctggtttatgatccagaatttccaggtaaagctaaatgggattaccaagcagcagaggcgatggctgaccgtcgtgattatccagttcagctcattaccatggatgatttagaagaaacagcgcaagcaatggcagaagctgaaaatgagcattttcaaaatgattgagatatggtaagctaattagtagtttggttccatgaaaacaatgaggtgtgtcggaatggatagtaacaaagagacaaagtttagcatccagtacgagcctaaggatattttggacaaaaagttcaaaaacaaggtccgcggttatgatcctgatgaagttgacgaattcttggatggtatcatccgcgattacgaagctttcaccaatgagattgatcgactgaaggaagaaaataccaagctgtttagccgggtcgacgagctgaccaaacagctgagtgtttccaagaatgtcagtgcgcagacgccgcaaaccaatgcggctgcgacaaattatgatattcttaaacgtctgagtaatctggaacgtcatgtgttcggctcaaagctatctgatagcagtgttgacaatcatgatgacggcaaccattccgacgttgaccaatattaatgatcacatgtaggtcctgagtgatcgcggtctgcttttgcaggctgaggaaagtccatgcccgcacaagctgagatgcttgtagtgttcgtgctaagcccaataagcttaggggccgtgtaaacggctacggcggccaaacgcgctaaggcgtcagctatgcgctagtaggtctgaaaagtgccacagtgacgaaacgatcagggaaacctgagcggtggaacgggtaaaccccgcgagcgagtaacccaaacttttggtaggggcgttttgccaagcaaattgaagcgacggcaatacagcggtaacgctgagatagatgatgactgaaggagcttgtgcctgaacaagttctggaacaaaacatggcttatagggatctacatgcaggcacagcccggggaaacccgggctgttttttttaaagcggaaacaaaagcgtttagaaaccggaatgtaagtggccttgaccctaatgaccttacgttggtcattagggtcaaggtccttacgtgcaggtttctgcttttgtttgcgcgtttcggagagccaacagaggttttccacacgcgggcattgtcttgcttcaagggcccttacacgtcagtttctgcgcctttttgcgcgtttaaaagaaccacgaattttttaccttcaaattccttacacaaaaattcctgtgatcatcacgaccactttctaatcaccaactcaagtaccattttcccccaaaccatctcaaaaacttgtaaactaaaactaaccactaaaaacgctgcatgaatgaaaggaaaacccatatgaaatatcaacttgttgccacgatggctgccggacttgaatctgtgacaactaaagaattgaaagcccttggcattcaaacccgaacagaaaatggtaaggtttattttgaaggcgatgataagacaatcgcgctaaccaatgtttggttgcgtagtgccgatcgaattaaaatcgttgttggtcaattcaaggcgctgacttttgatgcgctttttgaaggcgttaaggcgttaccttgggatcactacctaccgcttgacgcagcgttcccggttgagggccgagcggttcgttcgcaattacattcagaaccggacgttcaagccatcaccaaaaaagcaattgttgaaaaaatgtctgcggtttatcatcgcacgacgcggttaccggaaactggcgcgacttacccgctggaagtttcgattttaaaagatattgcaacattgacgcttgatacgactgggtcaagtctgtttaaacgcgggtatcgaattgccaaaggtgaggcgccattgaaggaaaactttgcggccgcgttaatcatgttgacaaactggcatccggatatgccgtttgtcgatccaaccactggttccggcacaattgcgattgaagccgctttgattggccataacattgcaccgggtctgcaacgccaatttacttttgagaactttggcttttttgaccagccagtcttacaaaccgtcaaagatgaagcgatggatcaagctgactttgatcgtgaattagatattcaggcaagcgatattaacggtgacatgattgatatggccaagttgaatgcgcaacaagcaggcttgctgcatagcattcagtttaaacaattggcagttaaagatttttcgacgaccaaagaaaacggggtcattgttgccaatccaccttatgggaaacggctcaacgatcaggccatggttcgacaattatacgcagaaatgggccaagcatttgcgcctttgaccacttggagcaagtacattttgacaagtgacatgggctttgaaaaggcttatggcagcaaggcaaccaagcgccgcaagctgtataatgggactatccgaaccgatcttttccaatattggggcaaacctaactggcaccatgatagagcgtgaccaggggcggttagaaaccggagtgtaagtgagcggccttggctgtgatggccgaactttggccattggagccaaggtccttacacgcaggtttctgcgcctacgtacgctttttttgaaaaggaatgcgacatgatgaagattctaaacagctttagtctgaagccggagcagcgccaaacacttgaagcagcgggacacaccgtcatcgatggtgacaagcttgatgatgccacggctcaacaaattgacgtggtttatggttggaatgctgcggctacccgcgtgaactttgatcgacttcagtttgtgcaggcgatgtccgctggcgttgattatttaccattggctgagttggctaaacaccatgtcttgctggctaatacaagcggcattcacgccgaacccattgcggagtatgtgcttggcgccatgtttacgatcagtcccggtattttgccagccattcgagcagatcgcgacatgtggacattacgccaagagcgaccgccaatgacattgcttaagggcaaaacagcagtcatttttggcaccggtcatattggatcaacgattgcgaccaaactccaggcattgggcttgcacacgattggcgtgagtgcccatggccgtccggctgcaggatttgaccaagtgatgacggatgtggcgacccatgaggcagcagggcgagcagatgtcgtcatcaacgcgttaccattaacgccagatacaaaacacttttatgatgaagcattctttgcagccgctagcaaacaaccgcttttcattaacattggccgtggtccgtcagttgatatggctgctttgacgcaggcattgaaaaacaagcaaatcagtgctgctgccttggatgtggtggatccggaaccactgccgcaagactcaccattatggggcatgacgaacgttttgctcacgccgcatattttgggcacggtgccacaattacgcgacaaagtttttaaaatatttaatgataacctcaaaaccttgatatcaagcggccaattggcaagccatcaagttgatctcacgcgcggatactgaaatttttcgacacaaccgttatactgaagctgtaaccgatttcagtcactgcatcgtcgctgactgatgttcaccgcggctagcagcgatgcgcattgagacatctgcggacaggtttttcgctcgtctgctcttagatgaaggaggaattgcttatggcacaacgcccggaagaaattaccaacttgcttcaagatgcattgcacacgcagcatgaggtcgcgatcaatacgattgatcgccatcggttcaagggacgcgtggtcgatattgaggccgcgactgtcaaaccttataatgaacgcggcgtgatcaccgtggcaacaggtcggggagcgaaaaggattcaggcgtacgccattagtcaaattaaatataattgagcgatcaatcgctgatcgatcgaaggacagcctgttaaaggttgtcctttttgcatgaaaaaaggcggcacagcatttggccgtgctgccttaagttctaaaaactgatgcgattatggtacgagcaggttaaccacatcgtccttaggaatattggtgaagtactcattcgtgttgatggcatctaaagtgtctttaatggctgctgacgtgtaaggcttgccttttaacgcaccggcaacatccgcaacatccttaggaccaaagaaatcaccatagaatttgacgttagcaattttgccttccttgacatcgaaacgagcatcaatcgtcccatagtcaaaatgcttccgcttcttggtggtgaattccgggctatggccatatacccaatcccagttgttgtaaacatcatcgtaaatctttttaatttcgacttcgtcttctggggtgacgtgatactctttgtctttgatttcagcgacgtcatcaacgccgaacaaccgagtcaaaagaatatcgcggaattcaggaacagtgaggttttgatactttttatctagataaggccgcaagttcgtcacacggctcttaacagatttaatgcccttactcttgatcttgtcttctgggacgttcaagacgttaggaatcacactcatgtcaacatccagcatcaaagtaccatgggagaacgtcttgccgttacgtgtatacatagcactgccagagaactttttaccgtcgaccagcatgtcattacggccagaaacttcagcgctagtcgcccctaaagtatgaattgcatcaacaatcggctgtgtgaaggacttgaagtcaccaaattcttcagagtcactgtcaaccacaaacgagaagcacaagttattgagatcatgataaactgcgccgccaccggacaacctgcgcgtcactacaatgttatgatcttccacgtatttttgattcaactcttcaagcgtattctggtttcggcccacaatcacactcggcttttcatagtagaacagcagtaacggttcatcaaattgtttcgagttcatgagatattgttctgttgccagattctcacgaatatcatgagacttcataatgacataatacattttcaatcctcctgaatgatgactgccattgacgactagccatcgatttgacttcatgctccattttagcgggttaatcattaaaaagaaagcgatttcgattgtgaacaattgacttaatcagttcttcattgttctcaactaaaaggaatatggatgaaaagcgattcaaccgtgcacgcaaatgagaagtgcgttaagattatgacatatctgttcatattgaaaggggctttttaatgactagtgaagtgcgctaccaagatgatctgtaccgggcagttaacggggcttggacggatcaggcagtcattcctgatgacaaaagcagtactggcggttttcaggaccttgccgatgaagtcgaagaaaaaatgatggctgatttttcagcgattgctgacggcaaaaaaacggcgccagacaagtattttgcatctgcggtgacgctgtacaaacaagccaaggatttcaagacccgagacgcagcgggctttgcaccagccttgccgcaactacatttggttgctggcattaaagaccttgcggattacaatcaacgggcagccgaactgcttcaggagcatctgattgacccgccatttaatttctacgtagatgctgacatgaaagacaccagcaaaaatgtgattaatttgatgggtccacgaaccattttgccggataccacatactacgccaagggcaatcaaaacggcgaacaattgatgaccattttcaaagatatgatggctaagcttttagcttacacagatcttgacgctgctgcgcaaaagtcgactttagctggcgccttggcatttgatgcagaagttgcgaaacatgttaagagttctgaagagtgggcagattaccctaaggcctacaacccgatgccgacagcggaggttgttgaaaaactcaagccattcaagtttgctgacttcttacaaaagatctttaaacaggtgccagaaacggtcgttgtgaatgatccgcggttcttggatgagtttacgcagttgttcaacgaagctaacttcagcaattatcgcgactggttgtatgtcacccggctaaacagtcttgttagtcttttaagcgaaccattgcgccaattaggcggtacttttagccgtgcgctatccggtgcgcccaaagcaccggatcaaaccaaacacgcctaccgattagccaacgctttctttagcgaaccaattggcatttactacggccgcacttattttggcgaaaaggcgaaggctgatgtaacacaacttgtccaaaaaatgattgccacttacaaacggcgactcagcaactctgattggctatcacaaccgaccaaggacaaggcgattcttaagctcgacaagatggtgctcaaaatgggttatcccgataaacctgaggacgtctacgatttgctgcacgttaatccggataagtcactgatcgataacatcaacgcgatgcaacttgttgagcttcagtacaacttcgacaagctcaccaagcctgttgatcgcaccgtctggaatatgccaggtcacttggtcaatgccagttatgatccttccaagaacgacatcactttcccagccgccattttgcaggcgccgttctattccctgaaacaaagtgcttccgaaaatctgggcggtatcggcgcggtcattgcccatgaaatttcccatggttttgacaataacggtgctcaatttgacgaacttggcaatatggtgaactggtggcaaaaggctgattatgcccactttaacaagctcaccgaagccatgatccaagaatttgacggtcttgaaactgaagccggtaaagttaatggcaaactcgttgtttctgagaacatcgctgatgctggcggcttggctgcggctttagatacagccaagagagaaccggacgttgatctgcatgccttcttcatcaactgggcaagaatttggcgttcaaagtctcgcctcgaacggcaaaaaatgctactagcggttgatgtgcatgcaccacacgaattgcgggcgaacattcagccacgcaatcttgatgattggtacacaacttttgatgtccaaccaggtgatgggatgtatttgccaccggaaaaacgtgttcaaatttggtaatcctttagcatcggctcatttgcagccggtgctttttttgaatcaggcagggatcttttgcaagagatgcgagtgactagatttaaataaattacccgtggtgagcgtgacttacaaaatagttgcgtcctgctgtgtgaaagggaatacaattgttgtcggatagagtataattgttataggaagcagtttgcgataaacaaggctgataggaagtaggggagtttatggaactgcaaacgttgcgcaacttcattgaaattgctgaccacggcagtattaccgcggcggcacgaacgctgggcatttcacaacccggactatcgcgccaattaaaagacttggaaaaagagctcggcgttaaattactagttcgtggtaatcgacgtgtgacgctaactgaagatggtacctatttgttaaaccgggcacgtgaactcaccgcaattgccgagcgcacaaagaataatttgcaaagtaaacatgcgcttggtggtgacctttacattggtgcaggcgaaaccagcggcaaacggttggttcttcatgttgcccaagaattgcgccatcaataccccggtttgcatgttcatgttacctatggctccgatgaagggctggtggccaatcttgaggccggcatgtatgatttcatactgcgacctggcaagcagcagacgcagtatgaaagtttgctactgccagttcgtgatgcttggggtattttgatgaccagtgatgatccgttaactgataatttattgatgacaccaacggacattggcgacagtgaattaatcctgccgcggaccacgcacgcacgcaacacatttgaacactggttaggccaaggcatggatccggcttacattgttgggacttatgacctgaccgtcaatgcgcttgggatgactgctgtcggcttaggacgagccttgtgtcttgaatatttggccacccaaagtcctaacacatcattgaccttccgaccattagcaccagcattagcggacccagtagcgcttgtctggaaacgtgatcgcgagttgtccagaatcgcgcaacgttttcttagtatgatgaagcaaaccattaaagacagtgaatgatcatcgtcctaatcagaccaaaacaaaaaaagccaccgcaaagcattgcagtggctttttttgtgggtctacactttctggtgttgagaaataatcaacactgaacgtgtaggcccttctttaacgcgctcgccagcccagaaacctgcgtgtaagggccccagatgcaatggccaaaaccgggccatcacatctggcgccgcttacactccggtttctaaccgggctggctcgcgctcacaaaaaaggagtgtcttttaatgtctgcagaaattaccactggcgatctggctcaattcaaacaagatctccaagccacacccggtgcatccgctcttcaaaaagcggtcatgaacaacggtatcaacgcaactgctgagaacacggacagcaaagttgccatgaccccgactttttctattgaacttgataccggcagcgttgccaaccaaaagcaaagtggccgttgctggatgtttgccgccctcaacacgatgcgtcacggcattcaagcacaatttaaaatcaaagacttcgaactttctcagaattacaccttcttctgggacaaatttgaaaaatccaattatttttatgaaaatgttctgaaaaccgccgatcaaccactcgacagccgtaaagttgcttttttgatggccacaccacaacaggatggtggtcagtgggatatgttgtctgctttgatcgaaaaatacgggatcgttcctaagtccgtgatgccggaaacttacagctcaagtaaaagtagcgagttgaacggtttgttgaacttgaagttacgcaaggacgccgttgcgcttcgcaaactggttgctgataaagcaagcgatgctgatattgaagcagctaaacagaaaatgttagctgaagattatcggattttggcttacaccttaggcaacccgccgacgaagttcgacttcgaatatcgcgatgatgataagcagtatcatattgaccgcgaactcaccccgcagaccttcttcaagaagtacgttgcgtggaaccttgatgattaccaaagtatcatcaatgcgccaaccgacgacaagccatacaaccatttatacacggttgaaatgctcggcaacgttgtcggcggccgcgaagttcggcacttgaacctcgatatcgatactttcaaagccttggccgttaagcagctcaaggcaggcgaatcggtttggttcggttctgatgttggtcagagttctgatcggcaattgggcatcatggataccaacatctataagaaggatgatcttttcaacaccgacttcaccatgaccaaggcggaacgcctcgattacggcgaaagcctcatgactcacgcaatggtcctcaccggcgttgacattgtcgacggcacgccaaccaagtggaaggttgaaaactcttggggcgacaaggtcggtgacaaaggctattttgtggccagtgattcttggtttgacgaattcgtttaccaagttgtcatctccaaaaagtacctgtcagctgacttgcaagacgtcatcaagaacgaatacgacaaaccaaccgttctggccccatgggatccaatgggtgctttagcttccaaataagtccatacgaattggtaagctgtcatattgcaaagcctcacggtcaatgatcgtgaggctttttgctgttcgcaacccccttgcgaaaccatcaaaaaatgttttgctagttgacgtatcgaacttttttgattaaagaaaaatgtggtattctggtgacacatcgtaaccacgcgttttttgataccggagtcatctcagaaaacgctcactttggagggcaatgtatggggacacaattcgcctttgactggcgccaaatcattcattcacgaaaaaacatggccgtactcgggttgttcatggccgcttttatcgtggcgtttttcgctttaagttggaccaaacagctcgatgtcactcaaacatcacaagcaacagccaacgccgcgttggccaactatgctgaatataatctggatacgttgagtcaagcacaaaaaccattattggctaatcttgacgcccaaaattcagcaaccggcgtcattggcttgggcctgcagcttgatgagcctgacactacccgtaatgggctgcttagtttacgtacggcgcagctagccatgcgccaacatcattacaaagcgctcaacacgatgccgctgccaccgttgcatcagcttactggcgatgtgctgagcctgaacgttttaaaatctgaaggccggcctgctgcaacaagcgttagcacaagtgcttcttatattgttttggtgttaccttatctcggctggatcactggcgctgctgcgatattgctcagttgcgacagttggatcgagcggcggcgacaccggacactcatcactgctcgtcctttgacagctggccttgcggggagcagccgcctactaatgcttaccggtttttacatcttaacgctgcttgccggttttgctttgatggttgcgacaccagccctgatagctggcctaggtgacttcaattatccgatcgccgtcatgggtacagccatactgccattgtggcaatacatacttttgtttggcggcctgacaatcttagccggtatttggctcatcagttttagtatgctagtcaatacttggatcaccaacgtttatctgaccgcctttatcgtcatggcagccggattattgccagtcatgctaccacagctcttccatttcctgtggttcctgccaatgccatatctagacagttacgcgacattaagcggtaccttagtggatcgcttgaaccagccacttgctagcgtcgtcattggcactggtttgctgtttctctggacctttgttaatctctttatctttggcctacgtgtcaaaaaggaggcagcatgatggcttattttcgttttcagttccaccagctgctgactaaccggaaaaatctagcggtaattggtatcgccttagttgccctgatctgccaatttgtttttttcccaccgaacaccacaccggtcgagttaccgacagcaactgttttaacccgtgatcgcgataaaaatattgcctttgtcaacgaatcgcacgggcctaataccgctgtgtgggtgccatcaacacgcgaatttgctaagcttgaaacccagatgttaacagcgcaaaagcaaggaaaaaataaagcttacgttcgcgcaactatcaactatctcggttttttgcgaagatatgctgctaatcccgatgcccaaagcagtccgttccattacccgctcacctattattacgaaaatcgtcaatatcccgatgctgatgctgcttacgctaatgttgttttaacgcaatcactaatacctttggcaaaacaagcacatccagatgtatcgacaattcatcagcaaacattctggcagacacttttccgcggcgcattgggtggctggctgacagcgttgttgctcatcaccattctgcttgcgaatgatctgctgaccagcgagcaacgtcatcgcagtattgcgcgttctttgccacttagtccgtggcatgccatcaataccaaaacgctgacggtacttggtaccctcgccggggcagtcaccctgctaattggtgtgactgctgtatgtgtcatccccttccatggtcttggttcactaaccacagccatcagtaactttgccaaaaacgggtcttacgcttatgtccagccactggcacttggttctgctttactcatgatgcttggtttgactgtactgctcatgtggctgttcattcgacttaacttgctttgccaattgctctttcacaacgaattgatcggactggttctcagcgtcctactgctctttggcgaaccgctctatttcatgcaaggtttagccttctccgtaccccaaacagcctactatctgcctagttacatgaatccagcagccatcgtcaacggcctacaaaatttcagatacgataccggccaaatgacaccgctatctggggtcatcgtgattggcagtgtcattgtcctgctagaaatcatgctgttcatcgtgacacatcgccgacatgctgcgacggttaaatagagcgtgagctggcgcggttagaaaccagcgtgatgcgtacgcattttacaggagggtacatcatggaattgcaactgcaaaatcttgcattaagttttaaaaacaaacccaacgtcattcacgacatcagcctcaccatgaatggcggatcaatcgtcggaattgtcgcccccaatggtaccggcaaaactaccttgctgcgcttgattctcaatgatctaaaaccacaagcaggcaaagtgctggtagatggtaaaaggctaggagtctatttttattttcttacttgttgcacttcaattgtaaattcgtcatacaaaaagccgcgaatcatgcaatctaaactaattgcacgattcgtggctttttctttgttttgcaagaagcgacatataaataaatcgtcactgaacaaaatttaatcaaaacaatttttcgttttttaagaaagccagcaaacgcaaccttcaatcaaagaatacttattgaccacatacatttaagtccatagactgaccttaggcttagagagaggactaattaccctgttttcttcgtctagcggattggatggcacacacccctcaacattcttgagacgcggaggtgagagccatgccaaaactaggagacgaaaggggttcgccgcgctggatgtggcgtcaattatcatcgcgctaagcatactggttaccagtatcgccaaagcgtatgcgataatcaaaaaagctaaccgcaaggattagcttttacccaaatagtcatctgaaccgcgttgaggtcatcgggccgccacccgatggcctcttttcaacgacttaattatacacaagatgctaacaaggcgtcaacatacttactttaatgaagttatatgtgaacaatgctgatcttggtcacacgattatttcaccgaaatttgctttttagcatcaacggacactcggatctgcttagtaaacttttcaatcgcagccggtgcctgttgtttttccttcgcgacaagatcaacgatggcgctgccgatgatgacaccatcggcgatgcctgccattgtttgtgcttgttcaggcgtgtgaatgccgaaaccgatagcggttggaacgttggtatactgcttaatttctgcgactaatgcctttaagccagcaaagaattcatcgcgttcgccagtaatgcccattgaggaaacgacatagataaatcctgaggcacttttggcgattttttcaattcgatgaccggaagttggcgtgattaacggaataatatcgataccgtatttttcggcaattggcacaatttcatcgcgactttcatacggcagatctgggatcaccaagccggcgacatttaaacccgcacagcgttttaagaaggcttcgtagccgtatttgaagacaatgttcaagtaagttaggaagacgattggcaccgcggtttctttgcgggcagcttcaacaatgtcaaagaccgttttggtgcgaacgttggcggcgaatgctcttaggtcggcggcttgaatcacgggaccgtcggcgactggatcggaaaaagggatgcctaactccacaatatcggcgccacctttggcaagtgcgaccacgtttttgacggtggtttcaaaatcgggatcatcagcgacgatgaaggggataaagactttatgatttttaaaaacatctgctaacttactcatcaacatcgactcctttgtatttggcaatgcttgcgacgtccttatcgccaagtccggacaaggtacagataatgatttgatcttttgccatctgtggggcaatcttttcaacgtaggcgatggcgtgacagctttcaatggcggcaacaatgccttcttgtttcgcaatgtaggtaaaggcttcaactgcttcgtcgtcggtaatgccaacgtattgcgcccggccttcctgagcgagagcggcatgctcggggccaacgccggggtaatcaaggccggcagaaatggaatataccggatcaatctggccatcttcattttgcatgaataaggacttcatgccgtggaaaatgccaacggagccgcgttcgatagttgcggcggttctgtcggtatcaacgcctttaccggctgcttcaacgccgactaattgaacagaaagatcatcaatataagcggcaaaacttccaatggcgttactgccaccacctacacaggcaacgaccatgtctggcagccgagcttctttggcctgaagttgctgtttcgattccgttgaaatgacactttgaaaatgtttcaccatttcggggaacggcgccgggccgactgcggaacctagcacgtagaaagtgtcatcactgcgactcgtccattcttgcagtgtggcgttaaccgcgtcttttaaaaccattgatccgcttgtgactggatgaacctttgcgccgagaagttccatgcgataaacgtttaacttttggcggtcagtgtcttctttacccatgaaaatttcacagtccatccccatgagtgcggcaatggtggcggtagcgacaccatgttgaccggcgccggtttcggcaatcaggcgctttttgcctaaatgtttggcaagcaaggcctgaccgatgacattattgatcttatgtgcaccagtatgatttagatcttctcgttttaagtagattttggcgccaccaaggtcttcggtcatgttcttggcataataaagcaacgaggggcgattggcgtaattaaccaataaatcatttaattctgccttaaattcaggattatcttttaagtcattgaaagccttagtgactttttcaagctcggtcatgagggtttcaggaatatactggccgccaaagtcttttccataacgaccggcgcgtgttggctgttgggttgtttcatttagtgtcttcatagatggcttcctcttttgcttgttgaatgaattgggtgattttatcagcatctttatggccgttggtttcaaccccgctggagacgtcgaccatcgtgggctgaacgagttgaaccgcttggcgcacattcagtggcgttagaccgccagccaaaatgaggggtcggctgatgtgggggatagcttttaagttaagtagttgcccgctgcctttgccgctatcgaccattaaataatcagccattgaggttagatcaatggcctggcgttcaaagacctggatcacttttaaaccggcttgttgaagttgcgtgatttcggctggggtgcttttcccatgaagctgtgcaacatcaatggcacctgcttgatagatagccagaatttcggcgactgactcgttgacgaaaacaccaacggtcttgatcttggaatgaagcaactgttttagggataatgcttgctcaagtgatacttgatgccgcccgggagcaaagacaaagccggcaaagtcagccccagcagtattgactgccaaaatatcttccgaatgcatgagaccacagattttaacgagtaccattttgggaacctccttaaccgcgccagttcacactctttcttaaacgcgatcactgccgcagaaacctccacataaggaccttggtcgcaatgaccaaaatgcggtcatcacgtccaaggccgcttatgttccggtttctaaccgcgccagttcacgctctttccttgaacgccgctattaattgttttttctggttggatcgcatgagtgtttcaccgatgagaatggcattgaagccagctgctgccagtttttcaacgtcttcctgcgtcttaatgccgctttctgcaacgacggggatgttgtcgggcaccatggctcttaatttcaaactattgttgaaatcaactcgaaagtctttgagattccggttgttaatgccgattatctttgcacctgactgtagtgcccgtgtgacctcagcggctgtataggcctcgacaattgcgtgcataccgagtttttcagccagttggcgataatcgcgcaattgctgatcggttaggatcgcaacaatcagtaaaataatgacagccccgtttgccttagcctcgtagatcatataaggatcaatcgtaaaatcttttcgaagcgttggcaccgacacttgttggctgatctcctttagataatgaaggtggtcgttgaaataatcgggttcgttcaagaccgagatagcatcggcaccggcttgatcgtacgctttggcgatcgccaagtagggaaaatctgtgacaattgtcccctttgatggcgaggcctttttgacctcagcgatcacgtgtaagccaggttgttttaagcgtgttagaaaatccggtttgggattgcgcggcatcttatccacggtttgttttaaatcagcgaatggttgttggcgttgatgacgtgctaaacgaattttggtcacagctaccagatcatctaagatcatgccaccacgtccttacgcttgtcggagaaagcaagtaggcgattgagttcttcaaaggctttgccatcgtcgatcgttttagcggctaaatcaatccctgcttgaatggataatgctggatgagccacgtgaagcgctgcaccggcattcaacaacacgatgtcgcgttgcggtccgtgatcgccggctaaaatacgccgggtaatgtcggcgttggcctcgggtgtaccgccaaccagatcagcccgctgactacgtttcaaaccaaattgctcaggtttcactgtgtatttcgttaagtgaccatcatgcaattcaaccactgcggtttcatcggcggtggtcatctcatcaagaccatcgcggccgtgaacgaccatcgcgttggtgacgccgagctttttcaagacattggctaatggttcgagcaacgcctcatcataaaccccaagcaattggcgagtggggtgcgctggattcgccagtggcccgaggatgttgaaaatggtgcggaagccaagttgctttctaacaggggcaacgtacttcattgatttgtgatattcctgtgcgaatagaaaggccaaattgttttcttgcaggctttcataactgacagcaggtgtttcattgatgtccagccctaaagcctcaagaacatcggcggcaccgcttttcgatgaagcggcgcgattaccatgtttagccacttgggtaccagttgccgcgacgacaatcgcgctggttgtggaaatgttgaacgtgttggcatgatcaccaccagtaccaacaatttcaagcacatctttggtttcgggaaaagcaagcgcgtggcttctcatggaagcagctgcaccggcgatttcatcaatcgttgggttcttggcagttaacgccgtcagtaagctggcagtttgcacctcagatgcttcaccgttcatgatttcatccaaaacggcttcgctttcttcaaacgttaggttttcgtggttcacgactttttcaatggcttgtttaatcatgatgaatgcctccaaattgtgttttgacagggattgttgtgagttttaagtgattgaaagctatgataaaaatcgccatcgtttaatctcgtttgtctgagccatacccaaaacctccttcgataacgcgttcgctggcgcagaaacctgcgtgtaaggacctgaatcgcaatgatcaaagaccgaccatcacgcttcaagccgcttacactccgtttcctaagcacgccggctcacgctcacaaaaaaatccgcccataactttgaaaagttaaggacggattttccgcggtgccaccttagttcgattaattcgagacttcaacaaataatagcagctaggagtctatttttattttcttacttgttgcacttcaattgtaaattcgtcaatcaaaaaaacttattttgattcgtttctactatgtttagcaagtatagctccaatgttaatcgtgggtagaagtaaaggcgtatattcgttagccattccagtaagttgagacacaattgctctgatgtacggaaataggattgctgatccattaacctgcaccaaattctttagtccgactccggtcttatcttcaactttaacgtatgaaaaagaacctgtaattgttacctcgactaaaaaaggaaaatcatcagggactttaaaatttaaagtaagctctgctttatctgtatcttcatggataatagtgtgagcttcaaactcaggatgataagttacttttcttttattttcaaaatcactaaatttagaattgcgtgagtagctcatactatctactcgataaccatcaaattttaaaactgccattatgctgccaatgcctcctgaacatgggattcattgtcaaaattggcatcgcatgttgcgatttcagcatacatacgttcatttttcagagcatagctttgctgattatcatcacgaatcaatgttggggattcatcaaaactatagcccatctgtttagccatattcttcagttcatcgcgtgagaataactttttgaactgttcagtggacaccacgggcatcaaccgatctgcttcagattgtttcatacgattcacctcctcaaataatattaacacaacgagaccgctttgattatatttaaatctctaatacaaatttccctagagtttggaaagttgctttcttttgcaaactctggaagtcgtgtatatgtatcacaaatgacggcttgccaattgttccatatttttctctggataagcttttcgattaaaattccatcctcattgtcacgcttggaagcattgctagatacgacattgccatattcagaatgaattaatcgagcaaaattatttcgcgtttttataaaattatttcggatagtcggatcatttaaattgcatatgttctttttagcatccgtaatattcagatttaatttgagcgttccaatacgcacattcttatatttatgtccggcatattgtgtagcaaggtacttgggactttcaagcccacagtctttcccatcaataaaaccgtatacacctttgccaaggtcactagtccattttgggtagtgatctttatcaaagccgtttatacaaatggtttttgcagaatcgtattttgtcccatgaaacgcaatcagcacggaatcttccccttaaattgtcatcgaaaataatataccattttttgtgttaactgtcacataattgcaaatagtaataaacaaaaacggccaaaagcacgtttctttttctaaacaggtgttataatgaaacggattttaagcagctaaaatttgacccgtctgattaaatatcttttatcatggcgcaaaaatgcctcctaccagcaatggcgggaggcttatttttgtgcataaaaagctaaatttaaccaaaatatggaaagaaaatggaacacacatattcaaaagctattaggtcaatagatgcaacgattgagtgggataaatcaataactagaattgacacgaaaatagtgatataaaggcgttttggatttgtggaaataggttcaaactccgccaactccactaaaaaaataagatgctccgccaaaactccgccagaatttggcgaaggactgttggtaaagttcataagaaagtcgctaagggttcgataccactagcgacttttttgcgtatatagggtgtctcgttggcaaattaaacctgttataataaaagcaatatagagcgtcatagattgagttaaaaataaacttgacagatacggagatatactaatcatgagaccagaccagaccagaccagaccagaccagaccagaaaataattttgatagtttaattgcccaaattgacgaaagtgctaacggcgtacaacgtgatcgcggcacgatgtttgaagaagttgttaagtcctacctactgaacgaaccagcatataagaatctgtacgatgatgtgtggctattaagtgaagttcccgccgaatatcatattcctaagaaagaccttggcgttgatcttgtggcgcggcatcgtgattcgggcgagttaaccgccgtacaggctaagtattatcgcggaaaagttggcaaggacaccattaatagctacgttgctgaactaaacaagaattactatgcagacggcctattagtggccaccacggatgactggaacaagaacgccgaagctaccttagatgatggttctaaggatattaaccgcattggcttgtctgacctcaagcattctagctttgactgggcgcaattcagttttggtaatgctgaaaaggcaatcactgccagtcataaacaaccacgggcttaccaaaaagaggcaatcgcgaaaacggtggcctattttgatgatcatgaacgcggtaaattgattatggctcccgggactgggaagacgttcactagtctcaagattgcggaggctatggccacacgcgaacagaaacaagcctattttgtgctgtatctggtgccaagcattcagttgttgtcgcagactttgtttagctggaacagtgacgtaacgccaaccacgaaccttatttcgttcgccgttacttctgaccgaaacgcgtctaagaagcgaacatatagcaatgacgaagacaccgacatcaacattcaagatattggtttccctgcctcaaccaatgccgataagttgatgaaaaacttcaaggcactcaccccaactaacggccaacggattaccgtgattttcagcacttaccagtcgattgatgtcattcaccaagcccaagcacttgggtaccccgaatttgatttaattatcgcagatgaagcccaccgcacgactggctcacacgcggctaatgaagaagctggtattttcaccaaggtacataataacaagattgtacaggcgcgccaccggctctatcaaaccgcgaccccgaagatttactcccaagatacgaagaaaaagggtcaagaagaaaatatcgtgattgcgtccatggatgacgtagatatgtacggcgatgaaatcttccggctcggttttggtgatgccgtagctaagggcattctgactgactacaaggtagaagtattagccgtggatgaggccgtgattcagcgtgacttgcaaaacagtcttgccaccgaaaacggcttgaacattgatgatattggtaaaatcattggcgtctggaatgcgatgatgaagcgcgaaagcttctcgaataagactgttggcattccaatgcaacgagccatcgcgtttgcctccgtgattgataatcagcgcggccacggtgcgggaaaagttggttctaaacagattgcacaagagttcagccatgtcgtcaacgagtatctggggacggataactcgaataactttcacgttgatgtaaagcacgttgacgggagtatgaatgccttacagaagaaagacgccattgattggttggcagccgatttaccagatgatgaggcacgggtactatctaacgttaagttcttaaccgaaggcattgacgttcctaatttggacgccattattttctttgccccgaaacagtcccagattgacattgtgcaagcggttggccggattatgcgcaagtacaaagataaggaatacggctatattattctgccggtagtcgttccgtccggccaagaccccgacaccgtgttagacgataacaagacctaccaagcggtttggcaagtattgaacgccctccgctcaattgatgaacgttttgaagcttcggttaacaaacttgacctgaataagaaaaagccacgcaacttgaacgtgattggtgttggcggcgcaccggatgatggctttgaccgttctaacaaacacaccggggacagccacggcgctgaacaaaccgaattggaactaaactggcatgaaattcaagatgccatctacggccggattgtcaaaaaagtgggcgatcgccgttacctagaagactggacggctgatgttcaggcactggcggaacggcatattcgatggattcagaacctgattgcgaataaacagtcaccgttcgccaaatcgtttaagcgctacgtgaagagtttgcaacataatatcaatagtgatattgatgaccagcaagcaatcgagatgctggcgcaacacgtgattaccaagcccattttcgaagcgctgttcgaccagtatagtttcgtcaacgacaatccggtttcccgcgcaatggaagacatgattaagcagatgaccaaggctggctttgaccaagaacaagcggccttggaacccttctatgaatcggtccggatgcgggcaactggaatcgacaatgcggcggctaagcaacaatttatcgttacgctatatgataagttctttagtaccggttttagtgccaccgccgaaaagctgggaatcgtcttcacgccggtggaaatcgtggacttcatcgtgaagtccgtagatgaggtgctgaaagaacactttggccgcgggcttgatgcggagaacgtgcacgtcttagacccatttaccgggacaggaacgtttattgcgcgcacccttgaatacctgaatcaggagatgcaggccggggagattacactggccgacattacccgcaagtacacgcaagaattacacgccaatgagattgtgctgctcagttactatatcgcggccattaacattgaatccgtttttgatgagatcaacggtcccgaagactacatcccgtttgatggtattgtgctggcagacaccttcgcctccacggaaaacaattcagtgcttgatgaagatatgtttgggggcaataacaagcgcctgcaaaaacagcaggaggtgccgattaccgcgattatcagtaacccaccgtattctgttggacaacggaaccagaatgacgataatcagaatgtacattatgaaaggctagaaaaacggattgcagatacgtatgtaaaggatagtaattcggggtatagtaaatcttcatatgattcatacgtaaaggcattccgttggtctggagaccttttaggcgaacaaggtgtcatcggatttgtaacaaatggtagtttcctaaattctggctcaacggatgggttacgaaaatcactctaccaagaattcaactacctgtatatttacaacctacgtggcaaccagcggacatcaggtgaaacatcccgtaaagaaggtggaaaaatcttcggttcaggtagtcgggcaccgattgccatttctattttggtcaaggatggttccagtgaacaccacctgtattacaaagacattggcaactacctctctcgtcagcagaagtttgacgcaatttcaagtgccacatcggtgaatggcattgattggacagagataacacccgatgacaataatgactggttaaatcagcgcgataagaattaccggacatatattcccttagccgatgaaccacataacgccggtgtctttccaaaaaatgcgttaggtattgttactaatcgtgacgcatgggtgtatggcttcagcaagcaaggcaccgccaaaaagacgagcttgctgattgaccactataacgctgaacgcgagcggattaagaagactggcgctgatatgaaccgtgacccacagtatattaagtggacgcgtaaactggaacgtcttgctcacaatgacgaagcaattacttttgacaccaataaaattcgacttggattgtatcgaccattcactaaaaagtggttgtactatgattacgctctgaatgaagaaacccgtctgtactacaagcaatttggcgccagcaatgaagtcatcttcaccactggccgtggggcttcaaaagatttttcagcgttggcgaccgatctgattccaaacatggactgtctcgaaaaagcgcaaggattcatgcgctacaataacgaggaaaataattcggttgagaacattcttgccccagaccgcgataacgtttccgctgagtttgcggctaggttgggcctgaccaccgatgaaacatacgcgtatgtttatggtttgctcaactcaccggagtaccaacagaagtatgcgaatgatcttaagaaggatttggctcggattccagtggttaagtatgtgcgcaagtatgtggatgttggtcaacaactgcttgatctgcacattaattatgaggacgtcgaaccatatgctgattgtaagataaccatgcatgcagataagccaagctatcgagttcagaaaatgcggtttaagtcacgcgctgatcacagtgtgattaagttcaattcagatattacgattgcggatattcctgaacgggcttatgactatgttgttaatgggcgttcggcaattgaatggattatggatcagtatcaaatcaaaactgataaggcctcacaaattatcgatgacccaaacgaatacagtgacgacccacagtatattttcaagttgctattacgagtagtgacggtttcccttaaaacactagacttgattggcacgcttccccagtttgaagtggttgaataaggtgaccgacttatgaaatcacaaataaggatagcgaaagaagcacgtaaaaaagcttttgaacctgttatgaggaaaatatttgagctgtgcagtgatagaatcaacaggagaatagacttaattttacgcaccgtagatgataccaatgaaacccaaaatcataatgaaaaagatgcccgagccagtctaaaatataaaattatcgagaataaggaaggtaaactggctggcggactggatgaggatgtggttagccatattattgacggaaagtgtgaacctagaagaaatctgtatttgttccctaccaagagcgcgaaggaatactatgccgcttttcggggaattctctggtttgatggagtttatgagatcctctgggggacggtcactgaaatcactacctatttaccgattatttttcagatgctttgtaacgcagaaatagaagagcaagacaatttgccatctaattctaagaaaaacaacaagttgactgatatacggcaggtacttagtaactttgagggcaatggcacggatgagcagattaatcatgcgtacaaaaaagtctcgaatcttttctttttggaatggatgaaatttacgacgcttcgtagcgatgaacgtaaatttacaattgctgacggttctcctaatccaactgttgtgactccgaaaaccattaaaactagaattgatgatacagaagaaaaccaatacagaggattttaccagctgaatattaggttaagtgaatttgcgaataaccagctttatcaagttttaacacaagggattatggaatcgctttgaacatatgcaatgctcaggaagcttattcagaaattgaataggctttttgctgtctcttctagtctatatttgtcaacagcgatggttttaagttcgcttgatttacaccgcggttcatctttaacgagtaagggagcaaactacatttatcgggcgcccgataaaataaattattaggagatgcacttatgaagttagcacaaggaagattatcagaggttgaaattgcaaatgtagaaacgccaaaggtagcacggatagtatctatttctaaaagtccacgatacggggaaaacggtgaaccaattccgaactctgttgcaaaagtagtttgtcagtttattgatacagatttggcaaaaatcgttgagaaagcgggtggagatgcttcacagttgaaagcctttgtgcttgagttagtcggtgatgaaaccgacctagtagatatttcggaatccgaactcctgggttcggagattcaacttacagatgccaaggttatgcttaagtgggctactggtcgcaacggtggtggttggcgcgatttgaaattggtaatgaatatttcgaatggtgatagtaaggcggcgaaaagataatgaatgacaaaaagagcttgagtatctgggcgtacctgaatgaaattgaatattgtttagaaaaaactgatgacgctagcctagaacgtgcgaggaggttagtacgtgtaacgcgagaaattctggaagaaaggcgcaagggcgactttgaagaaggttttctaaatggtaacaatgattgagtggttgagccggttattgccgacttcaaaaggtgttgctgtgttaactatcaacgacagcattgtgaacaccgataagagaagaaggagagctataaaaggcctgtttaaattatggacaggggtctgcattattttggaagtgggcagagtgagtcaaaagattgtaacgcgtacattcgaatctttgataagtatttccaaaacttcttttgccgtatactccagtggaatcatgttagctgttttcacagttcttgcatggcgatattttcatagtgagtattcgccgcttgaacgttggcagctagaactactactgcgaagattttcagaaaccaccgatttattgggtcggccggataatgaagtaaagcaaacacaaagtattcggtgggagtatcaagttatgaagcataagacaatagtcaaactctttactggaggacacgtgagccttgaaaatgagcatgatattggcagacgactactggctttcttgagtaaggaaactacacgacattgggaaatgattactgttgagtatgatactgggaaagttcagttacacttcacacatgaatcagaacagcggattattgtggatcgactgaacgttatgccaagaagtgaatcattaaacattccacttagtagccgtttttcatggactgatagacaaccaatggggctaatcgttggccccacaggatctgggaaaacaagtctgttaaagtctataatcattggctttctggcgaacgcccaaaacaatgaggtgtacaccatcgatggaaaggctgcgtttcttagctttgcaatgtctagaattggcaaggttgccactgatggagaaggagctattcgactgacagaagagctttgcgaggtgatgaaaaacaggtacagcgaaatgaatgcggattatgattctgaaaaggatcaggtttatgttgaaatgtttcatcaaggcacaattctactggttgcggatgaattgttatctttagtagcgacaatgcaggcagaggacaaggaagtaaaacctgcagatcgtctttatccaaagttgtacaagaacctactttctctgatagtgaagggccgtcaagctagtatatctgtgattatcagtggtcagatgatgccggcgtccatattgccaacagaggctcgcagtagtctggggatgcgtataagccttggaaggacatccccacaacaggcacaggaagtatttggggtaagcaatagagaattgccgtcggttgatgctgaacattatggcggactgatctggttggatggacttaactgggatggcccaaaagcctttctgccacctatgtatgatgataaagcattgccttttaaagctactttgacaaagcttgcagcatcacgcggcggtggtggaacgccacaagacgcgggaggaggcgagcacttgcctgttacttgacatacaggcaagataagctgaatctgtacatgttaaaaacttataatgcaaaatatgtgaggtttgaggatcacattgaagttattcggtatggtgagttaaaaacgcatttaagcggtgaagagcatgagaacaagcgtataacgggtcagattactgaaccggagcgaaagcagcaactcactgaacaggcatttcggattaagaggaaggttaagtattatctacaagcaaaccaatttacattattttggacacttacatttaatgaccaaaaggtgaacgcaaaaaattacgtgtattctcgcaaacggctacaggcatggctaaaataccagcgtgaaaagttcggcaagtttgcgtatctgtttattccggagttgcatcctgaatctggacgaattcattttcatggtgttacgggaggcttggatccacccctaacggtagctaggtatccgaagagcggaagaagaatcgtaaagaacggagttcaaatatttaacgccaacaattggcaaaatggatttagtactgttagtgctattcaagacaagaacaaggctgcaagttatattgcaaagtacgttacaaaagaattgatgctgctaccgactgcataccatcagccaagatattttgtgagtagagggctaaaacggcctacagtatcttatcggaaaatttctgaggaagacttagcaatgttcaaaccaaagtttgtggtaggacatgtgtcgtcagatacaaagcactttgaaagtgatatctcaatatatcggattgatatttctgcagatggtgagttactacagaacgctccagtagaaacggcttggaaactaagaaacagtgaaagggggacaaacatggatgcagataaataataatactgtgacgaaaaaagaactgacggaacttggttatcgagagaatacagcagtggaaatcattagacaagcaaagcggagcatggtacaacagggatatgaattttacactaatcggcgccttggtcgggtaccgattgaagcagtcgaggcaattattggggcatcccttcgaaaggatgcagacaacaatggcaaagactaagttttcaggggtgtatagtggccaagatggctacttttactacgatattcaattaggggttgatacgaacacaggtaaacgaattcggaaaaaagggaaaaaggatgccgacgggttgctgttcaaatctgcaactgctgcccataaagaggttgtaaggttaaaggcagagtatgatcgtgatagtgggcatacggtgtacgcgttaacctatggaacatttttgcgtcagatgtatattccagcttatcaaacgagtgttcaaccagccacgtttgatacccgtaagacggcgcttagtctgtttatcgctagatttggcgaaacagaacttcgaaaaattgatgtccgaatggttcaggaattcaaaaactggctgttaagcgatgccgggtatgcacaaagctatgctagtttagtcttcggtatgtttcgtaaaacattggattttgcggttgaaatgaattacctaccaagcaatgtctcgaaaagagtgaaggccattccaaaggggcgtgctactgtcccgtattggactaaagatgaatttcagcaagtgctgaatcaaatatgtattgttgactattacgaacatttgaatttcgtaatgttgtattgctactttatgactggcgttagagtcaatgaaggaatggctctacagtggtcagacgttgattttatgcatgcgcgattacgagtaactcacatgttggtcataaaaagtaagagtgattgggaacggcataattacaccaagactgatagtggactacggacaatatctttggataaagacactgtgaaaattttgcgagcttggaaaaagcggcaaaagcaaaacgggttcggaaattctgacgattttatatttagctatgatggtgcaccgatgcttaaatcaaccttaatgcgaattattcaacgatatgcgaagttagcgaatgttcatccgatccagggcaaaggccttcgtcatagccatgcaagctacttgattaacgaatttaatgtttcagtactcatcttgtcaaaacgactggggcattcatccccggaaatcacgcttcgacattatgcgcatttgtatgtgggcgctgatagggagcttgcacaaatgatgtcagggcacatatctttctcgacgcctgccgaatcacaagtaaactttaacggcaatcaggccgttgctccgctgaaactccgcccggaaagagtgaatgcacgagaacgttagtatatcaacgattgtgactgaccattacaattgagtgggaatagaaggtacatgtaaattgaacccgagatgttgatttaacggtattttcgggagatataaaggatacgattggcaggaaatgtgtacgctcctcgccaaaatccccgccaagtctgacctgttgagggttaaattgacggggatttttgtatgaaaatttcagtttactataggcaacgatgtttaatcatatgagtgaacgttgttgtgtgaatttgggacactgtgttgtatactttaaatacctatatatcagcacttattagctggtccgtcccacaatgtataacttcacattatatgggacaggagaggagaaaacatggcaacgtctttatttacgcttataacccaattggcaaatgcacactttacagatgacaatgcaagctttgaatctgtattactttctattattcgagttgtttctgctgatacggctaaaattgcgcaaaaaaatgcacttgaaatggctcgactactaaatggatgtaagctgattcctgagacaacttttaagagagggtataatgaataaatctagacggcggtgtcaccgagctagaaggtgttgatggtttagacggcggtgtcactgaactagaaggtgttgatggtttagacggcggtgtcaccgagctagaaggtacagacggtttggaactggaagctgatgatggcttcgacggtggtgtcattgaactggaagattcagaagatggcgtcgacggcgttaccggtggcggcgtcaggttctcgtcataggccttgaccgtcacttgcggtttatcaagggtaatggtaaaccgcaagtgagtcgcattcagcttgtatcctttaggtgcctttgtttcgacaaaatagtattggccgactaagagttgagtaaaggttaacttgcccttcgtatcagtcgtgaggtcgtcgtgtaccaaggttccatcggcacggtagagtgagaaaacagcgccggcgagagcctgctgatgtgttttctggtcttgtttaattagcgtgacctgtccaacttggccggtgccactaccgccgttacgccaagtaattgtgccgtttgcttgcgctggagcaccggtaccgccttgcttgcctgaagcaacgactgaattcgtccaagaatctgtggtttcgaaacttgcagaggtgggattagtccacaaatcaatttggatggcggttgtgatcgttcccagcgatattttgacttggttaccattcacttgatagcttggggtgatggtaccggtagcatggaaccagttgtcatcgtaagtaccagtgtggacgaccagcccacgacttgtatcaaaatgctgcccgggaccaagtataccagtgagcaccacattgtcgacatgctccatatttggattaatcgtaatctcccactggaaaattttgggtcgaccaaggtcatcaacatactgcgctttttcttctggagttgcacctgttggcggattgacaacccacccggctttgtagatataccatcctggacgttgatgaccactatcatcatagcggccacttaccatgaattgaagctcaccttggcggccgactgttgaatggctgaagaagtccgtgaaggtcaaaatgccggatgaactacctgctttggaaaagaaatggccaatcgtggcgccagttgtgggatcaaccactgcaaagtccacatcggctcgcgatacaaccgttgctggcagggaaactgtcgcagtatcaccggccttgacgaccacttcgtcaggaattcgccagtgataggttaaggtgtacacgctatacatcgaaagattggtgcgtgggtgaaatctttcccagtggtgtcagtaatcgtagcatcttgactaccaaaaccggtgaccgcgatattctggccagcaccgacactgatcggcttgcttatgagcggtgggattaaggcaaccagaactgacaacaacaaggtgataagtaaaaagactgaagcacgcttttgtgagtggcggcgcttttgcatctcggcacttccttagtcataatttaacaaaataattataacataaggatatttattcggattaacaaatataatgaatatttccttgcttagcaaggaaatttttgtgagataatacttacaaaaataacgaaacaatgacgcttagcttatttggttaaaggaatcaaataactggtgaaatgtttgacgtcttgtacggcttatgtttgaattaatttaatgatgcggttattcgtcatcatgttggggagggatcaagttgcgaaggtggcttgttattgcagtatcagtgatggctatgatcggtgtaactggttgtcagtcaaaaagttcaaagtcgtctagctcgactgggtcgacgatgattaaggtgaaccattttaccaagcagactttgcagaaacagtatacgaccatttctgacttggtgatgaaaacgatgacagaggtctcactgcaaagtgataacaaaactctcagtcagtcggctaaagccagtctctctaaacttgataagatccggctggaattggataataacaagtcacaggattcaggggacgatgccttggcaaagacattggttgattatgccaagcaatcaagtgacgtgttgacagccgttattaacaatgatggaaaaggctatcagtcaagcgctcaagctttctttaagcaggccgtcagtattggtcaacagtctttcggcggtcaagttccggaatccgtgcgcaactatgcgaacaatcagcaagcggtgacaaatagcggaagctcgaagtaacaatcaagttacataggatcgcaaaaggcagttgatgactgccttttttgttacacagcgtcaggcgacctgaaacgtaagactttttcaaatcgacggggttgtgataggtgatggcgcgctgatttgttaggttggacgtgaggaggcgatcgtttggcaccctatcaagatgatttgaatactttgctggccaagttgcaggcaattgcacagacgggtaactattacgcaaaggatgtttttgatcagcagcgttatacagaactggctgacgtgacgactaagctggcaataaagcttggtgccagtgaccagcaagcaaagctgtttgtcgatgcggattttggctatgtgacgcccaaagttgatgttcgtgcggttacctttattgacgatcaactattgctggttcaggaacgagcgggcggtgcatggtccatccccggtggtttggcggatttgggttatagtgcgggtgaaattgctgtaaaagaaacccgtgaagaggccggcttaaccgtgaaaccgcaacaattactggcagttcgggcactacgtaagcacgcctatgccaagcaaagttcgcaagatgtgtacaaaatgttcattgcttgtctaccggagaatcgtgcgttaaaaagcgggatcgaaactgcaaaggttcaactttttacgcgagaacaagcgcttcaggtgcccttattgctacaacgcaatttgccggccgacattgagatggcatttgacgcacatacggctagtcactggatggcaaagtttgattgagtttaaaaagatactactttgatagccaagtaaagggcatggcaacagaaaagagtttatttcccagtgatgaacacggaaataaactctttttgatttggccgatgactggttactttaatagaaggaaggtttatcgccttgggtgttaggttggtcaacgccaagtgaagcaccgatgtgtttgcttggatcgttaatcagcttgacgacgaagtcagcgatgctgcgccgggagacttctgtgcccttaaatggctcgcctttttccgttaattcataactgacaatgtttttattggaaagccaagctggccgaatgatcgtatattttaagtcagaattttcaatgactttggcggctgcggcgtaggtttcaagataaccaccatcaagcatttgatgattccacttgccaaaagcgcccgggacttcatcgtaaatttccaacgtcgaaatccaaatcaatcgactcacacctgcagcatccatcgctttcacgacggattttgcctgatcttcaattcccttgttgccaaggttggcatagacaacgtcaatgccagcaagcgccttggtcaacttggcggtgtcggtgacatccccgtcaatcaccgtctcccgttgcggattgacgtcttgcagccgcccggcattgcgtagaaacaaactcaggtgatgatcggtttctttcagcaactgatgccgcgccaacgttgcaatttgcccgtgtgcgcctaagatcatgacatttgccatttgaatcttcctttcttgttcccaatacagctttattgtaacaccggtatttgtgggcggaacgatcaaaaaagcccgcgaatttcttcgcgggcttccttctggtcaagtgctgtccggtgttgttggcccgggcatatggtttatcttgtcatcaaagcaattaacgaaacttcgacagagggtgagctttgccgaaacattgggggaatgataaacccctgtgaccagaagtgatgctattttgcgctgttcgttgcttgatcctgaattttttcaagttgttggtattggctggtcatccaagtccgatagtttttgcccttaggtaatgtctcggtcactttcaaaaccggcacattattttgttcagctaatttgacgagttgattgacagtctttgagcttgcttggatgttattgacaaagaaggcaattttcttttccttaatatcggtttcgataccatggatatcttttgcgctgtagtctgtgccgtcttcggttgacttcgagaagtgatcgtcattgactttgtagcccagataatcgagcgcgtagccaaagacaggttcggagacatcaacgagttggccatttactttcgacttcaacttgttgatcaaagtattgagatcgtccagtgaagcgatgtatttttttgcattcgccttgaaggtcgctttgtcggctggatctttcttggcaaacttatcagctaaggtattggccagttttggcatggttcgcggatcgtaccagatatgctcgttgtcgccttcctttttattcatcaaatcgtcagcgacacgtaagtaatttttggatttgtccgccgacttcacgaccttatccatccagccgtcgtaaccaatgccactggcgacaacaagatcggcagacgcaactgatttcccaactttggtagtaggctcatagtcatggggatcaacagccggattgttgataatcgactgcaccgacaccttgttaccacccacagctttggcaacctcaccataaaaatcaagactggcaacaacttgaatcttgctgccattcgagctggattgctttgcggcaccgttactaccgcatgcgactgcaaaaattgccagcaatgcgacactgatacctgcaagtaatcgcttcatcataaattcccgcttccttccaaaacgtaataattacgatttaaaccataaagcaaagtgagcggtctggcaaggaaaattttcaaaaaaattgagaaaagtgtcgttcttaaattctaattgacagataaatcgcagtcgtgatacggttactgccgttgcttaaatagtaatgattacgaattaaaaagaggtgatcatttttggaaaagacagatcttgccagtgcacggcggcgtatgaagagtcccaacattaagacccgaaaacgggcgttaaaagttttgcacgatgctaagcgtaagcaacagaaaaatcggtaatgtatcaataattggtggtcatttgaatactttgagtgactcgtttgcgggagagtaaagaccatcagtgaaggaaagaggcattcttttggcaaaaaaatctaaaattgcaaaagcaaaacgacaagaaaaacttgttcaacaatacgcggcaaaacgcgctgcattaaaagcgaaaggtgactatattggtctaagcaaactcccacgtgattcaagcccagttcgtttacatcatcgtgacgttttggatgggcgaccgcatgcttatatgcggaagtttggcatgtcccggcttaatttccgtgaactcgcccataaaggtcaaattcctggggtgcggaaagccagttggtgaaacctgaagccaccggcgatgaattcgttttgtgttttttatttcctcatgtttgctaactcacaagcaattatcatgccttttgcctgaagatgacgttatacttaaaatgtatgaagttagcgcttacataacataagcaaagtggctttgcttatgttcgtcggacagaaaagacgtttgcaaggaggaaaaacacaatggctgaattgcagtcaacgcactatcagatgtatatcaatggcaagttcatggattcggcatcaggcgatgttgaaaccgtgatcgatccttccacaggcaagaaattgtggacggcaccggcagcgacaattgaggaagcccgcgcagccgtggatgctgcttggacggctaagaatgcttggcggcgcgtgcctgctccaacgcgtggtgcgtacttgcgcaagcttgctactttagtgcgtgagcatgaagatgaactggtgaagattttgatgttggagcaaggaaaaattcatgccttagcgaaaatcgaaattgagttttcggcggattattttgactatatggccaacgccgcacgcgtttattccggcgatgtgatgcaatctgacaatgaaaacgaaaatattatcattgcccgtcagccaatcggtgttgcggttggtattattgcttggaacttcccgttcttcctgattgctcggaaaatggggccagctttggtaaccggcaataccatcgtgatcaaaccaagttcggacaccccaggactggcgttggcatttgcaaaactggttgatgaagtcggtttgccggcaggggtagccaactttgtgagtggtcgcgggtccatcattggggatgatttggcgaagagccccaaagtcggcattatcagcctgactgggtccaccgcgtccggtaagaaggtcatggcagctgcggcgaatcatgtggcaaagatgtcattggaacttggcgggaaggcaccggcaattgttgctaaggatgctgatatcgatttagctgtgcaggccatttttgactcgcgaattgataacaatgggcaaatttgtaacaacgctgaacggatttatgtgcaagaagatgttgctgatgagtttattaagaaaatgacggccaagatggcggcggtgaaagtcggtaatccgaacactgattcagatgccgaaatgggtccgttgatcaatcaaggcgcccttgataaagtggacggtttggttcagcgagcggttgaagcaggcggccagattcaaacaggtggtcacccagctgacattgacggtggtttcttctacgaaccaactgtgattaccaatgtcgcgcaggattcagagattgtgcaaaatgagatcttcgaaccggtgttaccgattttgacattcaagagcattccagaagcaatcgaaatggcgaatgacacggtatatggcctgaccagctccgtttatacgcgtgatctggaaaccgcttcgtatgttgctaacgagattgagtttggcgagacctacattaaccgattcaattttgaaggtatccaaggcttcaatgctggttggaaacaatctggtgtcggaggcgccgatggtattcacggtgttgaagaatttaccaacacacatgtcatttatttacagcgtcacccagaaaacttaaaataactaggcgacaaccagaggaccatgagcaagcatttatctcgatcatggttctcttttttgatgatgtttagtgcttgttcatgaatgcgattacatgcttttgtatatcgcgattgtcgagaagtaagccatttaagcattagattcgggatagtcactggttcatgttctttagtttttttaagttcgccttaaaaaacacttgatagcatttgaaattttctgtaagcttaagatgaaagcgaattaggtcaccctaaaaattggaggctcttatgttaacagttaaggacttgaccgttgcctacgctgacacaccggtgtttgctgatgttgccgttcattttaacgcaggtaagatcaccggaatcattgggcctaacggagcaggtaaatcgaccttgatcaaagctattttgggatcgatcaaggtacaatcaggaacggtcgacttttccggccggacactcaaagaggtacagcagtcaatcgcttatgtcgagcaacgtaaagatcttgatctgacgtttccgatcaatgttcaagatcttgtgctgactgggacatatggccgattgggcttactgaaaagtcctggcaaaaaggaacgacaggcggcgcttgacgccctgacccaagtcggtcttgaggattttaagaaacgtcagatcagccagttatcaggtggtcaattgcaacgcgttttcgttgcgcgggcgattgtgcaacatgcggaaattatcatcatggacgaaccgtttgtggggatcgacatgaaaagtgaacaagagatcatgacgattttgaatcagtggcgcgatgccggtaaaacgctgattgtggtccatcatgatctgaataaagtttcaaaatattttgacgaacttgtggtcatgaaccacggcattgttgcggaaggaccggtcaaagaagtttacaccgcccaaaatatcgaacgggcattttcagccgacctgtcgtccgtcttgtttacggcaaaggagggtgcgcgcgtatgacatcaataatggaattctttaccgctttgggaaaatatgatttcctgcaaagcgcgttgatcaccgccatcatggttggtatcatgtcaggcttgattggaagtttcatcattttacgcggcatgtcgctgatgggggatgcgatttcccatgcggtcctgcccggggtagccgttgcttatatgctcggtattaacgtcatgatcggggcatcggttttcggaattattgcggctttgctgatcgggtttgtggcagccaacagtaaaatcaaaaccgacacatctatcggggtcgtgttcagtgcgttctatgccttgggtttcattctgatttcaatggctgaaagtgcgaccaacttgcaccatattttgttcggtaacattttagccgtcagcgacagcgacattgtcaccaccgctgtcgtgttgggaattgtgatcctgttcgtggttctgttctataaggaactgctgatcacctcgtttgataatacgtttgcgaaaacgtatggcttgaataccaccatgattcactatgctttgatgctggtgttgacgcttgtcaccgtttcagccttgcagacagttgggatcattctagttgtggcgatgctgattacgccagcagcaattgccttcttgtggacggatcggttagaaacgatgctgatcacgtccgctagcgtaggcgttttctcggccatcaccggactttacttcagtttcacctttaactgggcatccgggccggccattgtgctcgtagctgcggtcctgttcgccatttccttcgtcttctcaccgaagcaggcgttcttcagtttcagtaaaaaacaacgagaaaagaaaaccgctgctgctacccacactgccgaggaggctgttcgatgaaaaagattctaatcagtgttgttgctgttttaaccatggttgcaggggttttctggtttgtaaacaaccgcagtacgactcagaaagattcagcaagtactaaccaacaattacgtgtcgtcaccaccaactcgattcttgaagacatggtgcacaatgtcggcggtgatcgcattgaactctatagtatcgtcaagcgcggcaccgacccgcacgaatatgaaccgcgaccgaccgacgttgctgccactagtgaagccgatgttgtcttccacaatggcctcaaccttgaaactggcggaaatggttggttcaaaaagttagttcaaacatcgcataaagcttttaacaaagacgtttttgctgccagtgacggggttaatccgatgtacctgacgaccaatacgaaggaaaaagacccgcacgcttggcttgatctggccaacgggattcaatacgtgaaaaccatcaccaagatgttgaagcaaaaagatgccaagaatgccaattattaccagatgaatgcagatcaatacgttgctaagctgcaaaaactgcatcaaaccgcccaatctcagttccttgatattccggaacgccagcggttgctcgttacatcagaaggcgccttcaagtatttctctaaggcttatcacgtcaccccggcctacatctgggaaattaacaccgaagcccaaggtacgcctgagcagatgcagacggttttagcaaaaattcgcgcctccgatgttaagcatttgtttgtcgaaagttctgtttcaccgaagtccatgaacaaagttgctaaagaaaccggcctatcgattcacgccaaaatctttactgactctttggcagcaaaaggcaccaaaggcgatacgtactacagcatgatgaaatggaacctagataagattcacgacggtttggcggaataatcgcgaccaagacgctcggttgaaccattaaaaaaacgttacctttgccgaaaatggtaaaggtaacgtttttttatggctgactcgtagccttctctgactgcaaacccattgttgcattattcgccgtgtcgcttgccgcgagccacgtggtcggcatgggcgagcatagcatcgatgacggtgatgatatgcggatcatcgaggcggtagaaattggctttacccacccgtttggcgctcaccagctggtgctttcgcaacaaggcaagctggtgggaaacaaccggctgttccaaacctaacaagtcaccaatggtaccgacattcagttcccgttgttcgagcagttttaacatctgtaggcgaatcggattgctcaataacttaaaaatgcgttccgcctcagtcaatttagctgtcgtgaccagttctaaagtgtctgtgtccatgtgaccgaaacctccattagttaagcgtcatcaccgtgtcccaatcccgtttgcaacgcttcccagccctcactagccacaaaataaaccaagactaaagcagcgacagaatccgcccaccaccagttaaacaaccaagtcagcaaactgccaagcagaacagttgcggccatataagcacaggtgatgttgcacatgccatcttcaatcagcgcgggagaggttaacttttctcccaagtgccgctttttaatggtcaaaacaggcatcaggaacacggaagcaattgcgattgccatgccgctgtaacttgtatcagctgcgtcatgtgtaaccccattatagccggaaacgccaatgacataaagactgagtaataataaaacactgccgacaatgagactggaacgttgctctgcttgagcaacctccgcagatggcgcaccattggcttcttttttaagacgccaaatgagggcactgccagaaataatttcaagaaaactatcgaggccaaacgcaattaagagaatggaacctgcttgcataccggaccaaaaaccgactatgaactcaaatgccatccatgccgttgaaaaatattcaacccgtaaggctgacgtcatggtttgtttctgcgtcattgacagttgctgcattaaacgaccctctttcatgtgactgttcatctaagcacagacacatgatatattcaacatatgtacatgtcaacatataacgccgatcaatgactccatgaaaggtcttgcagcaacttcttaacaaactagtgctggtgggcgtgttgttgacttgactggggccgataagcggtaactaacccggtcacagcgtccaaagtcataatcagacccattaaccacatcgctgccatattgtgcatggtaccaattagaatcagcaacaccacatttaacgccagcatgagccagcccattgttttcgacatttgttgcatgaaaatcctcctcaagtgtatggataagacctataccatttttcgctactactttagattaattctaaattatgtttatggcaaccctaaaaagtgttaaaattcttgtcagagggggaaatcacgatgaaaacctatacggactatttctttgatgagccagcgtttgatctccacgatggcgggtacgtgccgcttgaggtcagtgatgcgcctgagaagcccttaaatgcgccgccgttgttgaaaccggataaagagacagcgaccgacgtttattacacggtgacagcaaaggctggggaaacgcaactgttaccaggggcgaagaccaagacgtggggctataataccagtctgttaggtcagacgattgtgtatcgccgtggtcagcatacgcatgtgacactgaaaaacaccttgcctgagttgaccacttttcattggcatggggctaatgtcagtggcccttatgttgatggcggatgccatgcgccggtttatccgggtgaaagtaagcatatcgacttcacattggaacaaccggcgacgactttgtggctgcacgcgcatccgtgcccatccacagccgagcaggtttggcatggtttggctgccatggtgattgtcaaagacgaccatgaagccagcctgccattgccaaggaactatggcgttgacgatattccggtcattttgcaagaccggcgttttcacgagaacaaccagtgggactaccgggctgattatgatcctgacggtgttgctgggccaaccgcaatgattaacggtacgatcaatccttattttgacgtcaccacgcaaaagatccggttgcgttttctggatggtgctaatcgccgtgaatggcggttgcatttttccgatgacctgccatttacgcaaattggcggggatggctcattgttaccggagccggtcaaattcacccatctgatgctgacttgtgctgagcgtgccgaagtgattgttgattttggtcaataccatgaaggcgacgaggttaccttatatacggatgatgtgccattgctaaagttccgcattcatgcgttcaaaccggatcagacgaccttgcctgataagttgttcgatgtgaaggcaccagtggttgacccggctttgccagttcgccatgttgtgatgcaggggatggacgaaggtgttgcgattgacggtaaaaagttcgccatgcagcggattgatgccacgcagccaattggcaaagcccagtactgggatgttaccaatagcaatgatgcgcctggaatggttcatccattccatgtgcatggaacccaattcttagtcttgtcgcggaatgggcatgcgccgtatccaaatgaacatggtttcaaagataccgttggcgtgaatcctggtgaaacggttcggctgctagttcgctttgatttgccaggggtttatatgtatcactgccatatcattgagcacgaagatggcggcatgatggcacagattgaaactttcgatccagccaagccaaagcaagaatataaattgatggatatggatacgttaatgatggccttggctaaagaacgtggcgtcaaaccatctgagatttggatgggcggtatgcagtcttatgaaaaaatgggaatgaaaatgtaaacgtcccacaatactaatatagaaaaagatgattttaatatgcactctccaacgatcaaacatcgcggggcttttgtcgccacgttactgacaggtaccttttcgatgtcaatttcgcagtcttctttaagcaccgcttatcctgcttttatgaaagcttttggtttaggagcggatacagttgcttggctgacgaccggctttatgttggtgatgaccttgatgattccggttagtccatggctgttgcataatgtacctttccaacggcttttccaagcgattgaactcatttttgccattgggacaggcttatgtatctgggcaccgagttttaccgtgctcatgattggccggttgcttgaagcgattgcggtcgggattattttcccgagtttccagaccgtgttgctgacaattacgccgcatagtgagcgtggtcggatgatgggcacggcgggattggtcatgggctcagccttggcagtcggtccgattatttccggtgttttgctgacatggttcccttggcaggctttattcttgttcttcttggtcgtttcgctgcttgtgctagccgtttcaacggtgaccattgcgtctgtcatgccattgcaaccgacgcaactggactgggtctccttccttttatccgcaagttttccaattctactttatgccttgggtgctttgtcgaaaaaaggcttaactgttggcgtggttggtttgttgattttaggcgttctggcagctggtattttcgttgttcggcaattgaatcgccaaccaccaatgttgcaaatgcgagtttttgccactggtatgtttactaaagcggtgtttctgaccggaatttcatacgtcggtttgattgtcaccactatcctgatgccgctttactttcaaacgctgcttggtttgtcaccgttgatttctggcttgtccttagtgccagctgcggtgttgctgagtattttgaatccaattagcgggcgcctactggatcgctttggaccgcgtgtcgtggccatgattggcatgttgttgattactggtggctttggtctgttagcagtctttgcccatcatttaccgctgattggggcaattatgttggcgatggcgactgaagccggcaatgcctttgtgatgatgccttcagtgacggcaggcgcgaatgctttgccgaatgagctcgtggcagacggcactgcggttacaacgacggctcggcagttgtttgggtctgccggtgtcatgttcgccacagtgttgttggatggcgtgcaaaccacgctgcgaagtcatgctggcggttttgcggttaccttcgctgtatttgctggcgtgggcctgattggcttgctgttggcgttaacgttaccaaaggaagtcgcgaagaaagcggtatagctgcgaattcgtgctttgcatctaaaaaaatgaccgcctactaaaaagtagacggtcatttttgttgcaactaagcatgcttgactgggtacttagccgcaaatgatcaggagagaagcatcgcgactaggaaaggagggtaacacggttgctttagtcaacaaagaccagttcgatagtttcatcttctggtttgatgttgacagataaatgacgattaaggtcggccaccagtttgcgtgcgaaggccatcttctcgtcgaattcggtcatgtgcgaagtaaacgggacgctttggtaattaaagttttcgccgatatagcccggatcagtcacgtagcgcaagttgttttcgtcgtggcgactgcccggtttcaggacggtatccaaatactgatagagaatcgttggatcgtagttcagcggcttatcaagggtcgtggaaagcttgtagccggttgcttgaccagcgaattgttcgttgatttggacttgggtaaggctttgatacaatttcaaaacgatcactcctcttcttttcacttttagtatagcagttatgatgatatttaaaagagaaatattaggtaagcctgaaataatttttagtgatgtgactaagcagaattcgggactgctcaactgataatgcctttatttaaaagaaaaaaggtattcaaaaagcctgacagcttgagtgatggtcgatctggctatcaggccttctaaatacgcataaggtttgttagggaaaccttacttatagtattaccatgattaatccaaaattggaagaaaaaatttagggtggccaaacattatccttgtgttttggttactgaccgaaaggcaccatggccgcgcatacgctgacggcggatccgaatgattttgtcaatttcggtcacaatgagaatgattgagccggcaagtatcgccagtccccattcacgccaagacatcggtgcggtttggaaaatgtcttgcataaacggcacataggtcaggaagcattgcaatgctagcatgatcccaatgatgacaaaggccatgggattactgaacaggttctttgagagtgccaatgtattggtgcgaatgttaaacagatagaaaattttacctaaaacaatcatgttaaccatcatggtacttgccgttgtgcgatcggttagatgatttgcggtcaaccagtcaaacgcccacaagccgatgcctgcaattaacatggcaacataagcaatttggaaaacatcgtgtttatgcatcatcgcggcgttcttcttacgtggtggtcgatccatggtgccggcttccgcaggttcgaaaatgaaggcaaattggatcgtaatagcactgaccatgttgatccacaggagttgactggcacgcaatggcatttcttgttgcgtcagaatggtgaacacgatgaccaagccttcagcaaatgaagtcggcagcaggaacagaatactctttttgatattctggtaaatccgccgcccttgcgcgatggcagtttccatgcgagcaaagcgatcatcggtcagtaccatatccgctgcatccttggcaacatcagtaccagactggcccatagcaacgccgacatcggcttttttaagggctggcgcatcattgacaccatcaccgaccattgccgtgacattgcctgcttcttgcagcacagagacgatagtcagcttgtctttaggggtcgttcgggcaaaaacatcagcattaagaatcaattgtcgacgtttttcatctgataggcccgccaattgcgcaccggtgaccgcttctggggaatcagccagtccgagttttttggcaatcgcgatggcagtttctggatgatcaccagtaatcattttcaccttcacgccagcgcggcgcatttgcttgatggccgtgatgacagactcacgcggcgggtcgataatcgcggtgatgccgagaaaatcaagtccttcgctgagcagttcaggggtaatttcggttgtggcgtttggcactaccttttcggcaactgcaatgacccgttggccttggacactgaactggctggtgagcttcaagtagcgaccctgatcaaagtcagcatgtgctgcagcaactaacggaagaattttatccggcgatcctttaacaaacagtctcgtacgaccatcggcacatttagctaacttcgccatgtaccggttgttggaatcaaatggcatcagatcgcgctcggtgttcgccggttcctgtttgaaagccttgtagtaggcagtcagaaacgagccatctgtgggttcgccgttaatgacataacgaccatcttcttggtgcaattccgtgtcgttggcttcaaatccagcagtcagtaatgctgttaaatcggcatgtgcagctggatcaatcacttttccagccattgaaaagtcaccagtcggcgcataaccggtaccgctgacattgtaggttgcttgcggtgtcacgatggtggtaatcgtcatctcgtttttggtgagtgtgccagttttgtcggtacagatgacatcaactgagccaagcgtttcagcagctggcaaggttttcacaatgacatgctgctttttgaccatgttggacacgcccatggccaatatgaccgaggtggtggctggcaagccttctggcatagagccgacgaccatcgtgacaatggccaaggcgaggacgggcaaactgtatttgccaatgacgaggccgaaaatgaacagcagcacggcagcggcaatgatcgcataggagatgcctttgccaatgccgtcaatttcacgcatcatcggtgaacggcctttgcggacatccgataccgcttgggaaattttaccgaattcggtttgatgaccagtggcaaccacgatgccgatgccactgccaccagcaacggcagtggaggcgaacgcaatattgctttggtcagctaatggcgtgtcagctggcaatgttgcggtggttttgatgacggaattggcttctccagtgaggacagcttcctgaatggtgagattatcaatatcaactaagcgcaaatcagccgggacattatcgcctgcttcaaggaagacgacatcaccgaccacaagattggcactagggatatcaagccgttcaccgtcacggtaaaccgtggcttcaggagccagcattttcttgattttttccaaggaatcgctggcgttactttcctgatagtagccgatgatggcattgatgataatgaccaaaacgataactgaggtatcggtcacatcacctatcacggttgtcaaaatcgcggcaatgatcaggatatagatgatcagattgttaaactgacgcagaaaaattagccattttggcgttggatgcgactcgattgagttcggtccatttgccttcaggcgtttagcggcttcttctttagaaaggccgtggtcaagggacgggacctgcaacgattgctgcaggtccttgatactgtgtgcagacgcaggtggttgcgagtcaggaacttcttccatgcatgattcctcatttcataatataaattttttgttgctaactatataatatggtatgcctaaaccggttgcaaacaatttgttaatggcggttatggggacactagtatttgcagaaaagttgaaaaacctgatgggtcgataaattttccgaaaagacgtttgaacatcctcacactagtgactttttaacaataacggcaattctgagtaataacttgtatggctatattcacaatttttcctttaaaaacacaaattattttcataaaacggttgacgatatatcagtacaggcatatcctaagaaaggattaagttagggagacctaaaaggccttgttccccagggacttaacttttttcaaacgaaaggggagagttattgtgagtgatgatcacaagaagcgccatccaattaagctcattcaatacgcgaatgggccgtcattggaagaaattaacggtactgttgaggtgccgcacgggaaagggttttggcgcacgctttttgcttattccgggccaggggcgttggttgccgttggttacatggatcccgggaattggtcaacgtccatcacaggtgggcaaaactttcagtacttactgatttccgttatcctgatgtcaagtttgattgcgatgctattgcaatacatggcagctaaacttggcattgttagccaaatggaccttgcacaggctatccgcgcacggacgtcgaagaagttagggattgtgctgtggatcctgactgagttggccattatggcgactgatatcgctgaagttatcggtgctgccattgcgctttatctgttgttccacattccactagtcatcgccgttctggtaacggtgcttgatgtgctggtgctgctgctgttgaccaagatcgggttccgaaagatcgaagccattgttgttgctcttattcttgtcattttactggtcttcgtttatcaggttgctttgtccgatccgaacatgggtgctttgctgaagggattcattccaaccggtgaaacatttgctagttcaccttcgattaacggcatgagtcctatccaaggtgcacttggcattattggtgcgacggttatgccgcataacctttatctgcacagtgccatttcgcaaacgcggaaaattgatcacaagaacccggatgatgtggcactggctgttaagttctcagcatgggattctaacattcagctgtcattcgcctttgttgttaactgcttgctgttggttatgggggtcgcagtcttcaagagtggtgccgttaaagatccatcattcttcggcttgttccaagctttgtcagattcttcaactttaagtaatggtgttttaattgccgttgctaaatctggtattctgtcaattctgttcgcggttgcgttattggcatcaggtcaaaactccaccatcaccggtaccttaacaggtcaggtcatcatggaaggctttgtccatatgaaaatgcctctgtgggcacgacggttggttacccggattatttccgtcattccagttatcgtctgtgttatgttgacggctagagaaacgccaattcagcaacatgaggcgttaaataccttgatgaacaattcacaggtctttctagcgtttgcgttaccattctcaatgttgccactgttgatgttcacaaacagtaaagtcgaaatgggcgatcggttcaagaacactggttgggtcaaagtgctcggttggatttccgttctcggcttgactggactgaaccttaaaggcctgccagattcaatcgccggattcttcggcgatcatccaacggctacacaaaccaacatggccaacatcattgccattgttctgatcgtagccatcctcgcgctactcgcttggacgatctgggatctgtataagggcaatcaacgttatgaagcacatcttgcagctgtagccgatgaaaaagaggcgaaggcagatgttgacgaacaatgatttgtttgaatctttggccatgagttgcgatgggatcgaggaatctgtggggtacgatccttggctattcgctattcttgggttagatcatatgcaatctaagacggccacgcattcaaccaaataatcattatcgttgtcagttttcctagtaaagccgctttgatcatctgtttgttgatcaaagcggcttttttaagtataagccggtgcacgttatgacagaaagcataggagctaaagtttcatagtctcatgaataggtaaacaatatagaaagcgagtgatgggatggcacagggagaagaaacaagcatgtcaacacagttattagaaacgccagccatgttgtcgcaacatgcaacggatttgctgatcagtcttatgtatgctgatcgtgtgggttctcaggcaagcggcagcaagaagcgtctgtcgtttcgcggcgggcggcagttttttgaagattttggccaattagcaggtattggcagtcgaacaatcatgaagcgcgctagattggaactacaggtttctggcgctttattggccgatcgccatcgaactcataagcattatcaactggcaaatgatccatggacgcttttcaagcaatataacggtctaatgacatcgccaattctagcaacccgcacatacactactgatgagtttgagcagttgctgaaaatcagcggtgacttcagtgaaaactttcctttggaggcggctggcaccgttctaattaaggcagcgatatttggcagtaaccaaccgttgatttatgctgtctcacaggctgcatatgatcgtttactgaaggcggaattaaccctaaaaattgccaatagcaagcatcgtgtcgatgatagtcgcgcagtcatcattcaaacatggtcagttgatccggctacggtgagtcatcggctacatggtggtatatcgacaccacaggcagatccgatccatctctacttgtcattactgaccactggttctatcaaagctcaaaccgaagcggcacaacttgtcgaaacaatattgcactaaacggcgattaaccgtgctgggtggctttttgttttacttgagttgtttaaccgtcggagaattcgtgtaaaataggtctatgcaaataggcatgttggttgaatttttctgatggtgatgacggaggtaaacatgagcaaatatcgaacagaaacggacacattaggaccagttgaaattccggcaaacgctttgtggggaccgcaaacagagcgcagccggcataattttcaggctggtccattgatgccgatgccagtgattagggccttgctgcaactcaaaaaagcggcagcgcgagcaaatgtggccgctgatgttttaccggcaccaaaaggccaattaatcacgcgagcagtcgatgccttgttggccttgccagacgaaaaactgcaaaaagattttccactgcatgtctatcaaaccgggtctggcacacaaacaaatatgaatgtgaacgaagtcattagccaccaagctgcaaaactcaaccccgacttgccgatcctaccgaatgatgatgtgaatcacagtcaaagctccaatgatacttttccaactgtgatgaatattacggcggctattgcagtgaatcagttgctgcaggctgtcaaccaactgtgcagtgttttatattcaaaagccgtcacttacgctcgtgttgttaaaatcggtcgaactcatttacaggatgcaacgccgctaacgtttggccaagaaatcagcggatgggtggccatgatggagcatgatcagattgctttaaagcagcttcagcccaatcttttttacttagccattggcggaacagcagtcggaacggggcttaacgctgaccctaattttggcaagattgtggcaggccgattgagcgatgtttatcaattaccactttcggcgaaaaccaataagtttgctgctttagcggcacactcagaaattagcgttgttcatggtgccattaaaacgctagcggctgatctgcttaaaatcgccaatgacattcgcttccttgccagtggtccacgtgctggatacggcgagttgcgcattccggccaatgagcctggtagttccatcatgccgggcaaagtgaatcccacacaggccgaagcgctaaccatggccgctgttcgagtcatgggcaacgatacgacgatcacggtggccgcgtcacaaggcaattttgaattgaacgtctacaagccggttatcatcagtacctttttagagtcggctgatctactaacaaaaacagtcacgagtttcactgaaaaattagctgccggcttgaccatccacgcaccgcatatgagagcactcgttgatcattcactcatgctggtcaccgccctcgcaccccacatcggctacgaaaaaagtgccgccatcgcgcaattggctgagcaagaaaacctcgatctaaaagcagccgcaataaaaagcggcgacgtcacagcagcgcagtttgataaatgggtcgacccgttaaaaatgacaagagcgtgagctggcgcggttagctcggcgtagcgaagtggcagtgacacagatggtctgggctttggaccatctgtgtcactgtccttcgcatagcttcaggcaccatcgcgtaagttgaagacggcaagaaaaaagccgagctttttacagctcgactcgcacgatgatttgaaatgctagattaatcttgagtcacgttgcttgatgtcacagactgcgcagttgttagcggaacaccttttgccccaccggaaatactttcgatgaaatcgaggaaggtcggcgcaatgccaagttcttcaagatcagcaggggcgatctggtaacggatcgccttttcgtcatggtctaagaccttctgaacccagtgcggctcgcaaatcatttcgtgaccaatggcgaccaagtcaaaggaatctgccgctttctcagcatcggctggcgttttcagaccaccaaccacaatcactggaaaagcaccggcgacatggtcacgaatttgttcattcatgatggctgtgtcctcagggttgcgcaatgaggttcgccaaacgtcactttgggagacgtgcaggtaatcaatcttggtttgtttcaaagcgtcgattaaggccaaggtatcatccaaggtaatgccaggctgttccaactcttccggcgaaatgcggtagcctaacaaaaatggccggtcagcaattgtggcaatcactttttctgcttcatgaacgactgccaacggaaaacgcatccgcttatcgcggtcaccgccccattcatcggttcggcgattagagtttggcgaatagaattgctgtatcagataggtgttggcaccatgcagttcgatgccatcaaaaccagcaaggatggcgcggcgcacagcttgaccaaaatcgtgaatagtggcctcgatttctgccgatgtcaatgcgcgcggtgtttcgtaacccgcccgtggcgaagcaaccgcactggcactgactggctgctcaccgcgcagaatcttgctattgctcatgcggccagcgctgaagatttgcaaaatagccttggtgccgcctgttttcatcgcagcggcgagtttgctcaaaccggggatgaatcgatcatcagcgacacttagctcaccttcgaatcctttgccaagcgcattgacattggcggtaccggtaataaacatgccgacgccaccggcccgttgctggtaatacgtgatttcgtcccgcgtcacagtgccgtcttcaaacgacaggcgcgttgtcatcggcggaatgacaatgcgatttttcaacgtgatggtttggtgcttgaaggtgaacggttttaaaaaatgataacccgacatgcaatcacactcctttagacgaaaattaacgttcttgcgtgactggccgtaagagcacttcattgatggcaacattggccggttgatcaatggcatacaaaactgccttggcaacatccgaggcgctgaggccattgtttttttcatcggcttcaacagcttcacggcgcttaggatcggtaattgtgctgaaaagctcagtattcacggcaccgggcgagatcatggtcgttttaatatgattagccgcttgttcttgtcgcaggccgtccatgatcgcctggatagcccacttggtaccggagtaaacggcggttccagggtgaacaatgtgaccggcaactgagtctgttgtgataatttggccactgtgttgggcaatcataggcggtaaaaccgaggcgatcccatacaagacgcctttaatgttgacgtcaatcatacgttcccattcgttgactttgagttcggccatttcagaaagtggcatcaggccagcgttgttatacaaaacatccacatgaccaaacttatccaacgccaaatcaatcagcgctttcacttgctgctggtcggtcacatcggtttgctgataaagcacctggccgtccgtaaagctggccgccaattcggccaaccgttctgtgcgccgcgcaccgatgactagttttgcaccagcctgagccagcacttgtaccgttgccgcgccaatcccgctcgatgcacctgtgattacaaccactttatctttaactgtcaaaatcacggcctcctttatgggcttatcctgctaagaaaaaataagtaacagaaacagcttaacctaccgcgcagctcagcaccatgcaagctgttttattgaaattctaatattggattgacctcaagtagactttaggggctacacttgacttgtcgtcagtaacataatttgaaaagacgtatcgaagggagttttgtgtttatgaaacaagttcgattaggcggatccaattggcaggcgtcaagtgtggccttgggcatcatgcggatgaatgtgctggcccccgacaaagcggccaatgtgctggatagtgcatacaatgacggcatcaactttatcgactcagccgacatttatggtcaaggtaaatccgaggaagtctttggcgaagctttgaagcaggctaacgtttcccgcgatcagttattcattcagtcgaaaatcgggattgtcgttgatccaaaacgctctcatggcagtttgatatttggcaaacggtacgacttttcaaaagatcacttactgtcagcggttgatcacattttgaaacggttgcaggttgattaccttgattcggtcttgctgcaccggccagatccgttaatggaagtcgatgacgttgcggcggcctttgatgcattggaacaaagcggcaaggttcggcattttggtgtctccaactttaaccctgaacaaattgcgttgcttgaaagcggcattcggcagcctttgctgatcgaccaagttcagttctccgttgcgcacactggtatggtcaatgcggggatgcacaccaacatggccgacgaggcttctgtcgatcatgacggcagcctgctaccatacttgcaacgcaaacacatgaccttacaagcctggtcgccattccaatacggcatgtttgaaggtaccttcatcgatagcccgaagtttaaggcgttgaatgatgaactgcagaaagtcgctgaccactaccataccaataaaaatgcaatcgcagtcgcttggctattacgccattcagtcggtgtgcaagtgattctcggctctatgaatcctgaacatatcaaggaaagtgcggaaggcgcggacatcacgttgacccgacaggagtggtatgatatttactttgcggcggggaatgacttgccgtaagttgtgacaaaaagtcgtctcgaattgttgaggcgattttttatattggctggtaaagctagccttgcatgttgtataaatgagcctgaggtcgattagcgacaacaattttttgtatctggccggctgtctaaaaacaccgattttgacgttatagattcagcttaatattttgatcgaaaaaagattgcacctgatgtcttaatttttctggttcgccgtcagttttagcgacttcaatcgctaaattgccaagatcaagttgaaattgatcatcggttggaagtgctgcgttgtttctttttaagaagagaattgtcgccatgaatgccgtccgcttattagcatcgttaaaaacgtgctttttgataagctttaaaaaatagaacgtagccaaactggctaaatcttgatacaacgcaattccaaaaacttcttgttgcgcagattgcacgatatcattaagcgcgttcgcatcttttaactgtggcgtccgttcttgttgtttttggacgacaacgttaatagcgatgatttgatcttcggacaaatatttcatcctatctatccttcaaataagccatgactgtgcgatattgtccgattaagccttgaatcgtatgaagcaattctttttcgtcttccgaattgtgaccattcaccacgcgcatttcgatatcaccgtcctgtttcaattcaaaccgaaccttcgtattctttttgatgccgctacgccgtctgatttcgacagggatggtgacctgacctttactcgtcacagtggcttccataaagtccctatcaatgattgacatggttttatctccttactttattcttacattgacgctaacatagaagtaaggaaaaagtaagactcatatgatactcgcactgaattggttgatttctcattgatgaaaacgaaaatctggtaaaattgagccatgaaagaaaggtggcgcaatgaatctagaagaaaagtttgctttcatggcaaccggtaagccatacgacgatatggatcctttgttactggctgtgcgggatgaagcaactgccaaaactgatgcacttaacaatgaacacgatccagccaaacgcaatgccttgtttaggaaattggtaggccaaactggcgtctaaccgtttatgaatccaaattttcactgtgagtttggtcggaatatccgcgtaggcaatcatttttatgccaattatgactgtaccattttggacggggcgccggtgaccattggcgatcacgttttatttggcccgaaagtcggtttgtacaccagcaaccatctttttgatccacttgaacgacaacttggtggctgcattgctaaaccgattgtagtcggggatggctgttggctcgctgccaatgtgacggtgctaccaggcgtcacgattggtgcggggacgattatcggagcaggtagtgttgtcacccacgacatcccagctcgcgtgattgcggcgggtaatccttgcgaagtgctgcgcgagatcacggctgctgataaaacagggtttgcagggcatgacatgatctaaacgccaaatcgatacttgaaaatggcaattaacaagcgcattctaacaatattcacaatgactaaagtgctctgagtgagcatgaattgccaagttaatcatcgaaaggaagtgcaggatgacagataaacgtgaaactttaatgtcgatgctaagcaaggcatacgctaacccaacgatcaaagcagagccggcattacgggcgcttatcgaaaccaacgccaaaaaggttgatgaaggtgatgacgataaggcttatgtgacggccgtcactcagttgtcccacgacatttccaaatactatctgattcatcacgccgtaccagaagagctggtggccgtcttcaattacatcaaaaaagatgtacctgctgccgatattgatgcagcacgttatcgcgcgcaagccttggccgctggcttagttgccattcccattgtttgggggcactagccgatgtagggctgtgaattttaaacggtgaggctaaagttgatgatcaatcagttatgatttgccaaaaacgtcgcagactaagatctgcggctatttttttgccatgaaacttgttgacaccagttaagaaaaaccgagtagcagatcgataaagagaaaatttggtcgatatttgacaaaaaagcgacgttaatcgggcaaaagcctacgtttaaaaaaagtttgcgttgtcgtgtgaactatccagtacagtgtgtgtgaaagcatccgcgagaaaaagtcgatgttcatctggacggggggatacaagttggcgatgacgttgaataaagcaattcattatcttttactgataggcatcagtggtgtctttctttttacgctggctgccgccatgggctgggtcaaccaaggtgactttgcgctgccactactgcttttggcggtaggactcacgttgtttcgggaaactgatgccggatatgaaaaagcgaggcattgaattgggtctgcttagaaggcagaaaaacgtgaagccgaatttctgtacacaaggacaaactgattttaaaatgtaatcggttacgatgactcatatctaaaagagttcaaatacaagacggtatcaagatccatcagtcgggctacaaagccattgttttccgatactttgcctaaaagctatagcatcgatacttttcaaacatttctatagaaaaattgtcacgacatcaaaggaaatggtgacatatcatgaacatgattcagcgggttctggtgcaaattttcctcgctgacttgattttagtatactgggtgccaagaaaagtcatcactttttatttcttaaagtgacaacttttaaggctattgtacgtagtggtggaaacctcttacgcagctaggtcgctatgaaggtgacacatggtggaaatgaacgaaccggccatcagtagattaccgattttctcttcgcggctggggatcaaaaccatgtaactggcctttaaattcatcaggattttgactgacataagtaccgcgggcccaactggcagcgacagtttcatcaactggttcatcgtgttcgctgtaatccagccccattttttcagcagcaggggagacccgaatgctgacgaattgtttgagaactacagtgattagactgaccatagcaccaactaagacgatcacgatggcggtgccgacaagctggattaggagcagctgccatccaccgccataagccaagccagcgtgcgcaatgtcgggggcgacctgtttgctggcgaacacaccagtcaaaatactgccgacaatcccagcgaccccatggcagccaaaggcgtctaaagtatcatcaatgcctagccgtggcttgattttgctgataaaccagtagcttgtcaacgttgccgcaacgccaatgcatgctgccccaaaactcgtgacatagccagtggccggagtgatcccgacaagcccacacaaggcgccggtacaagttccgatcagcgttggatggccggtttgccagatgtccagacacatccatgtgaccaacgccgcggcggcgccaaccgaagtcgttaatgctgccgtcatcgccgcttgattaacaccgagtgcagagccggcgttgaatccataccagccgatccataaaatggccgtgcctagaagcacccaaggccgattataaggtgtgatatgttcatccgtgcggcgacctagaaaggcggatagcgtcaaggcggtaatgccagcattgatgtggatcactgtgccgcctgcaaaatcaagcacacccagaccggccaataaaccgtgcggactccagatcaagtggacaagcgggtaataaaccagcaatgaccacaagacgataaaacaagttagaaacttaaaatgcatccgaccaacgacagcgccgacaaacaaggccggcgtgatgatggcaaacatcatttggaacagcacatacacgccggttggaattttcgccgtggtcaccgcgccaagcgaaagatcactcaaaaagaaatgatgaacctgaccgatgacgccgaaaagatcgccattaaaactgagctcatagccgacagcgacccaaagtaggatcgcaatcccggtgatgtagaaaaccgacagcatggtattaatcacgttgcgtttggaaaccagtccaccatagaaaaaagccagtcccggcgtcataaaccagactaatgtactcgcaataattacaaacccagtatcagctaaattcatctctgccacctcattaccattgatggcggtattgtagcatggcattttcaatagcatagcgattcggtcgatctattggcctagagcaaatctggtgctgaaaggagaaagactgctatcaaaggattttcgaagcggtaaaaaaactgaagacgcgttagcttatgtgacatgaaaacttgacgattttatggcaaacagaaaaatatgccattggtctatgcgaaaaattggtttttaaatgaatataagtgaaggcaatgtttggaaactggcgcaggcgccatgcaaaaacacagggaaaagcggctactgattgcgaccatgccaaacccaagatggaggtgtttggtagcgctcagtgtagcagttttccctgtgtctctaatcgagcaagttcattaaagttcgccgtctgctatttgaccgagcacagatttggacggaatgaagaacaattcgccagtttctggcgtcgaaaaatcaagcaaccgatcagaattgtcaaacatgccttgcaacatacgcttggtgaccgtccaatgacgggcatagccgatgaagtaggttccgttttcgtttttggccggattactgaacgggacattcatgcgcacaattttatgttcaacgccgccgtcattatcctgagaaaccacattgtgggcatttggcagcttcttttcgtcagctaactcaatatcgttgaacttctttcgaccgatggctttttcctggtcctccgtcgtcaaatcgttccatgctttcatattgtgttggtatttttgcgcaaaagcataggagccgttttcaaatgtgggatcttcatcgccgatcaccgcatactctggcgtgtcgagtgcgcttggattttccgtgccgtcgacaaagccaatgatcgctcggccttcgaaatagcggaagccatgggtttcatcgagtgtcacagtctgatcgtcaatgatggtcatgatctctgacatgagttcgaacggaacggctgaattctgcgagcgaatgtggaagaacagatcagctggggttgccactgcggtatattttggcccgacaactggttggaattcctccaactctttaggcaccggtgctgctgggaaaagataatcccaagcttttcgcgacaagccaaatgcaaccgccaattttgcatctgggtagcgaatgttcatgctattgatgaatgctggtaagtgctctgctaagtcggcaatcatggctttgtcggctgcggcatcttcgcgcttaaggtcaagcgtagcaaaaataatgtcagacccggcatccttatagacatcctgtacatcacgtaaatttatggtcatcgttacgcctccaaattagaatcattctaacctactatagtctaccatagcggtggctgattgcaacgatttcgcgatgtttttaacctaggcattcggtggtaaagtaagaacaaaggttgtgattgtttgatgatttcagtagcagatcaagccgaacttgtcattcgactggtggtggctgcactttgcggctttgccattggttatgaacgcaagaatcgcttcaaaaatgccggtatccgcacacatatgattgtggcgttgggtgcggccttgattatgattgtttcaaaatacggtttttttgatattttagatttgaaaaatatggcattggatccttcacgtgtcgcggctcagattgttagtggcgtcagctttttaggcgctggagccattttggttcgccacaataacgtgaatggtttaacgacagctgccggggtttggacgacagcggctgtggggatggcaattggggcgaagctgtacctcatcggcttggccgcaactgtcttagtgctttgcattcaagtcctgctccatcatcattatcgctggctgcccagcggtgataacggcattttgacaattcgggtccgcagcgaaggctttgacatggtgcatttacgcgaaacattaggcaagtaccatatcaaggtcctgaatgtgtccattaagcatgaaggcgacgaagttaaaatgaacctgcatgtagaaagtaaagcaaacgaagatatgcggcgcctgctgacgttttatgccgacaatccgaatattatttcgattgaattctaggcaatcgctaattaagttggctagtaccgtctgcatagttgagggtcacaccaggctgaacgttgaagatgtagacattaaaatgaatcgtgttgtcgccgatactttgcgcacgcatcgctacaccgcgtgagcagttcatcaccgcgaaagatcggggtcacttcataacgaataaaatgctggcgtgactgtttcaaataatgtgccatatcatcttcatgggcctgcatcaacggcgaatttaactgccgcgtcccagtcatcaaatttttcggattattattttcaccggaaagctgaaaaccaattaaatggctgcggttgtacagccattcgccatgcactttcttgttgtgccacccagttggattccaagtcagcggctcgcgcttggcagttggcatgatagcttgattcagtaaagcattggcagtaccagcacggttgagactatcgagattgctaaatgttgtccacgggcctttatcagtggcaagttctgctttcgtaaaaccaggctcgttattgttgacggtaatctcggcagtgttgttgtaattgagctgcgccagttgcgtgaccggttggcgcgaggtgccatccgttgccggcacactgttgctagctgaacttgattggggcggtgttcccagcagtgtggtgtgttgctgcgtgtaggtataaccgccgctggctaagccaaacaacagcaatgtcgtcgccaaccgtcgatttgcccgccgttgccgctttgtgccttttcgcagcaaaagtagcagcatgccagcgagaatgagactgaatgtgatgaggttattcatgttgcctccaaatagattagttccatatcaaccggaaactgggatcggataacgcgggtaaattgttctgaatagtctgaggatagcatattcttccaccatgtgagctggcgtctttcagttcgcttaataacaaaatacgccgatgctgaaccgattccttatttttatcaattatcgttggcccataatgtccttcgccaagtgactgaccatgttaagaattccaaaagccgaataatgcatttgtgaaacccccaaatatctgctaatatatgtagaaatcttttaagcgaggtataaaattgctcacagtaaacaatgtatcgatgacgttctccgaccgtaagctatacgaagacgttaatttgaaattcacgcccggtaattgctatggcattattggcgcaaacggcgcgggaaaatcgacttttcttaaaatcatccaaggtgaactgaccccaacgactgggacggtaagtttgtcgccgaatgagcggatgagcagtctgcgtcaggatcactttgcgttcgacaatcaaacggtgatgaacactgttttgcaaggttgggaacgactttatcaggtgatgacggaaaaagatgctttgtatgctaagccagacttctctgaagctgacgggaataaggcagccgagctggaaggcgagtttgccgaaatggatggctggaacgctgaaagcgacgcgtctcagctgttgcagtcattgggcattgcggaaagtgagcaccagaaactcatggctgatctgcctgaaggggagaaggtcaaggtgttgctcgctcaagcgttgtttggcaaacccgacgttctgctgctcgacgaaccaaccaacgggcttgatccgcaagcgattaactggcttgagaactttttagctgactatgaacacaccgttttggttgtctctcatgaccggcatttcctgaatgcggtctgcaccatgatgtgtgatgttgacttcggtaagatcgaactttatgtcggcaactacgatttctggaagcagagttctgaactggccttgcaactgcaaagccaagcgaatgccaaaaaagaagaacaaatcaagcaattgcaggaattcgtggcgcgtttctccgccaacgcttcaaagtccaagcaagccacttcacgtaaaaagcagcttgaaaaaattacgttagatgatattcggcctagcacacggaaatatccgtacatcaagttcgaaccagaacgcgaaatcggtaacgatttgttacgggtcgagaatgtttccaagacaattgatggtcatgaagtactgaaaaatgtcagcttcattttgcggccaggtgacaaaacagggatcatcagccgcaatgacgtgactgccactgtgctgatgcagctgctggcaggtgagcttaaacctgacaccggcaccgtcacatggggtgtcaccaccagccgtgccgctatgccaaaagacttgaatcctgaatttgatcatgatgatctgaacattctcgattggttgcggcagtttgcaccacaagacgaacaagataacacgttcttgcgtggcttcctcggtcggatgctcttttctggggatgaagtgctcaagcaactgaacgtcttgtctggtggcgaaaaggtccgttcatacttggccaaaatgatgctgagcaaggcaaacgtcctcatcatggacgatccaaccaaccatcttgatctggaaagcatcaccagtttgaacgatgccttgatcgacttcaaaggctcattaatcttcaccagtcatgaccatcagttcattcagaccattgctgatcatattatcgaggttgggccactcggtgttgttgaccgtgcggacacaagctatgatgaattcacgcaacacgaaaccgctcaggcacaggtagccgatatttatccggctgataaaaagaagtcaaaggcgtaattgctgatatcaccttgagcgttacaggttttgacatcatacgcagttactaaataggcgaacaattttccgcagttaaggaaattgttcgcctgtttgtttgctcatggataacttattggaatttataaagatcccagtgccaaggcggagcagtcgtaagccagatggggccgaagcgccgtctccgctctagctgcgcgtcgccagcccagttggccggagatcgctaagtttggcacggtagggattgttgcatagatcctttctgaattgtttgaattttagaattcttgctcatctctacttcaattttgtttttcaaacccatctgatagataatatcagcataagtaaccgacaagataagtgtgtgtgacccgcgcaagttgttattgaaagtctcaccaatctggtcacatcagctaagaaagcagtgatcaatatgtcacaacccattacgattcttctcagcgtcaccggctttattgttgcgatgattgtcctcaatggtttgttaacctggcagcgacagcaaaaactcaagcgccaattgctagctgactggggcacttttcctgaaaaacggccaaaaggtgagcgctatttaaaagccgcctatcttgatcacgaagcccaagttaatcatgattgccaagttgacgacctgacttggcaggatcttgatatgttagacgtgttcgaacagctgaacgtcacccaaagtagtgttggcgctgaacgggtttatgcacaattgcgggcttatgatttaggtaaaccagctgttgacgaggcgttgattgccttttttcaagatcatcctgacagccgattgaaagtgcaaatggcgtttgccggactgggcatagagccggcgaacaatagccaactttatctacggacaaccaccaaaaaagccttgccgaatgcatggcgattcaaagtaatgggcggttttccatttatcggtgtcttgttgacgctattgtggccggcaattggggtgaccgtgatggtggtcagtttgctggtcaacgtgttctactacattttgaaacgtgaaggccttgatgccgaaattacgtctatgggttaccttgtccggacgattatcacagcagaacgtctcgccaaaattagccaaccgactcaagcagcattgcgacaagcagttaaaccaatgcgcggcatcacgcgatttgcgtttgtcttccggaccaagaccggcagcatgggcgacattttaactgagtatcttagcatcatgttcatgctgagctttattgcctacaacacagtgctcgatcgcttaagcagccaccatgctgaggcgctagccctgtggcaacggctgggcgatttagagttggccattgccattgctaattttcgcgcggcggaggcgaccacaacgcaaccagtctttgccaaaggcggcatgaccgccactgacttagcccatcctttgttgaaacatcccgttgccaacccagttgactggcagaaaaatgcgttgatcaccggcgccaatgcttccggtaagtcgacctacgtcaaaagtattgcgatcaatgccattttggcacaaacgatcaataccgtgacagcgacaagtttcacgatggagccgggagaggtcatcaccgccatggccgtgcgtgatgatctgagtgaagtcgatagctattttgttgcagaaattaaagcaattcggcggctgctcaatgccgttgctaaaaagaagcgcgtctatggttttatcgacgaaattttaaaagggacgaacaccgtcgaacgaattgccgcttcagcgagtgtcattaattggctaaagcaatatccgagtctggtcgtggttgcgacaaacgataacgaattgacggacattatgggcgatcaatgcgtcaactggcattttcaagagaaagtgacgaaggagtatggcgttgtctttgactatttgctctatcaaggcccggccacttcgcataatgccatagcactgttggcaaccatggactatccaacgtccttaattcacgatgcgcggcagttggctgcggattttgaacgtaccaaagcatggcctaagtttattaaaggaggcattcaagcgtgacagttgcagataaaatatttgaagccattcgtcaggatcccgataacgctgactttaccgcccaaggatgggatccgctatatcatattgaacctgaagcaacgatcctcatcgccagtcaggcaccaggacgaaaagcacaaacgacaaaaacatactggaatgatccgagcggtgatcgattgcgaacttggatgggcgtcaccaaggatcagttttatcacagtggcaagattgccgtcttgccactggatttttactatcctggcaaaggcaaatcaggcgacttaccaccgcgtaaagacttcgcggccaagtggcatccttctttgttagccttaatgccaaagattcaacttacaattgtgattggcgcctacgcccaaaaatattatttaggaaagcatcgcgaaaaaacgctgactgccactgtcaaaaatttccgggcgtacttacctgactattttccaattgtgcatccttcgccgctaaactatggttgggtcaatcgcaatccatggtttatgaccgatgtggtgccggcattacaggcgcaggttgcggccttgatgaagtaaacgaacgttctcgcactcgcacaaaaaagctgagatcatggcagagttgatgccgcgatctcagctttttaagtagccttttgcttgaataatttaacgagtgattgaacttatggtaatgtcacgaaaatgagtgcgccaacaacgccgccagctaaaggaccgagaacaggtacccacgagtaaccccaatcagagccgcctttatgtgcaatcggcaggatggcgtgcgccaagcgtgggccgagatcccgcgccgggttaattgcgtaaccggttgtccccccaagtgacaatccgattgcagtgattaaaacgccaacacccatcggactcaaaccggctgtccatttgccttgcgcaaaagctaataggccaaaaatcaagacagcagtgccgatgaattcagacaagaagttagcggtatagttgcgaatggctgggccggtcgcaaaaacgcctaaggtggttgcttggtcattggtcttcgtccaatgtggatagtaatgcagccagacaacggcggctcctaagaaagcaccaagcatttgggcagcgacaaacggcagcacccatgaccaagaaaattgaccgatggcggcaaaagcgatggtcaccgccggattgagatgggctgggccaaggaaagcggcggtataaacgcccatggtgacagctagtccccaaccaagggtgatggcgacccagccagcatcctttgcttttgattggttgagtgacacgccagccaccacgccgtcaccaaggagaatcaggatgaaggtgccgataaattcacctaatgtttgtgtccacatgttgattcctctttctattcaggatgaaccggtgctggtgccgtttttagataggccagttgactgtcggcaatggcagcattcaaggcggccagttgttgggctttcaccgagtcgtcccatcccagtgtttgcgccatttcgtcaacaaccggctgtttcaactcagccagtgtttcagcgtggaaaagaagggcattggttcggcgcaagagataatcaaccggtgtgagcgtcatttcttcattgagtgaataacgcagactcatggtttccttcagacttaatcctggcgcagggccatcgacagcgtaagtgagcactcggctggtattggaaccgaagcggttagccagatcttgggcgtctttttccgataaaccagcatcaacgccaatccgaatgtagaaggccatggtttcttcaacattggtcggatcaaaatgtccgccggaaacttgcagctttttggaatcaactgctggcgcgtcaacgttgaaacggtcgaccagaatacggcgaatcagcgcgagggcaccagcggccattttccgatagtctgtaattttaccaccagaaagggtgatgagcccgtctgtcgcttggtgaagcgaactgccgcgagaaacttgagatgggcttaatccggcttctgcatgtgctgtttccagtttggaaatggcacgttcaacatcggcgcgggttgcttgatcgtcttcataagcgttcacaacctcgatcaaggccgtgaatgaatcgtctgaaactttgccgctgttagcaccgccgccgttataatcggaactgccgttgtcgttgatcagtggtcgcaacccagcccaactagcttcaatatcgtcgatcgtcatatggctttcggggaagcgtttattgacgactttcagcagataatcgacatcttcttgctcaacgcggggatgttcataatcgccggtataatctgtatcagtggtaccaaaatacgttttgccttctcgcggaaccacgaagaacatccgaccatcgtttaagccagtatccatgtaagttggttgcggaactggcaagcgagaaccgtcaacgactagatgaacacctttggttggccgcaaagttggcgcgtgtttttcgtgatcgtcaagtgcactgaacttatcagcccatggaccggttgtgttgatgaccagtttggcatggatatcgaattcagtgtcgtccaacaagtctttaacatgcagcccaaccacttgaccagcgtcattgtgcagcacgccgaccgctttaacatgactggccatcaagccgccaagttcgtcagcttctttgatgttttcgatcacaaggcgcgcatcgttgttgacgaaatcgagataaacgccaccgccttgcaggttatcagcggacaattgtggttcacgttgaaggacttcatcttttgtcacggtataattggcgtactgagaaccttcaacaccagccaatcgatcatagagatccatggcaattttgacgctgaacatgtcaaacgtactgccggattcttgataaattggcaacagcattgggaatggccgcgggatatgcggcgcgatcccttgcacgacggcgcgttccttaacagtgtcagcgacaacgccaacatcaaaagatttaagatagcgaataccgccgtgtaccaatttggtcgaacgcgaactggtgccttccgcaaagtcctgcatctcaatcaaaccggttttgatcccgctggcagctgcttgaatcgccaccccagcgccggtaatgccgccaccgacgatgagcaagtcgagctcggtatgctttaactgatgaatcgtttgtttgcgcgtttcgttggaaaataccattttgttctccttcattacggatcgagtcagtctcgatcatttttggttgacagatcaggctttcttcgccttgtgcttatacatttgggttgcagcaacagcttgctgccagccttcataaaggtggtcgcgatcaggcgcgcccattgttggttcaaaacgtttgccaagcttcacgatactttgcagttcatcggtattgttccagaagccagtcgccaaaccagcgaggaaggcagcgcccattgccgtcgtttccaaattggctgctcgttcaatcggaatgcctaaaatatctgcttggaattgcatcaggtaatcgttgttagctgcgccgccgtcaacgcgcaaagcttggatcgggataccagtgtctttattcatggtatccacgacatcacgtgactgataagcaagagattgcaaggttgctttgatgaaatcttcgcgagtcgtgccacgagtgatgccaaaaatagcaccgcgagcatcagaatcccaataaggcgcacctaagcctgtgaaggctgggacaacataaacttcattttgactcttagaagcccgtgcggcggcttcggagtcgcttgaacgctcgaccaacttcatggcgtcccgcaaccattgaatcgcactgccggcaacgaaaacggaaccttcaagtgcataggtcaccttgccatcaagtccatagccgatggtggtgagcaggttgttgttggacaaggtcggtttttcgccggtattcatcacaatgaatgcacctgtgccataggtgtttttcaccatacccggctcaagcgccaactgaccaaaaagtgctgcttgttggtcaccaaccatgccggcaattggcacggtactgccgaagaaatggtaggctgctgcattgccgtaaatttctgaattgctgcgaacttccggtagcatttgcttaggaatattcaacaattggagaatctcgtcatcccaggctagtttatggatgttgaacaacatggttcgtgaggcgttggtatagtcggtgacatgaatggcgccgccggacagcttccaagaaagccaagtatcgatggtgccgaaaagcagttcgcctttttccgcccgttcttgcgcgccaggcacatgatccaaaatccagcgaatcttagtcgctgagaaatacggatcaattagcaaaccggttgaatcatgaatcatatcgctgtggccatctgccttaagtttgtcagcgatctcgctagtttgccgcgactgccagacgatggcgttgtagattggcaacccggtctgtttgtcccatacaaccgtggtttcccgttgattggtaatcccgattccgacaatttggcgtggctgaatctgtgattcaataaacgccgtcgcgatggtcgacaaagcggcattccaaatttcattggcattatgctcgacccatcccggatgcggaaaatactgcggaaattcccgctgtgcatcaacaactttttgaccattgtgatcgatgatgatggtccgtgtactcgtggtaccctcatcaatcgccagaatgtacttctgatcacttgtcacaaataactaccccttgtgaaataatattgtacacaatgaaaacgtttccataaacagttataccgtacctcgtgacattctgtcaactttaaacttatgtgtatcattagttattttaaaaagttaaaaaaccgatcaaaattctgtaaatgagatggaaatggaggttgtgctgcaaatgagatatcttgaataaaaaaacgcgtggccgatgaacgttttcatcagccgcgcgtattttgcttaggatcatctgacctgctattggatgagctggcgcatgcgatggatccgctcaaaaatctggtcttcctgacggcgatcagcccaagaaaaattgtgcatcgtgctattcgggcgattaaccttcgtgtacaaaatggttggattataagcatatttgccaggcgtatgcgcgacaaaatccgccgtgaagtaatagtcctcagcaatgcgtaattgttcatcatagcgaatattaccggcagttaaagcatcacgagagaaagccttgttccaaatataaccgcccacttcggagccgtggcgtgagacttgatcaaacatttcgcgctgtgacaacaattggaagcgattaggcccgccgcggctgcgatgccaccaatcataaccaaccgcagtggccacaacacccgatgtgaacccgtgtgataacgtttcggcaaaggtcggcgcgattaaatcgtcaccgtcaacaaacgccacagcttgaccagtggcatgatcaatgccaaagtttcgcgcagcaccgatgccacgatggtgattaaaaccggtcgcgtgaaaattagggatacctttaacaaaatcagccactgtctgagcggtaccatcagtcgaggcatcgtcgatgagccaaagttcaaaatcaattgtttgttgctggatactttttaatgtctcaggcagataatgacctaaattgtaagttggcacaacgatggttaaatctaagttcgacataattgcctccttgaagctcgttttgataattatcgtcaaattacgggtgacgtcaatcaaaatgattcatgtatgaagttgggttgttgacatggggaatgctaactatcggcgccatgtggaagggacattctgagcctgctagaatttttagtaaaaggaagatgctttaaattcagcgatttttaaatggccggtaaaacaaaaacaaaaaaatttggctatagagcttccaattcgtcattatttttagtaaaataaaagcggttacaaaaatcagcatcggataaataagcttaacttcaattaggaggtattgacggtgaatagtacagatgtcacgaaaggttttacggaacaatttggtaagcaggcggagcacaccttcttcgcaccaggacgcattaatttaattggtgaacataccgattacaatggtggccacgttttcccgtgtgccatttcgctgggcacttatgcagcggttggcaccaatgaggacaacgcttttcggttatactcggccaacttcccaaaggttggcattattgacatcccatttccagatcttttccaagataagcgcggcttgtggacagattacttccaaggtatggcgcgggtgatgaagacggcgggtgcgaacttcacgcatggcctcaatgtttacatcaacggcaacttacctgatggcgctgggttatcaagttctgcttctctggaaatgctggtcggaacgattctgaacaatctttttgatggcggctttgaaccgttggagctggttcagttcggcgttaaagtcgaaaacgactatatcggcgtgaactctggtgtgatggatcagttcgcgattgaaatgggtcgcgcaaatcaagcaacgctgttggatacaaacacgatgaaatacgagtacctgccagttgagatgggcgataacgtgattgtcatcatgaataccaacaagcgtcgtgagttggctgattccaagtacaacgaacgccgcagtgaatgcgaaaaagcactggcaatgctacaaaaaggcattgaagtcaaaagtctgggtcaactgagtgaagacgaattcgacgagaatacttatctcatttacgatccaatcctgatcaaacgcgcgcgccacgccgtctttgaaaatcagcggacattgaaggcttcgaaagcattgcaagatggcgatttgaagacctttggcaaactagtctctgcttctggggtttcgttggcttttaactacgaagtcactggcatcgagcttgatacccttgtgaccaatgctttgaagcaacggggtgtgcttggtgctcgcatgaccggtgctggctttggcggttgcgccattgcgattgtcaacagtgctgatgttgaagactttattgataatgttggcaagacttatcgtgaaaagatcggctatgacgcccatttctatgtagccgatattgccgatggtgctaagcaactgaactaactctgctaaaatagaaaaagtgttataaagtagagcgtgagccagaccgatttctagtctgacgaatacgtttaaaaaagggagatatttcattatgacaattgcagttttaggcggcgctggttacatcggttcacatacggtaaaacaattactcgctgccggcgaggatgttgtggttttggataacttgattactgggcatcgtaaggcggttgatccacgcgcccgtttttatcaaggcgacatccgcgactatcattttctgagccaagtgttcagccaggaaaagattgacgggattgtccattttgcggcgttctcaattgtgccggaatccatgaaagatccgttgaagtattttgataacaacactggcggcatgatcaccttgcttgaagccatgaatcaattcggcatcaagaaaattgtcttctcatctacggcagcaacttatggcgaacctaagcaggtcccaattaaagaaactgatccgcaagtaccgaccaacccatacggtgaaagcaagttggccatggaaaagatcatgcattgggctgatgtggcttatgggctgaagttcgtggctttgcgttacttcaatgttgcgggtgcgatgccagacggttccatcggtgaagaccatcatccagaaacgcatattgtgccaattatcttgcaggttgcagcaggtacgcgaactggtttgcaaatttatggtgacgactatccaaccaaggatggtaccaatgtgcgtgactatgttcatgtggtcgatcttgctgatgcccacattttggccttgaagtatctggatgccggcaataagtcatccgcgttcaacattggttctgcgcatggtttctccaaccttgaaattctaaatgcagcgcgtaaggtgactggccaagagattccagccacgatgggcccgcggcgtgccggtgatccaagcactttgattgctagctcagaaaaggctcgtgacattttaggctggaagccaaactatgacgatattgacaagattatcgaaaccgcatggaactggcacgaaaatcacccagaaggatttggtgaccggaattgaccgcgattagcaatcacgttggtaccattgtgaaactcaatcccgattacacccagatggatgcagtctatctgaccaacaaattgttgaatttgatcggagatgctgcccttgacctgtctggtgatgctgatccattgacgaaccttgatctgatggtgaaagctgcgcaggagaatggtaaaattccagattcacaggcagcacgtcagattttggaagcacagctgatggaccttgctaccccgacaccaagtcggatcaatcaactgttttgggataagtatcaggcgggaccacgggttgcaacagactggttctttgctttgagtcgcgcgaataattatattcaaacgcgagcgattgctaagaacgttgtttttccagctaaaactgaatatggcgacctcgaaatcaccatcaacctgtctaaaccggaaaaagatccgaaagacattgctgctgcggcacatgccgcccagtctggctatccggcgtgtgccttgtgtttacaaacggaagggtatgccggtcgaactgactttgcggcgcgaaccaatcatcgaattattcgctttttgcttggcggtaaaacatggggattccaatattcgccatatgcttacttcaacgagcacgcgatttttctggatgctatccatgaacccatggtgatagaccaaagtaccttcagcaacttgttgtccatcgtttcaatgtttccaacttattttgttggctcaaatgctgacttgccaattgtcggcggttcgatgctgacgcatgaacattaccaaggcggtcgccatacatttccaatggccaaagcaccaattgagacgcaggttgaaattagcggacatccgcatgttttcgctggcatcgtcaagtggccgatgagtgttattcgcttagtgagtgctgattcggacgagttgataaatgcagccgaacatgttcggcaggtttggaatcagtataccgatgaaacagttgacgtccgcgcatttgttgatggcaaaccgcatcatacggtgaccccaattgctcggcgcgttggttcggaattccagctggatttagtgctgcgcgacaatcaaactagtgcagagtatccggatggtattttccatccgcatcaagacgtgcaacatatcaagaaggaaaacattggcttgatcgaagtgatgggacgtgccattttaccggcacgattaaagtcggagttagctgaagtccagaaatatcttttgggtgaagccaacacgatgaaaccaatgcatcaagcatgggccgaccaactgaaagcaaaatatgattggacgccagcaaatgcagagatacaaatgcaggcagcggttggtcgtgtgtttgccagggtcttagaagatgctggtgtgttcaaacgcgatgaagttggtcaaaaagcatttgctcgcttctgtcgggcactgtagcaacaggctacgttgctgaagccggcaaggagtcaatggaaacggagaaaacgatgaccacgattaccgatattgcgaaggcggcaggggtttcaattgcgactgtctcgcgtattttaaattatgatacgacgttggctgtcacgcccgaaacgcgccaacgcgtgttgaaaacagccgaaaagctggcgtacaaaccacgtcgacgtaaacgtgtgtctccgcaaaccaccgttgccttgattcagtggcgcagcgagcaagaagagttgaatgatctgtattatttacagattcaatatgctattgaggcacgggcggcctcagctggctatcatttgcagagtttgcatttggagcagttgggagccgagacgacacaaaacgtccaaggtgtgattgcgttgggtaagtacgacgctggcgaagtggcaacgatcaaagccttggcgcaaccagttgttttcgtggatcaaaatatgttggcatttgactgcgactcggtcaccagtgattatgccggtcctatcaagcaaattattcatcattttcaatcggtagggatcaacgacatcgggtttctcggtggcgttgaaacgagtcgcagcggacgcgagcagtttcaggatgttcggacagtcgcatttgaccgggtgatgcatgcagaaaacttgatgcagccagcgtttcgttttattggcgcgttcacgcctgattcaggttacgagctgatgaaacaagcgatcaccaaactcggggacaccttaccccacggtttcattgttgccaacgacacgatggcagtcggtgcgttgcgcgctttgaacgaggctaagatcgaggtgccgcaacgagtctctgtgatcagcttcaacgatgtggcggtcgccaagttcacaaccccgctactttctacggtgcatgctgccactgatcaaatgggccaaaccgcggtcgaactattgcaggcacgcatcaaagatccgaaacgcgtaccacgtcaggttaacttcaaaagtgagcttattatgcgagccagcagcttgtaggaacggtatcataacgtgttcccccgcgaagaaacctgtccataatgacctcaagtgcaatgaccaaaagcgggtcatcatacttgaggtcggctgatgctttggtttctaaccgcgcttgcttacgctcgtttataaaggaggacaagatggacgtttcagttgaaccatacggtcagtatcaaggccacaatttgtatgagctgaccttgaccaatgatcaaggcatggttgtgaagttgttgaattatggtgcaaccttggaaaaagtgttgttaccagaagctgatggcttgcacaacatgattctgtcgttgccaagtcgggaagattacgcaaaagagcgcaattttctcggcggtacggtcggtcgagtggtcggccggattcgtggtcatgtttggcagcatggggatgtgaaaattgatctgccaatgaacgaaggtaagaatcacattcacggcggagatgacggtctggatcggcaagtttataacttccgtattgaccagacagctaccacagctagtgctagttttacctttgttgatccagcagggcataatggctatccgggcaacgtcaagctgcaagtgacttataccttggagaatacgaataccttgcactatcgtctggatgcagttagtgatgaagaaacgctcttcaatccaactaaccatacctattttgcgattgaccagccaaacaaaattgatgccaccacgctgacgattccagccgacgattacaaaccgcttgatgcagaccatctgccagatcaaggctggcagccagttgccggaacggtctttgattttcggcaagggcaaaagcttggcgatgtcattcacactcgagcagcgcaaatcactgcagaacggggcattaatcacccattcctactgaaacacggtcaaaccctcgcggccaaactccagactgacaaacatactatgaccctggcaaccactgcgccgtccgtcgtcgtttacaccgccaaccactttgacggtaccggtattcctcacaacattgatcaatttgatggcgtggctcttgaatgccaatttgctccggtcagcggcgatgatctttcggcgatgacattattgccgggcgaaccatttacgttggtgaatagttgggcgtttgaataggcagcttaactttttaatgcctcgggatgttctgaccgaacctaatctttataaagaaagaagccttccaaatcattggaaggcttttttgacgcaacgagaaaagtttagaagttcttgtgttaagctgcttttttggttagcattgtgaacaaatagtttcaagttaatacataaatggttacgcggtcaaaagacatgcaatgtgacaaaaggagtcgatagcatgaagacaaagtttcttaagttgccggtctatcaacaaggacttttcttaacgttgatttggctaatggtcgggattggcgtgatgctatatcgctggccaacaagtgatcaggattttcaaacaaccgcctattggcttgcaccgaatttgattcatatgcaaggtgaggtgaccgctcaatggttcccgtttgcgtgtgcagtgacggccggtgtgagtctttatgtcgtcaagcatattaaaagtagaaactgtgacactagagaaggcctttatgtacttcagaatttgtggcccatctggttggtgacaatcgtagtatttttcttattaaatctttggctaccacaaacagggatgactcgtttttcgagttttgatcgacaagtactcacgattgcaatactgtttcttgatattactttatttagttcttacatgctttggttaaacttctgggtgccggttggccgggtacataatgtcattaaggttctattttgggcagtgcttttccttggagctggatttattatgagccacattcaatttacgtttgccagcagctcctttagcttggacgatctaggacgacgtacatggttaacactgccattttggccaagctggttgactggcatggcgcttgtttccttaagcttgttaattattagaaaaaaagcaatcaacattcagtaccgcgaaaaaacaatgtagtcgataaaaattgcaatatatatggtagattgtaaaattaatccgaacgctgttcggacaaaaaagatcagctccaagcttcacaaaaagtcgcttagcaaactgtccgaaaaagtgttgacttccccaacgttcagcatttcgtccgcaaagggaggataagtagcatgcaaaaattaacaattgtgataccagcctataatgaacaagaagtgctaaaagacactgtgccgagattatggtcaattgaacgagaggtggttacccaaaatttcctttccgaagattcagatatactgattgtggatgacggatcatcggacaacacttggtcaatcattgaaagtttccataagcagcactcaaaaatccgcggattacgtttttcacgcaattttggacatcaagctgcactcatcgctgggttgacggaagcgattaggaccacaaacatgaccattaccattgatgctgacttgcaagatgatcctgaaaagatcatggagatggttcaggcatacagtgccggtgcagatattgtctatggtgtgcgcacccatcgtgaaactgatagctggtttaaacgtacgacagcacaaggctattacaaactgctcagactactaggtgttcagatggtacccaatcatgctgactttcgtctaatgtccaaacgagcggtgcagacgttactcacttatcctgagcgaaacatgttcattcgcggattgatcccgaagcttggctttcaaacagtaaaagtctattataaacgcaccccgcggctcgccggggagtcgaagtatccgcttaaaaaaatgcttgctttcgcttgggacggcattacctcactcaccattgcgccagtgcggttaattcttctgcttgggacacttgctgtgatgctggcttttggcatgtcagtttactcaattatcgtgaaagttcttggattgaccgttcatgggtggtcatcattgatggtttccttatggtttctaggcggtttgcagatgatgagtctgggcgtcatcggcgagtatattggtaaaatgatgactgaagtcaaaggacgaccgcggtatacgattcaaacccgcttagattagaagtgataaaaatgacaaaaatggctaaacattcatggatggcagttttcctagcaatttgtctgattatcggcatttgcggcaatttaatgaaatctggtgctattttgtggggtgtcgttgtcctgctcatcagtgtcgttactttcgcagctgcacacaacttaggtccgttggttaatcgattgactgctaggcaaatgaggataatgatcggaattggcttaaccctgatgctcgtggggcaagttttgattctgatctttctgccagacacgatttaccatgatccgtaccgaattttgtcacaggctgatcaaatggcggcaggccacaacatttggaacatgacttacttctggcgttatcccaacaatgtttcgctgacctgcttgctctcgctttggttcaggctgacgagcttggtggggatgtcaacgaacgctgcgagtcatatattgaccatcactttgttagatacatttattagcatgaccttagtaactttgaaacaattgagcgagcgcaatagcatcgtgttaggcggctttacattcctagtcttaagtcccttcgcgtacacttactatttacaggtcttttattccgatctgccttctatgctcattttactcatgatttttcggatcttatggcgatggcgaatcaagagtaacctgcaacgaatttgtgctggcatcggcttgacgatgcttgtcttagtcggtcaattgctaaaaccaaatttgattgttctcttgccagcacttttcatcatcgttgtgatcctgtggcaccgaaaacttctaagaactactaagttgactgtgccttttcttttgattgttgctggtttcggcctgagcgtgccaacgacacaggtgattcatactgcggctaatttccatccaaatgctgcgtatgaactgccggttacgtcttggatgctaatgggcgtgaatacaaactctgacgggatgtatagcaccaaggatattgaaaaagcgattaccttaaaagataaacaggcagttgagcaatacgacattcaaacgattcaaactcgagttaagaagctcggcgtctttggattaatgaagctttggcttgtcaaaatagggattctccttaatgtcagatccatccaagactggtacaatggcggatttcaatcggcgccgacttggtacgatcagcattcacaatttctgagagcagttacggccgtgagttatcaagttgtcacgattgtgctttggttgacgttaatcattcggttgctggcatggcggccagatttacgtgatgaaactgccttgataggactgttggcgattgtcaccgcacttggatatctcgccttccataccttgttatgggaaactgaagaaagatacggccaggcgatcgtgccgcttgttctttttgccctaggagctttgcctaatacggcgcgcaaacgtgttgtcattcctaaacggacgcgcaatcggttggcagttggatttgctttggccgctattcttgggctgagcacgttttcggggttgttagcgaaggactatccgaatacgatcgttgtggcggcgcaacgttcccaactctccacgcaatatcatgcaaagccgcaactaattgcaccaaatacagtgatgtccgaagaaatcagcttgaacggtgcatcaaattacctatcagttcaaattcaccaagccgctggcatgaaggtaacgctgacaagtctaagtactggcaaagtgtacaagctgaaaccagctgctgctgtttataaactcgaaaccaatattgctgcgggccattatcgaattacggctaaaaacacttccggcattggccagcaagtcgatgttgtgaatacccagagatatcagttggctgagtatccattggtcgtcaatggcgtcaagaacgcgacggcatcgtttgtttatacgagtttgtatcaaccaacgtgatcttttgtaccttttgggtaaaggcgtgcggccaacaagcaggatgccgcgtggtcaaacttgcggatctattaatttggctttttctacacaactcgccatctgtcgaccgattcatattataatgaaagcaactaagcgaaaaggatggttggccatggaccagaataagttgaagcaggaagccgcgcaaagagcagctgagtttgttgaagacggtatgacaattggtttggggacaggttcgacagtggtttatttggtcgaagcgattgcgcaacgaatcaaagacgagcatctcaatctcaccggtgtcgccaccagtgttcgtacgcgtaaacaagcagaatcgctgggcatcccaatgaaagcactggacgaggttggccagattgatttgacgattgatggcgccgatgaagtcgacaagcactttcagggcatcaagggtggcggccggtcgcacttaatcgaaaagatcgttgctatcaactcggcccgcaacatctggatcgtggatgaaaccaagttggtcgatacccttggcaaatttccactgccgcttgaagtgatcccttttggcagcggcaagctgttgcaacggttggccgacgaaggacttaaaccggcataccgcttaaatgaagatgggagcaaggcgttgacagattccaagaactatatcattgacttgcatctgggcaaaatcgagcacccgcatctgctggctgaatggctgaataggcaggtcggtattgtggagcacggcttgttcttagatttggtcaaaaccgtggtcgttggcacaacacatggcccagagattctggacgcacatcgtggatagcattcaaaaagtacgatgttctcgttggcgagagcatcgtactttttgtagatggttggagaaaacatatgcagtctttagactttgaactaaacggcgatccaacgcaagcgccgcaaatggcgaagtatatgaagaaccaatttccatttttaggactcaaaacaccggaacgcaagacacagacgaaaccgttgcttaaagccagtcgcggtgaggacttaccaacgattcgagtttggattgatgcgttgtatcaacgcgatgcccgggaataccaatatgtggcaattgatttggcacttgatcacatcaagcgctggcacttttcggatatgcaggcttttcgacaacttgttgtgcagaaaagctggtgggatacagtggatgcttggcgtaaggtttttgcggactatgtgaagctgcaccctgatcagaaactggctgtctttaatttgtttttcgatcaaccgaatttttggttacggcgtatcgggattaatttacaactgctagaaaaagaaacgatggatacggcgctgcttagcaaggctatcttggctgatttggatacgaatgaatttttcattcagaaagccatcgggtggtctttgcggcagtatagtaagtttgacccagattgggtgcgaacattcatagctgtccatgcgctcagtccgttggcgatccgggaaggcagtaagtatttgtaaggcttgctgatcggcaatgtgcttgaaggcgggcgttaggcatcgaaaaagaccattggacttctgggagaagtctaatggccttttcctgattgctcagccctgcagaggcattttggtatcatctggtacacatgatttggctcactttagtatggtaaagcaacacagaaagaactaggcgtggtccaattcgaaagacaaaaagactgccaattgccttgtgggagcattttatccatcgttaattaaagtcaaacaaaaacccgcgaaatcatgcgggtctgcctatgtattggccagtcggtgggaggccggctgacgatttcactttggaggagtaaaaatgaaaaagttgggttggggtttgtaggaatgagtggggggctttgcgggctcgaagcgccgtctccgctctagctacgcgtcgccaccccagctggccggagattgcggagtttggcacggcaagtatattttagcctagaaccttcctagcgactattcggaatttaatgaatcacaagtcttgtgagagaattatggctcacactttttgttgttagcaatcacctagattgtaccgattttcagctcctctcgtcctctcaatcacgacacaaaaaaattgactgacgagtcaacaattcgttgactagccagtcaatcgcgactatactgcaggcgaaaaggttgatcagacaccgacatattaaaaagtgtttcaagtttgaccttaaggaggacgacaaaaatgacaacaaacatcatcgaacttgaccatcttcaaaaaaactttggcaagtttgccgcattaaaagatgtcagtttcacgttggcacccggtcaggttctgggttttctaggacctaatggggccggcaaatccacaaccattcgagttattttaggcttattaaaaaagagtggcggctcagtgaccgtcttcggcaaagatgcctggcgggatgatgcggcgattcatccacgcatcgcctatattcctggggacgtttatttatggccaaatctttctgggggcgaaattatcgacctattgctacgtttaaatggtcgccagcataatcaaaagaccgatgaactaatcaaggcctttgaatttgatccgaagaaaaaagctcgtacctattcaaaaggcaatcgtcaaaaagtagcgttaattgctgcgttgtcgcaagatgccgatctgtatatttttgatgaacccacttctgggcttgatccattgaatgagcagactttccagcaagaagttttaaaactgaaaagagccggtaaaagtgtgctgctatcaagccacattttgtccgaagtcgagcgaatgtgtgattcaattgttatcatccgtgatggtagtgtgattgagagcggcaatcttgatcaattacggcatctatcgcggatcaaaattgaagtcaccaccgctaccccaatgactgatttggcaaagcaagctggcgttcacgacctaacttatcgcgattccgagcacaccaaggcggttttcaccgctgatcgagacgcgcttggcaccatcatgaccacactggccgccaacaccgtggtcgacatgcaatcaacgccgccaacgcttgaagatttgttcctgcgttattatggaaagcaaggtgagacccatgcggcacagtaatcggaacgcaggttatctgcttcgggcaaacctcaaacaaaatctaaaattttcactcatccggcttgtcattttgatcatgatgattgccagtggtgctggcaaattggaagcagcctttgcaggcggggcctcgggctctaaagagattgtcaaaatgctgcgagcgccgggcatggcggcaatgtttggcgcgatgccaaaggtggacacgtataacacagcgattgtgtttgctggtgtgatggtcgtcttcatgattattttgcaggccttatgggttatgccgctgatgattcgcaacacccgcggtcaagaagaaagtggcttgctcgaaatggttcgcgctcgcaatgttgggcgaacggctgccatcaccgccgcttcgcttgagcttctcatcgacagtgccataatgggtatcctctattttgtctcgttggccgctgtcaacatgggtggtactgacttgtacggtgacttcctgttttcactggggatggtgatcgccaacttgctattcggaaccattgcgttgctattcgcgcaaccaaccaataacacacgtacagccaatatgttgagctacatggtgctgactgccgcttatttggttcggctggtcaccgatatccagcatcaaaatctgacgtggttatcaccaattggttggttcgaaaaagcaaacttctatactgataacaacgtctgggctttaggtttggccttgctggtcagcattctgcttgcggccagcgccaccatgattgcccgcaaccgcgatctgggcgccgggattattgctgaacgcaccggccgagccaaagctgccggctggcttcgctcgatccctgccttactgtggcgaactgagcgcggattatttgctgggtggttaatcggcgccgtggtgtttggcggcgtcatgggtagtgtgctcggcggcgttggcgacattcttaaaacgaatccgctttatcgtaaaatactagatgttggccaaatcaacgctgccaatcagaccatggtcctgtcattcttaggcatgtatctcggcattttcgtcgcattagccgtgactgctggcgtccaagtggcattccgactcaaacgcgatgacaaccttggttacttgagcgtcattcatgccgaaaagccaacgcgaaccacgatcagtgtcagctactattgctttggtctgctggcaggcgtgttcgtcctttctgctgggctgctggccttgttcttaactgggaacactgttctcagtcacccgttgccgctcaagtacctcggtcgcctattcgtggctagcgttccggctgtgatatcgtttatcgcccttggcatcgcactagtcggtctgtggccacgcttaagcagtctattctggctgtatatgggagccggtctgatcgttcaaattttccggggattgtttgatttgccaaaacacgcaggcaacttcacaccttttggctggattgccaatgttccggttgaaaacgttgatcaaacatggctaatcgtgatgattgttagcgctatagtattatttgttcttggtattgccggttatcgtcgtcaggatttgagcctatgaaaaatgttgtgacagatcccgaaaaagtcacccgtatactcaaaacagcgacggaaattttcggccagcaaggcttcatcaagagcaaaaccgatcagattgccaaccaagcacaagtatctaagggcttgctcttccattattttggcaataaacaagcgctgtatcttgacgctttcaaatatgcctatcatcgaatttatgatcacatggacccccaaaagtggcagaatgcccctggcttggctgccatgatgaccactgcagttaagtatgagttgaaactacaattcaaattcccagctgaataccgcttgatgatgcaagcctatgctgatttaccgcattttcccgaaccgttacgacaacaagtgcagcaagaaacaactgccatatccgctgaagccgatcgcattttccgcgagaaaattgaacagctgcctcgtcgtgagggcctgtcagtcgatgacgttttcggtgtcgtttctgccttaatcgcccaacaaacagcggtcaccaccagactcatttccagtggccattatcgcaagtttgaagatctgcagtccgtggttgagacgatggcacgccagttattgatcgtcgaacacggttttttaccagatgaaagttgacgtcagctgatagattaaaaaaaccgcctgcactgatctaattcagtacaggcggtttttttgatcataaaccagaaatgccttaccttattcaactttttttgtacttgtcagcttgaacagacgagcatacaaccagaagtttaagatgccaatcgctagtagcaggccaaaagccagctgactgccaatcccaacattttgcgcgtgagacaagcctggcatagtaacagccgtcatcatgccagctaaaacggtagtccccattgaacctgtcacttgctgccctgtgctatataaggcattcgcgtcgctttgatcatcaggttggatgactttcaagccatatgctgtactgttgccaaaagccatggaacggccgatggcaaaaatcagatacaagatcgtgacccaaagtacgctgatgtggcggccaaaaatcgtaaagccgagcacgccgagcgtaaatagcgtgttgccaagaaataacggcaaccgtccaccaaaatggtctaacatccaaccgtaaaccggctgacctagtccattgaagacactgccaggcaagagaattaacccgccaataaaagcacttgccccgtcaacagtttgcacatagtttggcagcaaaaaattaatcccaacattcgaaaactgcaagagaatatatggcagaaaactgtataagaaccctggatcgtggaaaacatccaacttaaacaaagttttggcgtgatgatttgacaaccaaacgaaaactgtcatggctgcaaccacgatcaataaacccatacacgcagttaaccatttccgatcactgacaccattcaatgcaacggtcaaactgatcaaggccacaccgagagccgtaaaacgcagccaatcaaaagcaaaatctgaagttggcgtgtattgtttgattcttccctgccccagcacaagtaacaaaattgcaaacggcaaggtgctccagaaaatcattcgccaatcaaagaagtttgccacggcaccgccaaaggttggtccaagcaccggtccaatcagaataatgaggttcgcgacgcccatgtaggtaccaagtttacttgtcggtaccgtatccaaaataatattgaccatcagaggactacacaaaccgacacaacctgcttgaaccagccggcccgcaagcaacacccagaacactggtgccattgcgcacatcaagtcgccaataatgaacagcaatgctgccgtcacaaacagctgtcggttggtaaatcttcttttcatgtaagcagaactcagcatgattagcgccgcggccaaaagatagcccgaagtcacccactggacggtcgtcaaagacacattaaaatcatgcatcaaagttggaaaagtgacattcattgaagtttcggttaacacccccaaaaatgacatgagcgctacaatgctgatcacaagcaatgcgtgccgagcattagtttcttttacttcaatcgttgtcttcgccatgatcaatccccttcggtttctatcataagacgcaatattttcagtaacaacgtcaaattttaaaagggcttatgaaagcggcctgaaatagcagccattttaacaatctttccatccataaatgcgatacgatagaagcattagttaacggaggaatcacacatgacaatcatcttgcttttcctcggctttttggtcggggcatttattatgacaatgggcggcggtggcggtgctttttaccttggcatcatgaccggcgtcgcgcatctgtcacccggcaccgctgcggcgacatcgctatttaccgccattccggccttggcggttgggtgttacagccattatcgtacaggaaatatgcgttttcacgcgggtaacgaaatcctgatgaccgccgtgcccgccacgattattggcagtcttgcagcgccacatattcccgaagtcgtctattcatgggcgatcgcggtcatttttgtggtgctcggtgtccaaatgttacgtcaatcgttcgcgcgcaaagtcaaaaaagccacccaacctgtgtggttcgcctatgtcctcggcgcaattagtggcctcatggttggtgttgccggattaagcggtggcggcccgatcatggccggtctcatgttaatggggctcgacatgcctcatgcggcagcgacttcttcgtacgctttagttgctttgtcagtcatcggctgccttttgcacgccacccaaggcacgattgcttggcaggtcggtggcttattgatgttaggctcgctggttggtgccgccattaccccgcgtattctcaatcgcttcgatccgcgcctgctgacagctatcttgcggccaattcttgggatcatgctcctgataatggcagtaacccaggtttggtaacgcaattcaactaacttaaccaacagttaatttttctgtgccaaacttgaaaacagcgcgattgttttccttcaccttggcaacgataatgaaggtgaataaggaaggggtgaacgatcatgcatattgatcaagtgattcgcgaacggcgcctagctttaggactcacgcaagaggaactcgccaacaaaattggcgtttcggccccagctattagtaaatgggaaaaaagggtgtcatatcctgacattaccttgctgccagcgttggctcgcattttaggcacggatgttaatacgctgcttactttcagtgtcacgatggatccagaagagagtcgccacctatacgaaaaactgatgacgactgccaaagatgccggatggcaagcggccgtcgatctggccgaagcgcagattgcacattacccatcagtgccaagtttgcagttgatgattgcggcttttttacaaagtctgaaaagtcaaatacctgaagcagactggccttcagtgtatcaacaaattgttgccatttatcaaactgcggaaaagagcactgatctgccacaggcacaagtagcggcccaaagtctcttttacctgtacctcaaggaaaaagattttgatgctgccgagaagcaattgacgctgttacctcctgaagtagtcgcctataacgccatggagccaaaattgaaattacagcgctgtcaactcaaggatgcttacattagcggcgaaaagttgcttggtactggcttgggggccgtctcgcttattctgaatgtactcactcaagttggtcttgctgatcaccagcttgctgttgccaaacgttatgctgacatgagccaaaaaatagacaacctgatccctatctccaatccttatacgctcgaagctcagttgaaagttgcagaagctagtaatgacccaaatcaagctgttacgatcattaaagaggtgttggccaatctcaatcaaccgcagccactggtattgcagcatttgaccccagccaaaagcaaggaacaggtctcgctcaaggaagctcaacggcaactgttgcaaatcttcaccgctgatcccgaaatggcttttctccaaaaaagtcccagctttcaacaactgctccatcaatacaatctctaacaaaatgacatcatgactaaaacacgaaaggccttcgacaggtagcaagttgtcgaaggccttttaatgtctcattcaattaaatcagttcgtaattttcccattattcagaaattcatacagataccgattcaccaatgggttgtgctcatgtagctggctatgctgcgccttgctattggtaatctcgcgctcagtataacttttcgcccgcccggcaacaacataccgcaaggaacgtgctgaattgactggcactcggccatctgtgcccttgcctaggttaccaaacagattcaaaacggcggcagttttgggaaaatacctgcgattgtcatacaacggtttgtaccgatccgacataacgttaggccgcccgtctttagcaagggtaatatgctgtccgccgttcattcccggcataccgggaaaaccgttaaacggcccggcaatcgtgattagtcgccgcaattgcggcatcccctgcttatctggcgtcactgcccagtttgcccaagcagccgaaccggccgagtgcccgacagcgttgaagttcttgataccataacgtttcttcagttgtttgagaattttacctaaggttggcgcatctggtcggccgctgctgaagacaacggcaatcagtgggtgtttcacactggcagaccaagaaccgctcacggacaactgcccagtgttggtgacggtatagcgtaatacttgctgatacccgggatgtttgctgagatcagcaatcatatctttttccgatccatagccaccaccaaaaccatgaacaaacaatgttggcgtttggtacgtacctgctgctcgcgcagtggacggtgccgacccgcgattcatccaaaaccacgcaccgccactaatgatgagtacgatgaccactgccagtatgactttgatccattttttcatgagcgtaagccctcgccttcatttgaagcttcatgctttgcattctaacacgatctcactaaattaaaaccacaaacgctcttgcttcgtctatcaactatttaagtgaattaacttgccaaaacacaagatcctcggtatagtgtattagtaatctaatacactagtaaggaggcacaccgtggaatttgacgataagatcccaatctattatcagatcaaacaatacttgtatcaggaaatcatcaccgatcgacttaaatcaggcgatcaactaccggctgttcggcaacttgccgcagacctaaccgtcaatgtcaacacggttcagcgcgccttgactgaactcattcaggaaggcgtccttgaaacaaaacggggacgcggcaatttcgtcacaaatgatatgaaagtgctaattgatatgaaaaaacgcgtcattgcgacagaattagatcgcctttatcaccaactatcagaattgaatttaagtgatgaggaaatgaaagacgcattcgccgcttatgttgatgagcaggaggtaaaacatgacaactaacatgatcacagtcaaacaattgacttataaacgcaatcgtaaagtgattctagacgacttgaatcttgacctcgttcaaggtcacttcatcggcttattaggtgcaaacggtgccggcaaaaccacattgatgcgactgttaaacggggtcgcgaccacttttcatggcaccattcaaattggctcatcagaaagtattgttgaacggaaacaactaagcagcttcagtgagtcgtcaaatggcgtcaacccaaatcgaacgctcaagcctagattgcataattaaagttaccacccagaaaatgtgaaaaaagacctgtccaacagccttgtcagtcgcatcttccgggctaactttagccgttaatgccgtggttgctctcactttaatgctcgccgttgtcggtgtcagggataccccagacaccgttacagttttggggttgcctttaaaacctgcgctttcaccgtgctaatagcttttgtatcagacccgacatatttagcaacgtactcgcctttttgatcaccattatcaggtgaaccggccgcagtaaacgtatagctatcgccttctggtgccttcttatcagctggattttgtgtattcaaggtctctttgtccttggcaaacttgccgcggaagaatcctaaataagcactatccccttgaagattttcggcttctagcagaacaccacaatatggtgggttcgtgtcattacccacatatgtgataccagactcaacagttttctgtccaaggataatcgcttctgaatctgctggaatgtcgatcaacgtaaagtcaacagaaacttcaccaacaccctcttgagaaatccaatactcaatgtccgatgcagcaaccttcagagcgttgcttgacaacccagagatttcagctgtaatggtaccgcctttgttggtatccccttgaacaacgattggttgtccctttggggcacctttagcgtcaaacggttgaatggtcatgcgtggaaaatgtactaaagtcatgtgatgactcctttctaatagttagcgtcataaagctgtgtgacagttcgatatcgccgtgcatcgacataccgttttgtgtcactaaaaaactcgtcaagcccctcggataattgcgagaagcctaacgagtacatgtgttttttgattgcttgttgtatctgcttacacagcatgcgatcaccggattgcacatcaatctggtaagttagctgttgtgctaattctttatcactggcaccaaaagcagctgttggaggagacaacggtttgatgagaacaaacgtttccttagaagctgcctctggatagtcgtaatacttaatcgggtactgagatactagcggatcaccacgtatctctgtataaatcgtgttcatcatgtctttcatagcagtttcctcaattcagccgcttctagctctttcagcttcggctgcatttcatcataggatgatcgaattttccctatgcccctcggagcatatgtgcgtccatttcgggtgtacccaaattcgttgagatgaactaagcgccaccgttgtcttgaaccatcactagaccacccaatcttgatattgcgaaccccaccacgaagccgtggtttgcccgcagtaatttcatttactgttgcgccagtatctcgatagcttgctgcagcttgtttaagttcaacaacggcatatcgtccagcgatggttaatgcgttgttgacatatttagcaaccttgcgatcgctaaacttttgacttagcttgttttctaagtcttctaaacctttaacgtccaaagttactgtcattgcttcgcccccaataccaacgtaatgaacctgttggcttcaaaatcatggcgaacttcttcaatctgccattccttaacttcccgatagcgagagtcgtcaataaacgctgtcattttgttgttcgggatgaattcacccttggtatcgcgaataatcacagtgacgcccaggtcaacctcatggctatcaagaactaccttgtccttattgcttggcgaataggcatcgcaaagacaaaagaacacttctttaggctcaatgtctgttggttcaggtgaatcaccagcatcttgagcatagaagtgaatcggtattcttaattttccactatcaactttgggaggctgatactgaaaacttggacgactagccattgtcatcgcccccctcaccatatgcttgtaaattcaagccaataatcgttgataggaagttgtcttcgaaaaattcagcctgatcattgtagacatatctggtgcgttcaatgacaagctctttgaattggttattggtgatatcagacactccagtcatgcgattaactgcatcgtacgaggcctgcagcatgttcttaagctcagcatcttctgacgagtggtaaatgctcattcgagctttaaattctgtcaaaagcgatttaacctgattatcattcatctggtgtcacccccgcaagtttctgtaaatcggcctttaatgcattgcttgggtaactgattctctttgaatcgaggtacgacttaaactgtgcaacggtggagttgctgtctgcccccgcttcaacgggggatactatttccccaagccactagctacagcattcggatcagtgatttttagtgcgtagacaagtgcggcattactatctgctggcgcaccatagaagaattgcttagcagtgaacagaattgcgtcctgaatggccaacgtttggttaaaatcagaaatgttcaagccaccagccatgtatgcatcataacggcctttaacaaaagcaatagccttaccatctggaacgtactgagattcgatgatctgaatgccatatggtaacgcatatacccactgaccattaacgttttgcatggtcattgcacgctcaaagtcaagcgaagcacccggctgtacaaccaaaatggtgttgccacgtgcaactacaggcttgccttttgcattcttggacagagccttaatgatggtcattagttcaaacttagccgtgtcggcatctttcagagttacggtgcccgcatcagccttcaccgggtaggttgtcacaccaacggatatggcaccttttgacggatcgcgatcaagcccaattggcttgcttttaccatcaccatcaacaaatgctgattcagatgcggccgcaaacgcttcggtgatttgggtagtaacgtatgtgcgtacccatgccggaccgaatgaatcaagatcattagggagcacaacaaatgctgtcagtttgctcatctctgcatcaacagacgtgaacgtagcatcaagctgcccttgaatgttgccgaaaatcttgccccatacagcggcacctttagcatcagatttccagattttcaggcgcacaccgttgttctgcaaaccaattgcttgcagcagagggtgattagaagtcatatcttcgaaaatcttatccacagtggtttgtggaataagctggtcgtttttgaacccagtatcagtcgagatatcattgaagaatttaacttcatcttgtgtcatcttcacatcaccggtgttggctgcaatgatgctgtcgatttcctctttggtcttattcttcagattttcttggaagctgttgagatcagtggacagtgcgtccatcatttcaccaaacgccttgccttgggcttcagcatcaccaccacttttgacgatgtctgcgaatgccttttgtttttccgcaaaggtatctaaattcttaaagctcatagtcatatttttatgactcctttcgtattaaaaaaggaaccctgcaaacttactttgcttaggctccttatgagggtttaatttgtttgcaagcttttctgctagttcatcagtgtcgacatttagaactagattactttgcttgtctttgatttctcgatactccttaagagcatcaacgatctcttttgtcagcatcgtttttggccccgctaccaaggtaggctgttcctcaaacataatttcatcaacaaatccaatatctttggcctgttgtgctgacatatacgtttcgtccgccattagcttgagcatctcatcagctgtttttccagtttttgatgcatacaagttagcaaattgtttatcttgcattgaaagaacatcactgtacttgtcaagatcacctgagtttccagaaatgccagagactgacacacggtgaatcatgaatgtagccgtcggtgccatcataatcttgtcagctgacagtgctactactgtagctgcagatgctgcctgaccgataatcttagccgttacagttccgggatagtctttcaaaagcgtcgcaattgagctcccggcggtaaccaatccacctggactatcaatttcgactacaacgtctgaattatcagtcggaagcatttcgcggatcgcgtttggagctactaaatccagtccccatgacttcatgacactcgcagtctcatcatcaacaagctgagtgttaattggaattactgtcgtcatcattatcacctcccttcgttgctaatcccgttggaatagcgggtgtttgctgatttgatagccaaatggcatcaccaccggccaaaggtttcaatccttgtgcttgtcgccgttcattgatcgttttcgcattaaggtcatcagtttccggctgaggagaatctgtgatagtttgatagttcttagtcatgtaatacacgtctccgccatctactggttcgtatcctagacgagcacgcacttcatttcggcttaggacaccgaccgctgtgatcttatcaatcgcttctgcttgcttgaatgggtcaggcttattcagtccccaaacggtgaccttatcttgatcatatgaagactggcttacagccttggcatttaactcatcctcaattttttgattaagcggagcaatgcaaaaattcaataattcttgttgattctgatcaacttccgcctgtgcaccgtggatcaatgctggtggaattcctagaatctctgcaacgctgtcaactgcctctttacgtgcagcagtaatgtcagaaaatgcctgatctgcgccactatactggctcgaaacttcgtcgtacttaatacttaatacccttttgtaaaggcacaattgcaatgtcgttgtctctgaatgcactaaagagcttatcaatgaatttctgagctggattctctttcttattgccattcacatcatctttaggcgtttggctgtcaaaacttgtaacgcctgagaaatccaccgttgctcttagctgcttgttacgcatggcaaaactaatcatgcggctgaataaattagcatagtcggacaataactgatttgtgtatgtggttaggttgtcgttgttgtatttgataaaccaaacgtcatccattccaaacacacgctgaaactgatagtcattgaccaccactccagaaaatgtatcaggatataccgccttgacattatgaacatagctgtcagcaatcagtaggtcgcctgtatcgtcctgaacgaccagcacttcattatctgtaatgagtttaaagatcagttcctgccaaaagctcgttgctgtttgattatagtttggtcggacatttagcttgtaataaagcgcaacgtttttagttttgaactcggactgagaaaccgttctggctaaaaaagatgcacacgtatttaacgcatactgtttcaggtaaacttgcgtctgctgtccgccaattaaatcaagatcataggcaaaactggcatctttacgttgagtaaacagatcaaataagttgaagttcacgctttcacctcctttcagaagtcaaggtcatttaaaaacgccagcgattcactgacgtccacatcggataattcatttgctcggtacaacgtatattcaaaggccttaaaaccatctgtcttacgacgagtttcctctttcttctcataggacttgtttccgtttgctttgttgaccttaaccaacacattttgcgtgttccagcgaagcattggattgtctccccaaataaatctgtggcgcggaaacccatcgtcgataatcgatgcgagcaacccgtcgattgaagtagggttgtgaataatatctacatcgaagccaccgtcttcaaacatttttcgcataatctgggctcggtaattatccatgatcacctttttgatgttgaattgctgagccatctgttgcatccattccagcgcatgtttcgggtccatcaatggctcgtcgatgacttcaaccaggccgctacgttcccagtcatgcagaggaatattgattcgctgattaggtgtggcaatccgttccttgcgactgtatgcgtaatatttgtcacagaatccttttcgcgcccattgcttttcgacagtcaccagcttgtccttataacgaacggtaacggcggcagcaatgaaatctcgtacactggcgaaatccacagctccaatcgcttctcggccatcaatatctttggggatcggctgattggtcgctaaaatctcttcccagggcgccacattactgttcatcgcctggctggggtaatccatccttttggtcaaaaactcttcacggccgcttggcgcctccaccaatgcgtcgtagtcttttttaatctgccggtataacgtttttccgtatgtggacaagggcttgacgatcattggcactgacttttcccacatcctgggattgtctatttcgtcctcactgtcaatcttgcaaatccatgggaacagaaaatcaggcgccgccttgcctttcaaaacgctttccgcttgtttcttcttggtgtcaatgaacccatcgcgaacgtagccatcggtcccaatgaagaaaacacgggggtttgccttcttgccaaggccagataagtgcacttttacattagaatcgtcttggtattcgtgaatctcgtcaaaaataacaaacccgtctcgcaaaccatccttggtgttaccatttgatgtccgatatttaagcgtcgagtttgtccggcgcgatttgatctgggtgtttgtcgcgtaaaacgcgcggccaagtgctgggctgctgtccacgacgtcttttatttcggctactgatgtcttcgcctgttcttcgctgttggcaatgatcgatccgttatatccacgaaccccattgaactccgaaatcaaaaatgtgccgagcgcagagattagcccatttttaccggacccacgacccatcatccacaaaaagtcttcataataattggtcccgtcttcgtgatacaaaaaaacgaacgcgatcaagaacttttggaacgactgaagtttgaaaaaccacttctcactgaacttaatgcatttctcaatctgttcgttgtcaaaatgcagtgtgtcgtcagatagcacagacttttttagataatcaacaagctgaatacgttccttattaaacagcaggtgtccttcttcataatccttgatgtaatcatcaacatacttgttatgaatcaaagcagatcatcaggatcatatcccgtgccctttccatcaattccaggcggagcggacaatcccatgtccttgccaagtgaaattaggcttgcattgatcttgttcatatcagccaaagcaggattagatttagtgaaatgctgactgccattctcaatttcaataattggctgcttgatagcttctttttgaagcttgtagaacatgtcaaccattgaaacatatcggtccaccttctcggtttcaattggattagtcttgtctatctgagacaagagcctgtttttaagcttatctagcttgtccatggattatcacctcccatttttggtatagggtaccccccctcgcgcgaaaaaaacgaaacatttttgcggaagacgagcccgtccaccggtccccgaatttcaaaatggcattgaattttttgacccgggggtctgttattttaccatctctcatcgctggcatactgattttttggtctccccaaacgtttataattgaatcgtccgtgtcgcttgttgtgacagtcgcggcagagtgtgcgtagattgtctggatcaagcgctaggtctggacgttcctctagcgtcttgatgtggtcaatctccagtgtcatgtcattgccagtagtcacgcgtccttctgctttgcaccattggcattcatagtggtcacgttcaagaacttgttcgcgcaatgctttccattcaggtgaacgatagaagtgtgcacgaccagcgtggctgtgaacatctcccgtataagatgtgttagtcatgcccatcactcctcatgcaatccgatgacgattgccaatccgataagcagtgtcaccacagcaatcataactattgctggcacgaatactagcagccaactccatgcgatcaaaccgaatagcttagccagcacgaatattagtgtgaggagtaataggaaattgcacatgctaaattgcctccgtgtattgtttgatcttgtcaacctgcgagtcgcaccacgtttcgtgggtaccgtctgccttgtagatttttacgactggcattgaacgataatttagcttgcggaaccgctcgtagtcgtccgcgtctgctgtgatggtttgcactggcatgacctgtgacagcttgaatactgttcgccgacacttttgacaacccggcctcgtgtagataattgcttgcatgtgtttctcttctctcgatagtttctcaatgattgatcgctctgtactgcatacgtaaccgtatccgacgcgtttcattccattagttgagctcataggtgcacctcaatcgcgtgtcctcataaacgaacgcatacagcaaatgctttcctgtggtgaagccattcttaatctcatagggatcatttggctttgctgttccaagctgtcgccacataatgccacgatcatctttaaaccgctcgctatgatagtggcctgagtgaagctcgtatgtttttgccatgttgaatatctttttgtactcaaatggaaaaagtcctgtcagcttgtccttggctacatctccgtgtgcgagcataatgccaacatgccctagcaagtatgcacagcgccagtcggttgccaaattactgtcatttagatcaacgtgtacttgtggatagcgatctatcagcgcataaagaaaagcgtattcgagatcacctgaatggttaccgaacacgctcttgattgagacgcgattgctatattcaattgccagcggaacaatctgatcaaacagcttcacagcatcatggaatgcctggcgcatgtttgcgtgatctagttgcgttcctctaaccgtttgtgttgcatgaatctgatcactatggaatagatctcccaattgctcgatcacaatctcgctgtagccgtccatgatgatctctctaagttgactcaccatgtcttttagatcggcgaatgttgtccagccaaaatgcaggtcaggcaatgggatgactaagttgcgatcgcccgatttcttcatgccataattgaccggaatgattttgtcgttgaacgcttcagccatttcacttatcgataagccttgttttggctttacgcgaatatgaatgctgtactgcggaactgtgccgtcttcggtactatgctgctcatacactttgtagtcgcctaagaccatctcgaacttatcaggatcgtatccacacaactccatcaaagtccgtgggtctttatttggctcatgcttgagtctcattaaggccgtgactgtttgactaccatcagcattaagagcgacttttctatcaacgggttggctctttctatctgttttcgctgaatcgtattcattcttcaatggtttttggaactcgataccaagccgtcttgctttgccctgaagcgcgtcatagctaatcccgagtttgtcggctgtttcacgtctggtaaatccttcagaggcgagcttcctaatgccgctgatttgttcatctgtccattgcatcttcacttatatgtaactaataatactcccttctcactttagttacaatagggtacaccctattgtacttttagtggtgtttcccttttgtccactctttgacaaccaacaattccatatctttttttaacgctgattttaaattatttgtcctgccttaaatggtcaatgtcgtgtccatctgtgtttaacttaaaatctctttttctcccttgcgcgtcccccatcggcaccttggtcagtatatctttgaatcgatgcttcaacagatacttcaacgtttgaaataatcagatgagtatcaatcctcatgtaatacaaacggccatcgtattgatacttagtggcttgtgaaagctatacaagcactgatacagcaagattttagcaacgggcttttaaatggtggtccctcagcacttgctatacggacaatcctgacaacacgaatcaagacaaaaagttgaactttaaagaaacaaattcattttatacaacaagtacatcaaaaatatcgtgctttcttgtgctcttaaattaattttaatccgaactaataaactgattacgcatttccatatcagtgcttgtgacaacatcaggccagctttcaccagccactgcttagtgatccgaatggaaaaataattgtagctacaagagcaaaaaatattagctatagtctttttttcgatctttattcaaactaaaatccccagataagaaagtttgcattagtttttcacgttaaagggggttgacttttttggcatgtgtaatactctagagacctattgttattttctaattttggaggaggtgctgttttgcttagttataaagaattggatactgcaaaacttcaagaaatttccggtggatatagctattttggaggttctaatggctattcttggagagacaagaggggtcattggcattatactgttaccaagggtggcttcgaaaccgttattggaataattggagatggctggggtagtgctggtgcaccaggacctgggcaacattaatgtttgggaaaaaaaaggaaataaatgtacaagatattatcagtttactttgtgactttatccttgataccagcatcaccgatcgtgaacgaagaatagctatcatggcaaaggctgatttggaagctaacaaatatcccgttgctatacttaataaagttatagttagttttcagatggaagctatgaaaagtggcctttcaacatctgcttccaagctttacgataagatttaccccgtcttaattgcttctaaaccctttggaacgaacttaggttatattggaatgcacagtacgtacttagactaatcaacactatactcttagttctaactcaatagcattaacaatattatttagaatctctggaacggtatcctgattttccccctgtaagttcagtttttaccacactaaaaactcgatggcatttaaaccatcgagtttttttgattaactcgggaaagatttttaaaaaatgaagttagtcaatttccataagaaagaaaatcggttctggtgcaaattttcctcgctgacttgattttagtatactgggtgccaagatcacttatatgtaactaataatactcccttctcactttagttacaatagggtacatcctagtgacttaatttgcgcaatacacatattagttacttttagttttttagctatgaaaaagaattttccctcaaaagtagtaacagtttcttaaattgcataatgaatgttatcatctgctttctaccagcatttaccatgtttgaagagttgctccactttaagagctaggaatccttgataagtccagttgtaaatcctatgtttcgtaaaatgaactgtgtttccccctttctcaaggcaagccaagatttagtttttcagtaatcaccagcttcaacttggatataggaatccagcttttatagcaatctgatttaatcttgttcagcggataatgtcagctggtggctgtacaggtgacgactttgtactgccagttcatctaattattgggacagatttcattatcgcttaatatagtgacttgaagaacggtcaagtaacgctgcagcaacggttcgaggaataaaatttagctagttaacaaaccagcgaaggctttggcctaattacaaacgtaagttcaacaccaataaaattatagtttacatgacttatatagcgattctgctcgctcgtctataaaaaccttaaacagtttcataatatggcaccgttaagaattaaaaaatcgttccaagcataacagaagtcgactacagatcattggaattatatctcattttttttaatagttcgatttttacccatgagctgttgacatcaaatttagtctttgttaattttaggtatggcaaaaaatttgtcataaaattatggaggtgttgatatgaattcgattagtagtgcctcaaccacactgtcaaatgatgatttggcaaaaatcgctgggggtaagaatcaactagcctatgatattggtcttggcattgggcgaggaatccacttgtttctaatgtttggcggatcttttaaggggaggccttaatatgaataacaattgtttaaataaatacttgattttagattccaaatctttagagaaaattcatggcggttctcataatagagcttggcacattggtcacggagcaactactggctggagtgatctcggtgacggaattggaagtatgtggggcggtatctggaacggcttgaacggacattaaatatctgcctattagaaggcgaccaatcttcttttcaaaccattatatgtggttggctaattcaatctcttttaatttgctttttattgtcgttcaatattaagccttcaaaaggagattgcgttagcttttttttgccattaagtcacttccaacaacaatcttacagaataggaatatatttttatgaatcctagcaacgggaaaatattattaaaaattttgcttctttgggctatcatttttttgtttgataactttatttcgagcccattattgaattatatgcttccttcgtttaaaacccatcttattttagaaattatttttaaggtgctcgaactattagttgctttttctcttaatcaatgtttatttaaacaaaaagttctatggaagggtactattagttataaggttatgcttttttcctcacttttaattttgcttattcttttcgcatcattcgcacaccctagcagaattattgaatcattaacgatcggtgttattgcagcaatctctgaagaatatttatgccgtggagttttacttggcagcactgcacaattaaagtatttcacatccaaaaaagggcgtatcctttttgcaattattttctccagtctgctttttagtttttatcacctgggaaacctcaggtctcaggagtttacctcaactttgcagcaaatgattgaaaccttcggaatgggaattcttttaggggttctttacgtcaggaccgcaagcctctttattcccatgattgtccacttttcagccgattattttgttgtggcattttccaacaatatatatgctgggccccaaaaagcatcttttactggatcaataattcacttaattatctatttaatcttagcatgggtatttatggactggtccagtaaaaaaacattcaagttactaaccaaatgaatcaataaagttcattgactatcaaagattggagcttaaaatcaccttgtcttctataaaaaggttatatgttcaacaagtagatgaaaaagactgtggccttgcctgtcttgatatgattctcaaataccatggttctgattactcaatagcacacttacgaaccttagcgaaaacggacgacgaaggcaccactgccttgggtattgttaaagctgctcaggacctcgactttgaaacccaagctgttcgcgctgatatgtctctttttgatgcagatgatattccttatccctttattgcccatgtgctcaaaaacggcaaactattacactattatgtggtttttaaagccacgaaagatcatcttatcattggtgatcctgacccttccgttaaaatgaccaagatgaccaaagaacgctttaaaagtgagtggtcaggggttgccatcttcattgctcctacgcccgcttatacgcccaaaaaagaagataagggcagcttattagcctttgttcccttgatgattaaacaaaagcgtttgattatcaacgtcattttggctgcacttctcatcacgatcattagtattgccggatcatacttcttgcaagggatcatcgacacatacttacccaacgctatgagtagcacgttgtccatcatagctatcgggcttattattgcttacttatttcaagctgtttttacatatgcacagtctttcttgatgactgttttgagccaacgcctgatgatcgatgtcacactaggctacattcaacacttatttgagctccccatgtccttcttcgcaactcgccgagttggtgaaatcacctctcgctttactgatgccagtaagattattgatgctctaggaagcacgattctgaccatgtttttggatatctggattgtcatcgcggttggtatttttttaggcattcaaaacaccaccttgttcttaatctcgttagtctcactgccgatctatattgtggtcgtatgggcttttaaaacgccttttgatcgtatgaatcaagaagcaatggaaagtaatgccattgtaagctcctccatcatcgagagtttaaatggcattgaaaccatcaaatccatgagcgccgagcgttctagctatgaaaaagtagatcatgaatttgctggcttacttaaaaagacctttgcttaccaaaaaacagatcagcttcaacaggccattaaacttgctgtcaaactggttcttaacgtcctaattctctggattggctcgttattagtgatgcataatcaaatgacactggggcaacttctcacgtacaatgccttgttaacctacttcactaacccacttgaaagcatcatcaatctacagccaaagcttcaaatggctaaagtggctaataatcgacttaacgaagtctacctagtagaatctgagtttgctaaaacgcgccccatcaaacaagttcaaagtctccaaggaaatattcgatttgagcacgtgaactttaagtatggttatggtcgaaatattctaaacgatattaatttgacaatttctaaaggttcaaagctaacaatcgttggtatgagcggttctggaaaaacgactttagccaaacttttagttggtttttttgatgttgcccctgatcagggacaaatcctaatcaatcaacataacctatctgaagttgaccgcacgacgcttcgtcaatatatcaactatgttcctcaagaaccctttattttctctggaactattcttgcgaacttaacgcttggtagtcgtcctaatctcacgcaagcagaaattgaatctgcttgtgctgccgcagaaattcaggcagatattgaacaaatgccacaaggctatgcaacggaattaactgaaagcggcgcagccctatcaggtggtcagaaacagcgactatcgattgcgcgcgcgttactgtcacctgcacagatttttattttcgatgaatccacaagcaatctcgataccattactgagcgcaagattgtcgaccatctgctaagattacctgataaaaccatcatttttgtggctcaccgtttaaacatcgcagaacgtacaaacaacattattgttcttgatcatggccaattagttgaacaagggtcacatattgagctccttcaaaaaggtggttactatgccaaactagtcaatgagtgaggtgccccttatgtttaatactgaaaaattagaaaccactgaattctatcaacatcggttcaaaaacttctcgacttacttgattgttcccgctgtgatggctttagtgatcgcgctcgcctttgtccttttcgccaaacgtgaagtcacgattacaacttctggcgaactaacaccggttcaaaaagcagtgagtgttcaatccaccacaaccagccggataatcgaaaatcatttaaaagaagggcgcttcgtaaagaagggtgatcccttagtcacttaccatgatgtcaataacccaacgcaacttaaagtactagagacgcaaactaagcagttacaagatcaaacagcggtcctagataagtacaaggctggcttaacaagtaaccaagacacctttaatcaagatgacccatttggctatcgtcaagccttgcaagactacttaagtcagcgacgaatttatgcccttggttctcagcaagtgagtggacaacaatcaagtgaaaacagtaaaacagccaaggtggggcaactcttacagcagagtatcgcctcatctaatcaaaacattgctgcttaccaagcgcttttaacggctatacagcatcaatctggttacaatgatagtcaaccatacagttatctttacaaaagctttatcgccgaaagcaaagatatgaccggatctgacttagacaaggttaaaacttcctatatcagtcaaattgacgcaaaaatggataccgaaaaaagccagcttgagagtttaaagctccaacaggctaataatgaagctagtgatacgagtcaacagcagttagccgaaaatgagcagaagatggcagccttacaagcttctcaattaaagtcagtggctgatcaaaaaaatcaagctgcccaatcactaacagagcttaacggaaaagttgctattctgaaagatcagacttctgatgtaacagttaaagccccaacatcaggcactttacacattgatgctagtttgcaaggcaaacattatgtgccaagtggcactactttagtggctgcttaaaaattctataattcaggcagttaagctaatatatgcattagataggtcttttttcacattttctgggtggtaactttaattatgcaatctaggcaatgcatcgttaggagtgaatcatttgatgaaattaatttcttggaacgtgaatggcttacgagctgttttaaaaaaagactttatgactatttttaatgaattagacgccgactggttctgtttgcaggaaaccaaaatgcaggcaggccaagttgaactcgatctgcctggctatcatcaatactttaactacgctgaacgcaaaggctattctggtacggccattttcaccaaacatgaaccgctcaatgtcacgtatgggatgggcgttcctgaacatgatactgaaggccggatcattaccttagagtatccaaacttctatttgatgacggtttatacgccgaactctggtggtgaactgaagcggctggattaccgccagcaatgggacaaagattttcttgcctacacgaaccaactcgcggccaaaaagccgctcgtttactgcggcgatttaaatgtcgcgcaccaagaaatcgaccttaaaaatgacaagaccaatcaccacaacgccggctttaccgatgaagaacgggctgactttacaaaacagttagatagcggctttatcgatacattccggaacttgtatccagataccgtcacttactcatggtggagttatcgattccatgcccgcgctaataacgctggttggcgtatcgactactttgtcagcagccgcaacttcaaaccgtatattcaggatgcaaaaattctgaccgacattatgggcagtgaccactgtccagttgaacttgtcacaaaagacttgatttaggagaaaatacgatggactttatcgccatggatttcgaaaccgccaatcgcaagcgagcctcagcgtgttcattggcgctcgtggtcgtccagcaaaataaggtggttgacagtttttacacccttattaatccgcagatgcagtttgatgcccaaaacattcacattcatggcatcacccctgaaatggttcaagatcagccaacatttgatcaagtttggccgcatattcaaatgttctatacgccaggtcggatcgtgaccgctcacaatgcaccgtttgatgtttcggttatgcgactgacactggatcgttacggcattgcggcaccgcgctatcaagtgattgacacggttaaaacctcgcgacaatttttgccgaagttgccgaatcatcggttagatactgtcagtgccgccttgcacattccgcttgagcatcaccacaatgccttggcagatagttatgcctgcgcacgaattttgatcgccgaaaatgagcactttggcgaagcgcggattaaaagcatgatgaagctttcaaaagcgggttgattcaggtacgactggcaaccgctcaacgtttgacccgactgtgcgctcattaactgctaaatacatctgccatgcaaaaaggcgactccgctgaggaatcgcctttttattttgcctattttgcctaattatatttattttttagccacaccgcgttccgccttccaaatgctaaaggaggtcttcattgattgccacaagcccgaaccggaatagaccaagacgttattccgataaaccgcgaccgtaaagaaagtaaacaaggcgagaaagacgacactaataccgacactgacccatgcctgacccatacttgctcggcctagcgacatctgcgttggcataacaaaaacattcaagaaaggcacgtagcttgttacttgtgccagcgtcgaatcattggcttgggcggcgattgtaatgaagtagccgatcatccccagcatggtaattggcataacagattgctggacttgttcctgattagaaacaagcgagccggttaatgcagccaagaccgaataagtgagtgtaccgatgataaagaaaagcgcaatcatggcggttgtcccagaagctagtatcgacagatccacttgctttaacaagccggcaaccattgtttgatttttcaaaaattgccagccgataacaccggcaatcacgtaaatggtagattgcaaatttaatccgaatttttggacaaatttgtcagcataacctggagagcgtctgccttacaagcagagggtcacaggttcgagccctgtatcctccataacgaaaacacctaccactgcggcaggtgtttttcttttacctttttgaagttggacgggggcgtccaacgcatgagattcgacttagtttaaacagctattagagggggctgattctgacaataaaaacgccaccactgattgtggcgacggttgattagccgtgcatgcgcgctagatagagtaacagcgtcgcaatgactgggctaaattggtaaaggtagctgggtactttaaatggtcgacggctgttgatgagcgtgacaaggatgatgataccgccgatagctattaagttgagtcgttgtaaccagtaaccgataacgacggtgattgccaacaagaccatatctgtccacttgggaaaatggttggcccataacccgattagtgctggcacatatagtaatgccaagtcgagcaacatatcctgactgagaaaatgcaaacccgcgtaaataagtaagatttggaataaaattgcttggccaaaagcaatggtaccagcccattgcttggtaactttttgtgtgcgcaacaaaaatgtcaacaggagctgaacagcaactaatggtaacaagatccattgattgatggcaccaatgataccggtaatagcggcaatgattagaactaatgggtaacgtttaacgaccattgcagccgctaagcaaatgcccatgagtaaaagcgcgatgatttgaaaatgccatgtgatttgcaaacttagcgcgatcagaaacggataggcgagtatttgtccgataaaggccgctgcaccagcaccttgattgatatttttcaaattgattatcctttctatgatgcttccattttacaaaaccctgagacggtaaacaaagattttcggaaattttacatcttttatgttatgctactagagttgcaaaacattcccgatggggttcgtcaaagctatgacgaacatgccttgtaacctaaaataataagggggaaacaaaacatgcaggaacgccatttatttacgtcggagtctgtttcggaggggcatccggataaaattgctgatcagatcagtgatgctattttggatgccatgcttgaacaggatcccgattcacgagttgcttgcgaaacgacggtgacaaccggtttagtgctggttgtcggtgagatatcaacaaaggcttacgttgatattcaatcagtggttcgcgggacgattaaaaagatcggttataccaaggaatcaggttttgatcctgatagtgtcggggtgctggtcgctttggatgaacagagtccagatatcgctcaaggggttgacgaaagtcttgaagcccgtgagtctgatactgatccgcttgacaaaatcggtgctggcgatcaaggcatgatgttcggttttgccattgacgaaaccgaaaactatatgccgttaccgatttcattggcccacgcgttaatgcgcaaaactgattcattacggcacaagggtgaaattagttatctgcgtccagatgctaaggcgcaggtcacggtggaatatgatgatgatgacaatccaattcgggttgattccgttgttgtctccgtgcaacatgatccggatgtcacgcttgaagaaattcgccgcgatgtcgaggccaagattattcgcactgtgattcctgaagctttaatggatgatgacacgaaaatttatgtcaatccgactggccgctttgtactgggcggtccgcaagccgactctggtttgaccggacgcaaaattatcgttgacacatatggcggttttgcccgacatggtggtggtgccttttctggtaaggacgcgacgaaggttgatcgttcggccagttatgcagcgcgttatattgccaaaaatgtggtagcagcgggtttggcgaaacgggttgaagtacaattggcatacgcaatcggtgttgccaaaccggtttccgtgtcggtgaatacatttggcacatgcgcagtatcagaagatgtgattgaacaggcaatccgtgagaactttgacttgcggcctgctggcattattaaaatgttagacctgaagcggccgatttatgaacagacggcagcatatggtcattttggacgtacagatgttgatcttccttgggagcacttgaataaggtgcagactttgctcaagtaccgagattagcgagaaaagaggcggccttagtcgagaattattctcggctgggtcgttttttcgtgcttatgaggggcttctcaagactaacaacatcgcctggcaactcagaagggatatttatgaagcaaaggaaaaccaatgtcgcactcgtaacggcggcaatttttattggcacatttatgacggcgattgaaggcacgattgtgtcaaccgctatgccaaccattatcggcagtttacatggggttcatttaatgaattgggtcttttccatttttctgttgactaatgcaatggcgacgtcgatttacggcaaactgagtgacaaaattggtcgcaaaccagtttttctcattggactaacgatatttgtcattggttcgttgctatccggtttgtcacaatccatggaaatgctaattattttccgcgcaattcaagggattggtgctggggctattatgccagtgacatttacgattatcgccgatatttatccattcgaaaaacgagcaaaaatgctcggttttaatggctcgatgtggggaatcgcttcggtaattgcgccgttattgggcggttttatcgttgatcagttaagttggcactggattttctttattaacgtaccgttgggtattttcacgtttggccttgtgtggttctttttgcaggaagatcggcgcagtgtccggcagccgcttgacatgcgcgggacggtttggctgctggtggccttgttggcgatgatgtatggctttcagacattagctgagcccaacggcatctggcagttagttgccatggcaattgtggctacgctgggcttctggcgtttttggcaggcagaacgtcgtgcagtcgatccgatcattgacttgaaactatttgaaaatcgtacttttgtgattcataatttgatcgccgctttgatttcggggttcgtgattggatttgaagtctacatgcctatgtggattcaaggaattcgcggcatggatgcttcccttggcggctttgccgtgacccctagttctttgatgtgggtcgttggctcttttgttgctggcaagttattgggccggttccaacctaagccgattctgacaggggccatgatttggctgcttggcggcagtcttgtgctggcattagtgccgcaatcgacgccgtattttgtctttctgctagttgctggtgccttaggattcggctttggtttggtgattacgattactacggtaacagcccaggccgttgtggcgcctgatcaggttggcgtggcaacgagtttcaataccttgtctcgaacgttggggcaaacactgatggtatcggtttatgggattgttttgaatctgcgtctgactcaaggtatcgcggcagatagccggctgaatagcaatatgctcaacgaactgattaatccacataccgccaaaaatttacccgcagcagtgttgccaactcttcggcaaattttgtatgaaggtctgcacaacatttactttttctcgattatcatcgtggcgttggcgattctagccaatcattttgaagcaaaaagggtgctgacaaaagaaacaattcaggagtcgaatgaagaaagctgaatcaactgaaatgtcatacaaaaaaccggattctatttaagaatccggttttttttgtacgctgatatcgctctcgtttgccgataaataactgaaattaaaatggactgaccactcgatcggtatgatcttcggcggctgcttttttgacaggttgtttgtacaatttcgctgctttatcggtgacttgcgcaatgacatcgtagtctgggtcattttctaacgggccaaaattgaacactgtctgcgttgcttcgcgcttgatatcttgcaatctagtgctgataaggacatgtagcatatctgctttttgatgtgatcgttcgatttcttcactggctttggctaaggtatacccttcatcaagcattgtcttgatcatgacgattaaggtgatgtttgccaaggaatatcgtttattgccattagcgtcatgcctgcgagaatgaatgagctgcttcttttcccagtatcgaatttgcgttggggtggctccggtgacgcggctggtttcgcctatgccgagtgaaatatcgagtgaacgtaaacgtgcattaaacggtcccatgacatagcatcctctcttgaaaatgcgctcactggcgcaagaaccgattcataaggactgtggtcgtcatgaccaatatccggccatcacggccaagcccacttatgatccggtttctcaacgcgcctgttcacgctattaccttgacatttattaagtttaaatgtaatattttctattgtcaatattacattgtatgatataggaaacatgaaatcttataaagaaactaggcgaagttatggacgttaaagatatcaacgggaaacacgtcaatgtaccaatgatggtcacgaccttgatcgttggaacgtttattacgattttgaatcagaccattctatctaccgcgtttccaacgctgatgaaggccttcaacatttcaactgcgacagtacagtggttgtcgacaggcttcatgctggtaaacgggattatgattccagtatccgcatatctgagtgcgaaggtgccatcaaaatggttatacatgagtgcgatgagtactttttttgtcggcacattggttgccttcattgcaaatagttttggcgttttgctaattggtcgattgattcaggcgcttggcgttgggattacgatgccgttgttgcagaacatcatgatgtcgatttttcccccgaaccggcgcggcgctgctatggggatggctggaattgcgattggggtggcgcctgccatcgggccaacgctttccggttatgtcatcgacaatttcggctggcgtttcttattcggtatgattctgccaattgccggtctcgttattttggcaacattgtttttcttcaaaaatgtcttaccgttgtctgatcctaagttagatattccttccttgattgaatcatcaattgggtttggctccttgctgtatggcttttctgaagtgggcaatgatggttggggtgatccgatcgttttaggcacgatcgcactcggcgttgtgtttatcttcatctttggttaccgtcaattgcacttaaaagaaccatttgttgaattgcgagtgtttaagagcaaaatctttgccttatccacagtcttaggtaccatcgccaacatggcgatggtcggggtggaaatgattttgccaatgtatttgcaaatcattcacggcaagagtgctttggagtcaggtttgacattgttgcctggggcgattttgattgctttaatgagcccggtcactggtcaagtgtttgatcgcgtcggcgccaagcgccttgcacagttaggcttgttcttgctgacgattgcaacattgccatactttttcctgacagaaagcacgccttccatttttattacggtgatttatgctgtgcggatgtttgggatttcaatggtcatgatgcctttgacgacgaatgggatgaacgccttatcacctgatatgattcgacatgggacagcggttaacaacactgtccgtcaggtggcaacttccatgacaactgctgtcatgatttcagttctgtcaaacgtcaccaatctggccaaaccggcggccagtttgttgaaaactaatccgctgcagtataagcaagacttttttggcgcaacacttagtggctaccacgcagcctttctgctggcagcagggttcagtttaattggctggatcttggctttcttcttgaatacccacgcaatgtcgcaagaagtgacgatcaaaaatgaaaagaaggtgaaggcatgattctatggtttttgggcctgacagtgatcggcctttatctcagctttattatgatgaaacgctccagtttgcgcagcacgttaattgcggtcttcgggattggtgtggtgggtagtctattgctgattacgttgaatgataatgcgcattttggcatggtcaaacgaacaacaactgatgagcagaccatctacaccgcctcaccgaatgcacaactgccaatgttgctaaaacaaaacattggcacggatggcaagcatgttgtctacatttataaaaccgatccgaagaaaaaagcggttcataccaaggctgatattgttgtaactaatcgggtgacaacgacagcgaatgccacagcttcgttgacgagcaaaacaactcggtggcaatatcaaaacgatttttatggtgcgttgttcaatcatgaaggggctggtcaattggttgctcagcacaatcaattggccatcccaacaagctggtcagtactgacaacggctcaggccaagcagcttggtaaaaagttggccgccttgcagcaaccaactgcagagcaaaaagcgtcattggcagccgcagtcaaggctaaagctgctgcgctggtcaaggctgatccaaaactagcagcagatccgacagttttagcgaagcaggctaaggctgcagttgaacaagcaatgattcagcaggctgttcgtgaagtgcaagcacaaaaatagtctgatgccgcccataacgtggtactagggcaaacatttttcgtaacattatcttgacgaatggcttttgtcagccttctaaattaaaaaaagcagaccgctattttttaacggtctgcttttttgattgtttggcaactcggtttgtcagataaggactaaaataccaccaactcaccatcagcaaggcaaagccaagtgaaaatccagcaaagacgtctgtgggatagtgaacgcgcacgaagatccgagaataaccggttaaaagaatcatgctactggcaaggcaggtgatgagccatttggcggattgacgtttgagcagtgcccaagccaaaaggatcatggaaccgtaaaagatcatcgtgccactagaatgcccgctaggaaaactaaaaccgccagcatgtactaatgcccgaatctgaggatctgcaataaaaggtcgtggtcgccgaacccaatatttgattccgacgttaacgaggctcatcaaggcccccatactggctgcaaaaagtgcggcgtaacgataacgcttgagcagtaacaccacggcgaacgccatggttaaaaggactaaggatgctggattgccgagactggtgattaagatgagtaagggtttaaaagtgacaggatggaactgggtgacagcagcaattacctgttgatcaatggtatgaatccatccagcgttatttagaatacccgtcaataacgtgatgaaaataaataaagcaattgctgcaagatacaatggttcgggttggcgttttagcacttgttgcctcctctacaaaacgttcgcagtcgcagaaacctccacataaggaccttagacagaaatggccaaagtccagccatttctatctgagtccacttatgttccggtttctaaacgtgcccgctcacgctctgaaatcgactaatgtcataagaatagcacaaacaccattgaaccttggcaatgtttttgctatgattgacgcaatcatcaaacgaacaaaggagtagtaagttagcgcgggtgacagagagcaggcggtggtgcgagtctgacgaagcaaagaccgaactgacctttgaagttgctggggtgaaatcagtagccacagccggccggaccgttatctcctttgagcgctgtgaaagcagaacttaggtggtaccgcggctgagccgtcctaatgtagatagggcggctttttgtttgaaattaagtgggaggtaacaaaatggcatacgatcatcatgagatcgataagaagtggcagcgttattgggccgagcataacgaatttaataccacaaccgatcctaagaagccgaattattatgcgttggatatgtttccttatccgtcaggccaaggcctgcatgttgggcatccagaagggtatacggcaactgatattgttgcacgcatgaaacggatgcaagggttcaatgttcttcatcctatgggctgggatgcattcggcttgccagctgagcaatatgccttgaacacgggtcacaatccgaagacctttaccaaacaaaatattgagacctttaagcgtcaaatcaacagccttggcttttcatatgactggaatcgtgaaatcaacacaacggatccgaattactacaagtggacccagtggatttttgaacaactttataaacatggtctggcatatgaagctgaggtaccggttaactggagtccggatctagggacggttgttgcaaacgaagaagtgattgatggcaaaacggagcgcggcgggttcccagttgttcggaagccgatgcgtcagtggatgctgaaaatcacagcctatgctgaaaagctgttgacggatctggacgatcttgactggccggaatcaattaagcagatgcaacgcaactggattggcaaatcaactggggcacagatcaccttccgagtaactgacagtaatgagccgtttgatgtctttaccactcgtccagatacgctgtttggtgcaacgtatgtcgtgatggcaccagaacatgaattagttcagaaaattaccaccccggcacaacaggccgtcgttgatgcgtacattgacgaagccgcccataagtcagatcttgatcgtaccgctttggataaggaaaagactggtgtttggaccggggcctacgcgactaatccggttaacggcgaaaaactgccgatttggatttcagactacgttttagcctcttatgggactggcgcaatcatgtccgtgcctgcgcatgatgatcgtgactacgcttttgccaaaaagtttggtattgaaatcaagcctgttattgagggcggcaatgtcgatgaagcagcttatactggcgatggcgtgcacatcaactccgggttccttgatggtttgaatgaacacgacgcgattgatcgaatgatcaaatggcttgaagataaaggtatcggcagtgccaagatcaattacaaactgcgtgattgggtcttttcacgccagcgttattggggtgaaccgattcctgtcattcactgggaagatggcgaaaccacgttggtgccagaagacgaactgcccctcacattacctgaagaggctgatatcaagccaagcggtactggcgagagtccactggcaaatctgactgactgggttaatgtggtcgacaagaacgggcggaaaggtaagcgtgagaccaatacaatgccgcaatgggcagggtcttcatggtacttcctgcggtttgttgatcctcacaacaaggaagctcttgcggattacgacaaacttaaggcatggatgccagttgatctgtacattggaggggctgaacatgccgtgctgcacctgctgtatgcccgtttctggaatctgttcctttatgacatcggggcgatcccgaacaaagaaccgttccaacggctatttaaccaagggatgattctgggcgataatcatgaaaagatgagtaagtccaagggcaatgtggttaatccagatgatgtggttgatgagtatggtgccgataccttgcggctgtacgaaatgtttatgggaccgctggatgctggtattgcttggtcaacaaaggggttagctggtgcccgcaagttcttggatcgcgtctggagtgctttcattgatgatgaaggaaaactgcgtgatcggattacaacgatcaatgacggtcgacttgataaggtttacaatgagacggtcaagaaggttaccgaggactacgacgctttgcatttcaacacggcaatttcacagatgatggtcttcatcaactcagcgcgtaaagatgatgacctgccactagaatatgttgaaggattcgtgaaaatgcttgcgccgattgccccgcatctaatggaggaaatttggtcacggctaggtcacgatcatagtctgacttatgcgccatggccaagttatgatgaaagcaaaatcaaaaccgacacttacgatatgatgatccaagtcaatggcaagctgcgtggttcgattacggcggatgtcaacgaatcagatgatgagatcaaacaagcggctttggcaaatgataatgttcagaaatttacggcgggcaaagacattaagaaaattattgtcgtaccgcgaaaaatcgtgaatattgtcgcaaaataaccgcactggcttcaccaattaactgaaagaaaaaatggtcaacgaatggttcctgaaggaagcgggcgttgaccatttttttagcgattcagctgtatgaaaagttttgtatttttggcgtttcgattgtgagattacttgctacgtggcggctgctaattgtcaaagttttcttttgattcccgaaagaagcccgggaaagattgcaagtcgcgctgggattgcctaaaatgtaaaggattatgcaacacgacaggagtttatcatggagaattcgctgggcagcggtaatcaaccgcaacgttcagataaggaaaaaatgatccgcggctcggcgtggatgactgccggcagtgttttttcgcggattttaggggccatttatgtcattccatggcgtatttggcttggagcagcgtttctaactgccaacgctttgtttacaaaaggttatcaaatttacagtctttttctgattatttcgacagctggtgttcctggtgctgtttccaaacaggttgcccggtacaatgctatgggcgaatataaaaccgggatgcgtcttttttaccacggcacttttgccatggtgctgatggggattgtctcgtgtggtgccatgtggctgctgtcgccgcttttagcagcgggtgacgcgcgcatgataccggtttttcggtcactggcatggccgttgctgctaattccgtcgcttagtttgattcgcgggtttttccaaggttataacgagatggcgccgagtgccatcagtcagtttattgaacaagtggcgcgaattctttatatgttagtgatgacttacgcgattatggtggcgggtaaccacagctatctgagtgcggtcattcactccaccttcgccgcgttcatcggggccgttttcggacttggactgttagttgtttatttcctccggcaaaaaccacggttggatgcgttggttgcccaaagtgctaattccctgcagatcagtgtcaatgagattcttctagatgtggcacggcaggcgattccatttatcatcatggattcaacgattaatatttactacatcgttgaccagtacacatttaatccaatgatgaaggctttttatctcggtagcgaagatcagcttgaccgtttttatgcgctgtttgccggaaacgctaataaactgattatgatcgttgttagtctggcagttgctatggccattaccgtagtaccattattggcaggtgcgaaaacacgcggtgatgttgagggattggcccggcaaatcacgaatacactgcagttgttttttatcgtcatgataccttcggcgttggggatggtggcagtcgcgcgcccactgtatgttttgttctatcgggatatggactggttgggcattcgcttgttgcagatttcatcacttttagcgattatgctgggcttgtttacggttttggcagcaattcttcagggattgttcaataaccgtcttgctattcaagagatgctgattggcttggcagttaaagtgattgtacagtggccaatgattttcttcttcaatgtttacggtccggttttgtccacaatgttaggcatgacggtctcgagtctcctaatgctctattcaacgaatcggatgtacaatattcatgtacgccaaaccattcgccgtggcgtcggtattctggccttttccttgatcatgtgcgccgtttgttacctgattgtgaatgcatcaaccttggtgatcaatccgcggagtcagttcggggcagcgttcgtcttgctgattgcagttggggtgggcgttttgatttacgtttatttgattttgaaaacgcgtttggctgatttaatcattggtgagcgaattagtcgacttcgcgatattttacacattcggtgagcttatgcgattagataaatatttgagtcatttacaatttggtagtcgaaaagaagttaaggcacttattcgcgacaagcgggtacgtgtggccggtgatttaatcactgatcctggttacaatgtgttgccgggtatcgcggtcgaggtgaacgatgcccaagcggatgggccgcttgaggtcgattatttgatgaacaaaccggccggggtgattaccgcaacagaagaccctacgcaatcaacggtgctggatctgatccgaccacatgattaccgaccaggtttatatcccgtaggtcgtctggataaagacactactggtctgttgttacttacgaccgatggcaatttaggtcatgcagtgctttcgcctaatcgtcatattgccaaaacctatgctgcaactttggctaagacattaactgctgacatgaagcagcgactcgaaaccggcattgatttaaaggacttcacaaccgccccggcacaagtcgttgtcttgccggataccgatggcaaacgcatccagattacaatcacggaaggtaagtttcatcaagtcaagcgcatgttgttggcagttgacaatgaggtgacggccttgacgcgaattgctatgggaccattgtcattgcccgccgatttagctgctggggagtatcgggctttaaccgatgacgaacggactgatttggataatatcactcgttgagcaaccgagcactttgctgtggtgattgtttggctttgtctaagcgagagattttgtttgttacaggagtttaagagagcggccttgattaggcgaaccaagatggctactttgacaaacatgattagaaagggtgcgtgtcatggatcaacaacagtacgtctgccccaaatgccaaaacacggcttatgttgccgaccaatttcaagcaactggtggtaatttttcaaaaatcttcgatgttcagaataaaaaattcgtgactatttcttgtaccagatgtgggtacacagaactttatcgcagtgaaaccagttctggcatgaacattctcgacttccttttgaatggcggctgagaaggcgtaagttcaggttaggaatgatgtcaaaaaagcaggtgatccttcagccgtcgttgtggcggaaagggatcatctgctttttgtttgctgctggttcacaaattggttcgtcattctgaaagctgctttaagtaggtgggcagttcgcgaatgaccatagtcggtaaggcaacataactattcatagctacaatatcagctacgcgggaatggacaaaaacggctgcgagagcggctttgtccaatggctggaactggcccgcaaaggcagcaataatgcctgtcagcgtgtcaccagagccgcctgtggccattgccggcccaccggctgtgttttcatagacatcttcatcaacgaaaacatgtgtatgggaacttttcgcgacgatgatacccggtatttttgcggccgctttttggctggcttcaatggtttgggcagccaggggtaagccagataaccgctgccattcaatctggtgaggtgtccaaattagttgggcttgcgggtaatctaggtgatgagaggcaacgagagtgatcgctgatccatcaatgatcatgacctgcttggcattgacggcagcaaaaactgttttcaaaatggtaagggctgtaccatcagtgcccagcccagggccaacaacaatgaccgttgcttgccgcacagccgtctcaagttccggcgcggtagcatcgaggatcattgcctcaggtaatcgggcgtgcaacgcatgacggttaaccgggtcagtcgcaacactgaccaacccagcgccagcgtaaacagcagcactggcactcatgatcgcagcaccgccaaagtgggcattaccgccaacaatcagaattttgccgaaactgcctttatacgtatcacgggcccgtggccgaaccacactttgtgcaaattgcgctgttaattgtttcatgacggatttgccgcctcctttaaaacttcccaattagaaaaagttttggtcgtcaattcaggctggccggtcgttaagaatgctttcgcaaacatgacaagcggcgacgcattggcccatgtcaaagtgtcaagtggcaaggcgcaggcaccgagtgaatcctgacccataaattgggcaacgcttgtttctagtttaccgccgttaatggatagcgcatagaaaacgcagatgtgctggttgatggtccagtgttggtacttccaaggatagataaaactggttgcccctagttgttgatcaatcgtggctgtcaatccggtttcttcggtgaattcccgcaagacgtcatgttcaagcggttcagggccatcaaggctacccccgggaaggtcgaagcgatgacgataaggacccccatttttcttaatcacgacaagcttgtcgtcaatcgttgcaatcccgtaacaaccaaatgcgcgatgagttttatgtgtcatcaggccacctccattgatcaagggtagcacgctgctgcagggggaacaaattgtaaaaatagttcgtgattttgcttgcgtgccttacctgcttccgttataatcatttatgttgttgccgcgatggcggaactggcagacgcgcagtgttcaggtcgctgtgggatttatcccgtgcaggttcgattcctgttcgcggcacttttaaggtaacaattgattaccacagatagcagaacccttgacatataaggattctgcttttttgttttacccttaattgccgtttctttcaaaaaattgagaccactttgagaccacggtcagagattatcgagtgctttgagtgtttttttaacctgtttagcttcggcttttttgaacatgtgctcatagatacggagagtcatcgaaacatctttatggccaagacggcgagaaatataatagatgtccacattttgactagctaggtaagcaacatggtcatgtctcaaaccgtggaaagtgatttgtttatgggccggtacctggatttgggtttgatagctcttaagcatcttgtttgtggccgcatctgtcgggactaaatgtcgggtacttctaaaaacaagattgagaggatcccgatagccctgagccataaaagcctctgtctgctcttttttgagctttttcaaaagttgggtaagatcgtccggcatatcaataactcgaacagaggagggcgtttttgtgggcatgaggccttgtccgaaatgatagtcccaagttttatcaatattgacttgctggtttttgaaatcgacgtcagcccatgtcaagccgaccacttcggagtatcgcattccagtgcctagtccgacggcaattgcatatgaagtattcgcttggaaatttgctgttttatagactaggtctttgagctttttcaaaaaggggagttcaagaaatttaaggccaggatcttttgcagctttgccaacaaactcaaccccctgagtaaagtcccggttaagtatttggttgttgatggcagccttgaccatgccacgtacataggcgttaatttttctgacagtatccttagcatgtgttttgccgtaactgttgatgaaatcttgccatcgatcaagggtgatgtctttgagtttagcgacaccaaagaagtcttttaacgccgttttaaaataatcgtaccgattttcggtaaccttggcgtgtttgcctcgcttatagcgagtgagccactcttcaaagtagttaacaaagccgacttcgcgatcaagcatgttagcgccttgttctaattcggaggctaagatctgggcatcacgtttagctgctgcttgacgggcatagccacgcttgcttttggcgtggcgtataccttggttgtcataatagtaaacacggtagcgccatttgccagtattttcttgggttatgctgattgttgccatgtcacttgcctccatctttgatataatgaggcacgcaaagagcgtacttcgtgaactattgttcctagcgcttttacgttgcgtttacctaagctttataggcgagggggagatgcgtttgtgttagaatacaaccaaggtggtgattgtatgtccaagacaattaacgttattaaaaagccaatcccagtaaaggcatatcaaactgacaagccactgaatatcgagacacttgaaggtacaatgcatgccaatccaggcgactggattatcactggacctgatggtgaacgatggcctgtgaagagagaaatttttgaaaaaacgtatagtgtccttaactgagggcactttttattttgggaagaccttaatcttgtcacgagccggtgaagtccttttatcgaaggcttgattgatgtatgcatttggatcaaccttaaaatcatcccatcggactaatacgcaatatctgtcctcttcggaccagatgtgctttcctgctgctagtggaagataataattatagttgaactcacgtatcgtagtgctgttgtcaatgtttacgtaattgtgcttttgtccacaaattgaacatgtaaactggcctcgataaaccgactcgtacatttcggggagaacaacaccgagaatgccgttaggggaattgtatagagacgcctgcatttctctttttataaagttttgattctccgtcattgagttctctgcactatatgagcctaatagtgtaatagttactgttgaatcaagtagatgatcttgacgtattttctgcatgatgtaatcttcatcggttgaagctataggttcatttaaggaccgatcaatcatgtcaacgtccagatcgttttggatttgatttttataatctttgttctctgttttgaatgaaataaaacacttgtgtcccatttttatttaccttccttagagttattgttcaaatttgcccaattcacgttttcgcttgagatgatggtctctacccgttcgacaaatgttttgtcgatgtctgacctggagtcatcgtatacaccagctttcatcttgaacatatacaactcatgtttgagttgttccgctatatttctatactggatccacttttcttggacctttgtaagacttgaaatgctttcagcgatagaagcggcaatcccaaaaaaagaagtaaaagtaagaaaatagcgccaatagaccacaagcccggcggtaaatggaactagtacagaagtaactattgtgatcgtccggagaaagtaaaaccaatttttttgctggcttgattttgtgtcataccattggatttgatcttcgactcgatcctttacgtattggtcaattgatgaagacgtcggcatacagacctccattttttctagtgcttattccacgatgtcaaccaagttcttcgtcttagttgacttagcaatcagaactagctgatcagcggaaccaagtgtccacccgaattcgatttgatccttgtcattggcgagtttcttggcctcttcttcgacgttgacctgtacgcctttgatagacagtttctgcgtgtcattagcagtgttgctgtcgagggcgtctttggcagccttcatgtttttcagtgaatcttgattcgtgagaatgacctgaatcacttgatggccagtcttgtcggtatcatctgccacgtccgtttgaatcttggtctcaacatttttttcgccgtctgtgttaaacttggcctcaagttcctttgcaatctttttgttggtggcagttggttgttcagactttgatgcaacgtcaccgcttttgtttgcagacttgccgtttgattgactaccacaagctgccagactcaatgacgcaagggcgatcattgcgaagccaattacttttttcataataacctccgtagtactatatttttgaagtatcacattgtcctgatccaactaatggatcggggcttttttatttttgtcgttttgagacttgtagaacatgtttctttagttgttcgtactccgacgtggtaattgcgccagagtcgagtaattgtttgattttgactaaatcattgatctctgaagaaacagtgttgttgccatcggctaaatatgcagtgatagagctagtaagtgcaccgataagtccaatgccattaaacataagcaaaatagctgcaattcttcccataagtgtgtggggggagatgtcgccgtaaccaacagttgtagcagtcacaatggcccaccaaatggaatcactgtatgatgcgccttcagccaaggaatagattgctgatgcaatgattatcaatatcactgacagccacaagtaataaataaggcctcctctatgaagaaatttcttcgctcgttcctgtaatatgccagtgattcctgcaagccttgttagacgaaatgctcgacttagtctgactactcttaatgcgcgcgcaaacctaaaaaacgaaaaaatagtattaaaaggaatgatggccaaaagatcgagtaagtgggttttgaagaatttgaatttgttttcggctgttagtagtcttgtgaaatagtcaatggcaaaaattattagaattgtgttatcaatgacgacgtatggaaaggtagagagattaattaccgaagagtaatcaagaatgactaagatgattgaaatgatagcgagtagcgcaataacgacattgtagtaacgaaagaacctcgagtctgatttcaatacgcaatccccattacgccaaaatttttaaagcagtatttttcactaagttgaagtagcgttcggggatcctataagtttccatgaagtttacaggattaaaatcctcgatatccatccaatcatcgagaaataaattcattaatatttgaacagctttttgattggctgctgcctcttcaggattagtatcacagcgagaataggctgcataatcggttccgccatttagaacatgggctgtctcatgagcaatctgtaatggaatctctcttggttggtaccaattcatattgataataatcagtcttctggaaggaattgcaatgggaatccagtcttcaggaatttttgattttgccataacgctaatattgtggtcataggcataattgaataaggttgtggttacttcatcaaacatatcacttgcccccatccagaatgcgacgaatcatttctagttcctcaggtgggatgggttttccttgccacgacatgattgtgtcttcatctttcatggctgccttgaggtcaaattgctgcggctcgtcatttttttcttcttcggtcagatcttcataagtcacgcctaaaaccttggctactgccaaaattgatggctttgatgggacatagccgggacgattccatttatatatggcattaatacttaagccagctttttgagcagcatcctgtaaactcatacctcgtaattttgcaaacttttttgtcttctcaaacagcgtcatattagtattctcctccactgctgaggacgcgccaaaaatattcaagattaaactagttgacttaaataatcctgagtattatagtttagtcatcagctaaggttgttagctggtaaaggaagtatcaagatagccggattcgtcgccatacgcagtccgcgactttcaagatgctctctttacctatgccttgattttatccctgggattaataaaggtcaactgttttataagctgatagacaaactaaacgaacaggaggtgatcactggtatgtcaacgatgttgaagcgtttcaaaaagcaacttattgacttggatctaacacaagccgaggtcgcaagaaaatttggctggtcaagtcaatatgtacgggacttgatgggcggaatggcgtttggccctgcagcggaacgcaatcgcgccgctgttatcgcttttcttgcaaaggtaaaggaggaatccaagtgaacgaattaaaagtaatcggccatgaacacatcggccacattgaattcacgggtatcgaaggaggatttggtgaagacaaaaaggcgatgttagttaaagatatcgcacagattcatcagcgccccgttttcaaaatcaatgagctgatcaaccggaatcgaaagcggtttgtaaatggcatcgacattctcgatctagccagaccagatttcgctatctttttgaaggatagcggatttacacagaaccaaatcaacgcttcagctaacatctatcttctttcagagcgcggctattcaaaactgttaaagattcttgaagacgacaaggcatgggaagtatacgaccaactggtcgataactatttcaatatgcgagttgccgtcaagagtggcagtccccaaattgctgcaaacatgcgtcttgagatcatgagcaacaatgccaagacgcgacaagcgaacgctttgtaccgaattgctatgaaagccggatcgattagctcgcagcaggcgctgttggcaaaggcggctgaagcaatcactggtgagatggtgttgccgacaatgcgaacagaggagttcagcgctacccaagtggctgaaaagttaggcatcacttcaaataaggtaggacgtattgccaatcgaatcgggatcaaagcagagcaacctggtcagaatgaattcggacgatggtcggccagcaagtcacagcacagcgacaaagaagtgccgcaatggctgtacacaaaaaagggattggctgccattcgatcagcaataaaggagtgaagtacgtttggagtcacaaaaggtgattagaaaagaattgccggtggttgcatgccagacgattgatttgttagaagcagcagtttctagagaattgcaaaagaaaaacccacatgcaactctgcgggttggactgcttggaatagttgctttagggcttatagcaatcactcgagtagacgagttttcgtcatttgaggctcaaaagttggagaggtgaaccaacacggatgcttttaaaatacaaccagaaattacggtcactttaccgacaggttgggagctaattgaaaccagtcgacgtaaagatcttgaacagcgtgccgacatgtcagagtggtggtcaacaaaggatgttgtcaagcgatataagcatgacatgcgttggctaaagaaaaacattttggaaaagccagaatttatggaaattctcagatatcgaatggtcatgtatgcgggagatggtggcaaagattggactttcgaaccagtcaagttttctgagtttatgcgtaactactttcctgaaattgcgaaaggaattggtgaataatgattggctatttactaattgctggtggcttcggcgtgatcattggtcactgcttaggccacagcggaaattggaagcagtggcttgaatgaagcagctatagctaagcttgttccacttatctcctacttgtctatccaggctgagaacgcacgtctggttggccataattaccgtcaaggaacggataagacgcgagcttatgccatgggacgagaagacggcttgcaaaccgccatcagcttaatcaacgaaataattggcaaaacaaaaagccgctaagcgctgtaccgcttaacgaccaaagaaatgtggtatcaaatgagtgacctcattataccacagaaagaaatgaggtaaaacaatggccagagaaaaattaaggcctagatgcttcacaaaagatctatcaactctacttgacgaagagccgtgttatcgctgaatctagatctgaagttgccaggtccgatcgtgaacgatcatgtgagcgaacccggcacagacagcttggatgcacacagtctcatcctgccgcgtgcagcgttgggtgaaaccaaaattcaggtcacgaaggcagatggttctgactttccgattgggtcggctcagatttaccgaaagccaaacggtagcagccgcagtaaatacggtagccaaactgccatgaaagaaaatgtctcgacagattatgtgccgagttcttcagcaacagcggtcatttttaaagacgtgattacccaagaagatggcttgtctaatgttttggatgccaagcttaaagtcgatatcaatcatgtaggttcggccagcgatttgaatggtcgacactttgagatcggggcctatgtggaaatgaccaatatccatgtgcgccgcgttgaatgggcaccaacgccaacagatgtcggcatcgacttctcgaacaatttcttttctggtatgtccttcgctaacgtcctccactatgactggcgggtggtcttttatgaaaaagaaaccggcaagcggctgaattttattccgcaaagtgatctgaatcagaattcgactttaacctttacatcattgaacccaggcgagttcgtttggactgagcagtcagatatcaacgcgacttacaatgctgattatgtcactgattggcagtttcaagaaggtaactggattaccgcgaacaaggacgtttttgatcaagagaatcttggcgaacggggcactggtcagaaaggctatacctcgaaaacatgggggaactgggttgatccgattgatcatgacaatctaagtgagtgggaggaccgcctcggcgcgccaacatttggccgcggggctgtggcttatacgctgaatggtacgagtcacacgtttaagcgaggaaccttttcgagcggtggaagtacatgggtcgccaatggcagcggacagattgagttaattgacccgaatgttaccaacaacaagagtgtcagcgcacaagcgattgctggcggtggcgccaaggcggataaaaacaagccaatttggacgtcaaacgatctccacaatcaggtggtcaatgagcattaccaaggcgcccctttttactactacatcaaccaagaagtgtacagcatgggcgattatgtggtaaagccgacgaccatcacggtgacggatttattgccggaaaatattgaattgattccggatcagaacaatgggccaccgacttatgaacaagcctttcaactttttaacgcgactgatcctgatgcacccaacaaagatcgggccatgacactgacgcctggcgtttcatcgtttgaggtgactgaggaaaagggccgccaacgtatcacgctgacgattggccgagcagatgtgcagaaaatctacttccacagcggctatttctcactgcgactcaaggttcggccgaccctcgatcctgacaccatcgatcaacgcgtgacaatgaccaacagcgcggtggtgaaattcttcgatacgaaagagcgctatagcaaggaaactaacgaggtggatgtgcatttagaccctctgaatcgttttcccgccagcatcactaaaaagaatcagcatggcgctttacttgaaggaactaagtttacgttgaaacaagctggccagccattgcaggaagcggtcaccaatgcccaaggacaggcgaccttcaccggtttacgccccggaaagtacaccgttgccgaagtgatgtcaccaggacacttgctccaaccagagtttgacttaattgtcgctgaaaatggtgacgtgacgattggacgacaaggggagatttgggacgacaacacggtggttaatcagttgaaaccaactgaacttgagttactcaaggtcaataaaagtaacaaaccattagccaaggctacgtttgcactgtatcgcgatggtcaggctgagccggttgcttcggacaacacaaatgatgaagggcggttgctttttgatcatcagctaacccctggcagctaccggttagttgaaaccaaagcacctgagggtttcgataaattggcgggggcattcacatttacgatcaatcaaaccggcaccatggttgatttaaaatacagcggcagtgatcttacgactgatgattatgaatttaaattccagccggacgccaccgacaaggttaatcgcattagctttacagtcgtcaatcacagccttgaaagtttgttaccgaaaacaggcggcaatggcattgtgctatttctgctaatggcattagtggccggcgctagcggattactgctagtcattgtgctcaagcgaaaggaggcgcgttaagatgcgactacgattgctatggtgggttatcccgctcctcctattagttggcacgctgcttggtcttcagccagtcagcgcggctgaaaacactgccaaaattgtcttgcataaacgcatttaccgggatgtgcggcaacctgaagacgtttggtacgacaatgacggtcagataattgatccggaaaaccctgataaggctggatataaactgttgagcaaaactagtggtctgaatggcgctaattttgaagtttacgatgctagttccttgttgaagtcagatatgacaccggatgacgttcaggcactgatcgaaaagtatcaaaatatgactcgcaagcaggcacttaagtttgcgcgggcaaacctgcaacttgcaggtcaagggaataaaggacttggcttgattaacaccgccaccgataaaaatcttggtgaagacgggattggacgcgtcacagttgacactggtcaaggcagcttcgagaaagcgtatctgctgattgaaaccgcgttggatttctccaccaatctgaacgttgacatggaaagaaaaagctcaccgatgctgattgtttttccggtaaaagatccgacttcaggtgacccaatgtcgaccgtgcatctttatcccaagaacgtcggttatgtccgggacccgtacttctttaaattcggcgttcatcctgacgggacgagtcggcgattagccggggccattttcgcaatctaccgaatcgtggacggtcagaaactatatctcgacttgtcaccagctactgacttgaagaacaaatgggttgcatcaaccgatgctcttcatgatgatcgtgtgaataaatttgtttcggacaaagacggtttagtgaacacaggtgaacgattcttgtcggcgggcacgtattattttgaagaattacagtcagtaacaggttatgaattggacgaaaaaagtcgggcgattaaaatcgaaattcccgactcttggttagatgatgatgacaattaccgttatgtactgattgacggccagccgatgaaagaaaacatcggcgggatcgtgacaccggaaatgatcagtatcggtaatccccgagtttataactatacagatcgcagcagcacttcaagcgaatccgacccgacaccgccgacaggccagtctgatcagttagacaaaccgactggcgcaggcgcaactggatatttgccggcaatgtctgactggcaaaacctaagtctcgttctcatcggtataggactcctgacattggcaacttacttcctgatcaagcataagaaagcgaggaaccacccatgaatgccacgataaaaaagatcggacacggcctattagccgccttgatgctcatgagcgtgttactaccgctattgggcgctggcagaaccgttcacgctgccgaaagccaagttgcatttacccttcacaaaattgaacaaactgcagatgaacagattcaaaacactgcccatgatttaggtctcactggcagaaccccagttgtcggtgcaaaattcaaagtgtttaatgttacagatgctttttatcagctattagagacacacgataaagagactgcggcggcgatgatgtcgcagaatctgggaaactatgcaaatcttcaagatccaaatgcgccagaaatcacgactggtcaagatgggttggcagtttttaatcaactgccagctaaaaccggtggtcggcacagcgtttatgcttttagtgaaacatggacgcctcagccctatcaaaaagcagctgatatgatcgtgagtctgccggtgcgtgacaagaatggcaatgacttaaccaatatccatctttaccctaaggatagtgtggttaccaaacacttagatgctatcagtggcggagcaattgccgctaaagacttacatgacgttgctgtcggtgatgtgttgacttacaatatccaatttcagattccccatgacattggcgcaatggcggataatcaatccggcgtgttcaagtacaatcaatttgaagtgctggattacatgaccaaagccggcttgacgtttaaagaactaaccgcagtgactgtggacggtcaaaatattttgaacgacttaacaggcaaaatcgcgctgatgacctcaaatgacgcggcatggcaaaccgcgcatggcaactatccattcggcttcaaattagatttcttaggcggatcagacgccaatgccgttcgtaatttgttgacgaagtatgccggtaaacgggtgaccgttggctatacggggatcgtgaacgagaagatggtacctgatcaaaaaatcgggaacacagcagttgtttcttttgatcctgataccaaaatcaccgttaacggcccggaaattcagactggcgggatgaagttcttcaaatatgaaactggttccgatgacaagtcgttggctggtgcaaagttcatcattcagcgacaaactggcaatgcaacagaatatgctgtgcttgaaggtgtcaccggtatgacaggcgcttatgccccaagcaagatcacttggacgacaacgaaagctgatgcaaccgaactgaccactaacgcaggaaagccatttaacctgtcgattcaagggatgctgccagggacttataccttgattgaaacagatgcccctgatggctatgaaatcacggatccaaccacggactttgagattgttgcaggtacgtggggcgagaaaatcgttcgcatcacaaacacccccgtacgcacattgctgccgatgaccggcgggatgggactgctcgcatttctgctgatcggcatcgtcttgatgagcggtggttactatgtgaagaagcaaactggcaagaaagcctgatcgcctatggctaagcaggcgaaagggtcgaaccggctgttgcgctggctcgtgatcatcctcttcaccgcgggggctgcctgcttctgctacccttttgcggcgacggcgatcaatgaagtcatcttcaagcagtgagcaagcctctttctaggtggtaactttattattgcaatctaggcaactagctcttgtttttagacgttaaaaaacactcgctgtgtttgaaaagccgtgcggcactttcagaaatagataaaacagcgtaacattgatggaaataccccgtggctaaccacgggcaacgagaggtgaacctaatgtaccagcttttaaccgattcttgctgcgacttaccctatcaaacattacacgatcatcatgtggattttgtctcaatgcattttacaatcgatggtcaggaatacgaagacgatcttggcgaagataaatacgatatcaatgccttttaccagcagctcaagcaaaatgtgatgccaacaacgacacaggtcaacgttggccaatttgtggatttcttcacaccttatgttgaagccaaaacaccgattctatacattggtttctccagtggtttaagcggtacgtttgattctgcaacacaggctaaagcgatgttgttagaaaagcatcctgatgcccaaatttatttaatcgacacattagccgcttgcgcgggggaaggccaatttgtgttggacgcgattgataaacgcgatgctggcatgccgattgctgagttagcgcaatggctgacagatcatcggttgcattatcggatgtggttcaccgttgataagctagattttctgtatcatggtggccgggtttcccggacatcagcagcccttggaacgatgctgaatattaagccggttatggacgtcgatactgctgggaaacttcgcgttgtgcgcaaagtccgcgcccgaaaacggtcactgatcgacttaactgatgaaacactgaaggctgttaaagccaatccgacgcaccgggtcatcatttcaacgtcaggcgattatgacgccgccaacttcgtgaaagaccgattgcatgccgcctcacctgaaacaccgctgcaagtcggcaacatcggccccaccatcgccagccacaccggctttggttgtgtcgcggtcttctcgatggctactgacgatcggcaatgactgtctctcaggctgaacgataacttctgaaacctacaatttgtcagagcccaaataatcataggaagtgctaagctaaaacttccttgccatgccaaatgatgcaatctttaaattccaacagactatttatgagagcgaagactgatttgcctatatatggcaaatcagtcttttttagtctgtctggtagctattcagaatgtctaaaagccagttaatcaagcatgaaaaggtgctaattaggcgtacttcaaggtaaaataagacaagattatggccaaggaggtttttccaatgtccattcgccctgccatcaccaacgacgtctcgcctttattatcactcgttcaaggttattatcatgacagccctgtcccacttacgattgatgaaagtgccatggctgctcatctgaatcagctacggactgatgccacattaggggctttgcttgtggctgagttggaccagcaactggtcggctttgcgattctttatcgtagttttgacacccgcacgctcaagccgttgctgatcatcaatgatgtttatgtcgcccctaagtttcgccgccacggtttggcccgacaattgatgcaggctgcctttcaactggctgatgagtgcggttatgcaggctgcagttggcaaacacggatcagcaatcatggcgcccagcatctgtatgatcagcttggcgtccgcgaaactggctggattcattattatcgtgctggcaaagattaatctgaaaaaagagacaagttttcggctgtttaccatgcgttttcgcctgataatcggtcgcagaacttgtctctttttttaattttcaacttaacgactgtttacgctcgtgcagccgatgcaggttcaaccagcctagcagcagcacagctagcaataagagtagcagagcaaaatcatagctgcggtgcatgccatagataaaccactggggatggccatgcggataatcatgaatgtaccgaccagcctgcgtactcatattcaggtacaacaagcttgtcaccaaggcaacaccgattgtcatccccaaattacggccaagtgcggccattgaccccgccagtccttgaaacttcggcgcgacattgtccatcatcatcggattgttttgaaaagcgccattggccaatcctgaccacgcgagaccaaacacgatccaacccaacggccagttcggggttgccgcggcaaacaaccccatcggcacacaccagagaaacagcgcgaagaaagacacccgttctgctccgaaatgatcgcccagattcccgccaattggtgcactgataacattggccgccggaattgccatcatacaaaagcccgccgttaacgcactcaagcctaaagtttcttccagataaaacggcatgatcacgctattaaaatagccgagcatatagacgatcatcgcagtcagaataccaatcgtgaaacccggatttttgaaaatggcaaatgggatcagcggatcagatgcatatcgctcaatctgcacaaaagccacaagaacgacgaacgcaagcatccctggtaacagcgtcacccacgacagtccggctgtttgtgcccagaacaccgtgatgaaaaagcccaaaatgattaccgaataactgccatatcccggccaatccatgtgggcacccgccaaggacggccgctgccttggaaaaaccagcacgccaattaaaaacgctaccagcgcaaccggcacattaatcaaaaagatccaatgccagcttaaaaccgccaacaccccgccgccaataccgggaccagcgatattgcccagttgcaacaaggcactgttgaccccgagcgcgcgaccatgctgattcatcggaaaaatggcggtgataatgccaaaattagtcgccatcgtcatcgcggcaccagtggcttgaatcagtcgggccgttaataaccatggtaaggtcatggatagtccgcaaaaaagcgagcctagtgcaaacaaaatggtccccaactgaaacaaccagatccgacccacgctgtcagacaacttcccccagaaaataagcaggacacaaatcgcgatcatataaactgatgtgacaagttcgacggtgctcatcggcaccttcagctcccgggcaatgtagggcaaagcaatattgacgatgctggcatccaatgtagccataaaggacaccattgaagttgcaatcaaaatcaaccaacgacggctggcgctcatggtgatcatctcagtttcattttagatttaaagacaactaataactgacacacagcgttatgaggcgatttcagggacaagataggcctactaatatcggttttatttaaaacaaatgtgtttaaatgctaccgacgccaaatcgtgacgcgctttgcgggcagtcgatacataccatcggtcggctgtacatcgaaagcttgataccacgcctcaaagttttgcacagggacattaacccgcaaggtcgccggggcatggacatcttgccgcaacaccgttttagcgcgctctggccgcattttggtcgcccaagaacgagcataggcaataaagaagtcttgcagcactttcggatcagtcgaatcccctaacaagtccaacgccaccgccatgccggcattatcggcgatgttttcgctaaccgtcagtcggccattcactttgacgccttcatacaataaaccgtcaaattgatccgcaatagctgtcactaacttgtcgaaggcttgtttgtcctcaaccgtccaccaattatttaacgtgccgtattcatcatacaaggcgccattattatcgaacgaatgtgaaatctcgtgaccgatggtagcaccggtaccgccaagattttgcgctcgggtccagttcagtgagtagtatggcggctgtaaaattccggctgggaaggtgatgtcatttttcatcggatcgtagcaggcattcacaaggtgccccggcatcccccaaacattgcgatccactggctgacccacctgctgaagccaaaagtcttgcgtctgctggctcaattgcaaaatggtcggtagtaaatcagcctctggctcgacatgcagcgtcgcgtaaagcggaaaaagttgatctggataacccattttaattttcatagtcgctaatttgcggatagccttctgcttggtcgctgggcttaaccaagtattgtgttcaagttgaacttgatattgttgcaaaatttccttgaccatcgcggtaatatccgctttcgcatccgcgccaaaataagtctggccatagtactgaccgattgcatcatcaaaatagtcgttggcaactccaaaagcatgcttttcccaagcttcgggctcaggctgtccagccaaaaaacggtcatattgaccagcaagttggcggctatcatcgcttaaataatcagcacaagccaatagttcgctaatcagcatccatgcttgccattctggatagtttgcttcggtgattaatgtcgacagatgcggcagataagcaggcaccacggcgttgaccttcgtcggtgtctgcggcattttagcagccaaagcttcgggaatgcctaagaaaccagcatcttctacaaattcagtccaggttagcggattgtcaaaggtgctatcaacggcaaaatcgacatttgccggaatgaacgcagccaatcggcgatcaaagcttttagccgccgccacatagtgcgcttgtgctgtctggtcaaaaccggcctcacccaaaagcgtcgcgaccattttcgaccatgcagctaaatctgccgcattctctgcatcatcggtttgatacatggcagcgtcaggtaaaatcgtggccggaccaccaagattcaaaatattgtgagccgcatcgtgcatatcagcatcaacgtacgggcttactggcaacacatattgctccgccagtagttttggcagtgctgcacgaaactgggccagcgttttaagcccagcgattttatccagccgtgcacgaaccggtgtcatgccgagttggttgcgtcgaactttatcattagccttagcaaatagtcgtgcggcattttgcagtggtgaatcggcggcttgtggtgccgcgtttattttcttcaaatcggctaccaacttgattcgaatgctatcagttagatcactgtcagcactcacgacgcttttgtcaggcgggatcactgtgttctgctgccaagtcccgttgaccgccatatataaatcatcttgaatacgtggtaatgacatcaaaattcctccttttaagcgcattcgtcgaaccaaaatccgatgctgctcctgcggtttttaaatgcgataatgcaagcatagtttgactaagcaagcgcgtcaattgcttgcacaatgtccttgaaacttctatcttaaaagcaataagacagagagggtgatgagatggcattagaacaatatcggtttgacggtaaaggcaagtttgatatgaaaggcttcacgaccacaccgccagatagttttaaaaataaaaaagatcaaattaaagcagatattgagaataacatcaaaacattatcaaaagtgcagcaacatttagccgcgcaaaaacaatacagtgttttgatcattttccaaggcatggatgctgccggaaaagacagtatgatcgagcatgtgatgtctggggttaatccacaaggcacctcagttgtctcgttcaaagtaccgactgagctggagttagatcatgattttttgtggcgaattcacaaggccttccccgctggcggcgaattaacagttttcaaccgctcgcaatatgaagaagtcctcgttgaccgcgttcatcccgaattgttactcaaggaaaacctgcctggtatcgacagtgttcaggacgtttccgatagtctttgggctgaacggttcaatgatattaaagctttggaagcttacgcacggcgcaacgggattctaattttgaagtttttcctgcacctttccaaagcagaacaaaagaatcgattccttaagcgtatcgaggttccggaaaagaattggaaattttcactggctgatattaaggaacgccgctactgggatgattatcaaaaagcctatcaagaggctattcagaacacggcaaccaaggccaatccttggttcatcattccatctgacgataaatggtattcacggctgattgtttcgcagattatcaatcaagaagtcactgctttgccgctaaaatatccagagatttccgatgctcaaaagcagcagcttgaacatgctgttgaggctttgaaagactaaatagattcgtttaaaactattttatacagaataaaaagacgcctcgacaaaattgaatcctgtcaaggcgcctttttgattatgctttggccatcgcatattttctgatggcgactgctgcaccatcatgatcgttgtcagggacaacagttttaattgcatctaataccacgggcaacccattggccaaggtcaccccaagtgcagcagtttttaacattggcaaatcattttcaccatcgcccaacgccatcgtctcagtcatggggatggcaaacaagtcactgagttggcgaagagcggcttcttttgacacgccttgccgcacaatttctagataggttcgtttcgaacggctagcgaccaattgccactctggatgggcaagaatgatggcttccgcgcgatcaaccacagcaggctcacccatgcacagcattttatgcactggcaatccttccgccagcatttgttccataggcgcagtttctgcgccaaagcctgtgattgcggcttcttgttggacccacgcatccaccacgttcacataccaatgcgcgccactgaaaatattcagactgagtgccagtttagctaacgcttcgtatgcttggctaccaatgccagcgggccaaggcgttgcggacaggatttttaaatcgccatgttgcggttggcaaatgacggcgccgttgagactggcaagtggcacgtcgagacccatctgatgtgccaaagcggtcatggccaaaggcggccgcgcagaagccagcacaaaggttccgccagcagccgcgtaatccttgatggccgttttaacttcatcggtcaactggtgatttgaattcagcagcgtcccgtcaatgtcacttaaaatcagtcgataacgcaaatcaaaagcccctctctttttcataatcccctcgaacgattcttttcagccttcacgactgctggtgggtaaccgggtgcaatggatcgttcagggccggaatactctggcgaacactgaaggcaaaacccaaagccgccaacaaaattaagcctgtggcaccgacaaacaacaactgatagctgccggtgccctcaatcaccattgctcctaacaacggacccaatgcgcgaccagctgaagcaaagccttgaatcaatccctgataacgcccttgctgtgccaatggcgtaaacaaggtgacataagtcgagactgctggtaaggccaagacttcacccatggttaaaacaatcatcgccacgatgaacgttatatactgtcctgaaccgttcagcaaaagcaaaaatgatccggcaaacaagacaaaaccgccaatcaagcgcaagcgaatgtgttgcaataaccagcgatcaaaagccgtcaaaattggctggaatagcacaatcagtaaggcattaatcgtccacaagaaactataatccttaatcgtcaaaccttcgcctaacatgaaagcagaaatattactctgccattgctcatacattagccaggtcacaaataaggtcaccatcaacatgactaaccgcggcttggctgggttgcgctcgctgctaacagtttgcatggtcgcagtcgcaatcgccactttatcaattcgataatgcaacaaagcaaccactaaaaataaggcaaataagccagttgccaaagcgaaaacaacgccaataccataaggcagcacaaatccgacaattaaagtgccgataaccaaccctagattcgatgtaaagtagagaatattgaacacgacactcggtcgtttattctgaatccgagtcgcataggaattaatcgccgtcgttgtgataccgctgccaagaccggacacaactaacagcagtggataagccggccatccatggaagaaaatcagcataccggtcgcaaaaagattcaggccaataccagcaagaactgtcccatatggctgccaatgatcaaataaccacccaccgaaactgttaccgatcaccataaacatggaattagcaaaaagaacaatccctgcaaccgttagtggttcacctaaatattcatgcatataaatcgttgttaacggccagatcaggctgatcccggtattcgtaatcaacgaacccagaaataaccatttcattgctaaagtcttttgctgcaccatactcccccatttcttgtcactgctactgatcataagggaaatggccctattatagcaacttgaatgagcaaatatttagggtgttatcatgatttgcccaaaataaaagcctagtgtaaaagttcgagctggttccgcggcaattcaggggtgccgactgcgaagcttgagtggtggacacaactgcaaactcacaaagaatcaagatcttgtcgttcagtcagtgcttgtgccaaatacgagcctcaatcaacaataagatcgacatgctgatcgtgttctaaaatagaatcatgagagctggcggagcggcgatgggctcagtggtgagattggtcttagtggagtggttttctccgcttagaccaaggccgagcttcaagaccgcgggctttgcgggcttgaagtcgtgcccaccacgttccagcccaatcgccgcggagccagctcggactaaggcgaaatctcaactgaaatagaactgatactgaatcaacagatattcatacctgctacagtcaaaaagaggcacccgcagcaatcaattgatgtgcgggtgcctctttgagttgcgccatgatagttgtgcagtcttacttcgccaacgccaaagccgtaatactctcaatatgctgcgtctgcgggaacatgtccactggctgggtttcctttgctgtgtagccaaaggcggctagcagctgcaaatctcttgccaaagtcgcggggttgcaggacacatagacgatctttggcggcttcatataaccgacagcgtcaatgaaacttttatccagtcctttgcgcggcggatcgaccatgagcacatccactggcagttcgttgtctttccagcgttggatgacctcctccgccttgccgacttcaaaggtgacattatcgatgtgattgcgcaccgcatttgcccgggcatcgcgcacagcaggttcaaccacttcgacgccgtaaacatgtttggcatgacgtgccatcgtcaaggaaatcgtcccgatacctgaataagcatcgatcacattttccttaccagtcagaccagcagcctcaatggcctttttgtaaagcacctcagtctgaatcggattaacctgataaaaactgactggcgagatctggaattcactgcctagcaacttatccagcaaatagtcctcgccgtaaatggttcgtgacttgcggcctagaatgacgttggttcgtttgtcattcaagttcacaaccacactcgttacttctggtaatgctaaggtgatctcttcgacaatatctttgagatgcggcacttgccaagtttgtgacaccaagacaatcatcatctgcttcgtataatggccccggcgcaccatgatgttacgaataacgcctttattagcgcgttcatcataagctggcacatggtattttcgtaaaagatcacgcaccaccacaatggcttggtcaattttcggatcttgaatcagaaagtcttcaattggtacgaggtcgtggctgtgttttttataaaagccagtttgcagttcgccattcacggtacgaaccggtacttgcgccttattgcgatagcctaaaggattcgtcatcccgatggtcggcagcaccgcaatatcaagatgcgcttttttataaagttcttgaatttgtttctgcttaaattgcaattgtgccggatatgccaagatcgacagtggcgcaatccccgtacggatataagtgctatctgcaccgggaacacgatccggtgagtcgctcaatcgtttgacaactttggcaaagccatattgtttctgcgttttgaggacatgcacctgcattttttcgccaggcagggcatcttcaatgaaaagcggaaagccgtcgactttggcaatgcccatcccttcataagtgagatcttgaatggtaacttccagatcttggttcttggttacagctggttgggccaaattagtcatccttttcgtcttgtgagccgatctgtccatcaccatcaatatcttgatgagaaatggattcgacttcggccatgtagtccttctgcttctgtgcgtccgtaccaagattcttggtcgggatctcgtctagattagcatacatggcaatatgttgcttcaaattaataaacgtcatcggcgcatcgccgccgtattcaccatcaaggttaattttcaacggatcgtctccgccggccttcacccgcaactttttagtttttgtatagataatattgggatcatccacgtggcgaccaccgttgaagacaagcgccattagcttcagcaaattcgccatgttcgctgttttaacaataattaaggagaacttgccatcaccaagtgcggcatccggcacgatttgctcaaaaccacccacagaattggtaaggccgaggaaaaacatgctggcgggtccatcataaaccccgccatcatattccagcttcatcggcaccgtccgcaccgctggtaacatctcggcgcctttaatcacataggcaaaatagccaaaaatagatttaacttcagatggcacagaataagtgagttcgctcaacaaaccaccagccgcgatgttcataaaataatgatgattggcttggccaatatccatcgcaagggtttggcctttgagaatcacttgggccgcctcaaccggatcatcccgcgaaatccgcaaagcacgcgcgtagtcattggtcgtccctgctggaataatcgccattttggggcgttttttagctggtgcgatcccattaaccacttcattaatcgtaccatcgccaccagcagcgacaattaagtcgaaaccggcttcagtggcacgctttgcttcttcacgtgcagaaaaaggcttcggggttgtttgaaaggttgaactttcatatcctgcctgttccatgatatccaaaatgtcggggacgaagcgctttaaaccttcgttgccggatgtagggttgtatatcaaacgcgcccgttttctcatcggtcaatgctccttaaacgttttaacaatactggactgctggcccgttgctggcggaaacagtctttgtcataatcgtgaatcgtcaatgtcttgctcaaaagcttcaatcatgagcaacttttgagcctatttttcttggtacttcccatctgctgccacaatagcaagactagcaatttgcgcaataacctcggcatgtaaacaacaaagaacattgtctacatgtcgaggctattatccaaactgaattgctagatagtcagtataacttatcgttgcttaatctcagccatcaaaatctggttgaccactttaggatttgcctgaccatgtgtttgtttcatgatctgaccaactaggaagccaattgcccggtccttaccagctttgaagtcatcgatactttgctggttattatcgagaatttcgtcaataatcggggtcaatttagccggatcggaaagttggatcagacctttttcatggacccacttatccggatcagtatcatgttgaatgatttccttaaagacctttttggccattttactggaaatcgtgccatcaccaataagcttgatcatgcctgccaaatgcgctggcgtcaaggcaacttgccccagttcaacgtgttgggcattcaagaaaccggaaacctcacccatcagccagttagacgcttgctttgcatcagcgccttgtgccacagttgcttcgaagaaatctgacatttccttcgtctgcgtcaagacaccggcatcataagctgggattccccagtcttcgatgtaacgctgccggcgctctgctggcggttgcggtagcgaggcctgaatgtcgtcaatccatttctgggaaacagccactggtggcaggtctggttcaggaaagtaacgataatcatcggcgccttccttaacccgcatcagaagcgtttctttagcatctggatcccagcgccgggtttcctgacgcacttcaccgccgctcaaaagcacagcctgctgccgtttttcttcaaatgcgaggccatcgcgaacatgcacgaaggagttcaggttcttgatttcggtcttggtaccaaaatgttcctgtccaattggccgtactgacaaattggtatcaacccgcatagagccttcttccatcttaacgtccgaagcccctgtgaactgaacgatttggcgcaaggtttccagataagcataagcttcttctggactggtgatatccggtttggaaacaatttcgaccagcggtgtgccttgacggttcaaatcaacataggaataaccatcgtcttcgtgctggttcttcccggcatcttcttcaacgtgcagttctgcgataccaatctttttcttcttaccgtcaacttcaatttccacccagccattggtgcccaaaggcttctcactttgggtgatttgataagccttagggttgtcaggatagaaatagtttttccgatcaaaatgagtcaaacgcgtgatgtcagcatgcaatgccagccccaccatgatgccaagttgataggccccgcgattgatgctcggcaaaacgcctgggaatccccagtcaatcacgtttgtctgggtgttgggttcctgaccataagtgacaggtgatggtgagaacattttcgatttggttttcaactcaacgtggacttcaagcccgattgttgtttcaaagttcatcttacttgccccccgggatctgtgctaagtagtcgttttgtgcttcaaaagccgcagcaacttggaagatcgtgctttcgtcaaaatgtttgccgatcagctgtaagccgactggcatgccatcaacgaaaccagctggcacggatgccgccggtaagccggcaagattgaccggaattgtcaaaatgtcgttcatgtacatggtaactggatcggtgactttttcgccaattttgaacgcaacggttggggttgtcggtccaataatcagatcataatctttgaagacatcttcaaagtcacgggtaatcaaagttcgaacctcccctgcctttttgaagtatgcatcataaaagccggctgacaaactgaaagtgcccagcatgatacgtcgcttgacttctgggccaaaaccttcggatcgagaacgaacataaacatcctcaatatttttgacatccttggcgcggaaaccataacgaatgccatcaaagcgctgcagattggagctggcttcggagctggcgatgatgtagtaagatggcaccgcatattgagtatgtggcagtgacacttctgtcaccgtcgcgcccatgtcttcgaactgcttggcagctgctttaatcttgtccgcaaccgctgggtcaacccctttacctaagtattcctttggcagagcaatcttcatccccttgatatcttgaccgattttggcggtaaagtccggtacgggtgtgtccgctgtggtgctatcacgttcgtcatgaccagcaatcacattcagcaactgcgcagcgtctttaacatgtcgagtcagtgttccgatctgatcaaggctggaactaaaggcaatcaaaccccagcgagaaacgcggccgtatgtcggtttgaccccgacgatgccgttaaaagcagcaggctgacgaatggaaccgcctgtatcactgcccagtgcggcaatcacttcaccagctgcgacagctgccgcggagccgcctgacgacccaccgggaacgcgcgtgtgatcccaagcatttttagtcgttttaaaagcggagttttctgttgacgagcccattgcgaattcgtccatgttggttttaccaacattgatcgcaccggcttcatcaagcttttgcataacggtcgcatcataaatcggattgaagttggcaagcatcttggacgctgccgtcgtgacaacgcctttggtgacaatgttgtctttgatagcaattggcataccggctagtggttgatcgtcagcaataccggctgcatctactgcagcagccttttccttggcgccatcagcattcagtgctaagaaggcatctacttcagcatccaactggttgatgccggccaatgtctcgtcaaccaattgactgctggtcaccttgccggagcgtaactgctcatgcaattgatcgatactggttttaaagtaatccacgcgctagtcctcctctttatcgatgatcgctggaacttggatcaacgtgcccttcttggttggcacatttttcaacaagtccgctaccggctcgcctggcttagcgacatccgctcgcatcacattttccagatgaatactctgagtagttaccggcacatcttgtgtcggaacactttctagttgttcaaccatatcgagaatctcggagagctggctggtgtatttctccagttccgtttcagaaaattgcaacttggccaatcctgccacatgcgcaacactgtctttagaaatcatgctatccccgctttcagtttcattatcattcgtagtttaccatagattcggctaatagctcccgaatacatgggtataaaagcctttgtcgccagaacttcgcgatacaaaggcctgcatgccttgcgtgctctgaatcgtgatctcaatcggcacgccagaaggtaaatacttgctagcggcagttgaaatatattgcgtaaagctctgaatttcggtcaacccataaaactgtgtgttaaccgtaatgttcatgccggctagattaccaccttcataatgcgcctgtgccgtaatcccagctaaagtcgggaagaagcccttcacttggttcgtaaaattcgaaaagtcattggccacggtactgttaatcgccttatgatcgctcaccactggcaacacttcattctgttggtcaagcttcttccaatcgcctaaattggtgccggttttactggttgtctgctcagtataaacaccgccaacgagactatcttgttcagcattcttgtagataccgacaatgatcggaatattattcggtactttactcatggcgcgcaaacgagcgacgaccttggcagcgattgcttcaccttgtttcttgatcgcctcatcggaaatttcggtttgatactgggcaccgtattccgtctttgtatagtaatcaaccttattcatcccgagcgcaattgcgattccacccagcttcatactattaccgtcttgtaccatgaaatcctgctctaaaatctgctgcaaataaatcggattgcgggtatcaggatcagttttgccattatcaaccggattaaggccgtctttgttgtccttggattcacgtttcagccaacttttagcggttgccgtacttaacaactgaccttcttcaaaactatatttgtcagttggaaactgtgctttggctaggttttcgagaccactttccatacttttaatattgaagttgttctcgccttgatcattctgctgcagcgtcaagccacgggcgctgctcgtctgataacgtccgtttttgataacgccttgatacatactattatcaaccgtgccggtggtttggtaactaccggtttttgtgccactagtactgctgctgccactgtcaaaattcaacttgccacaggctgctaacaacaccgcagccccagccagcaaagttaacgttaaaaatttcttcattgatgttcctcaatccttcaaattcgccagcaattccgtctcattcatgattgggacattcaagctttgtgcctttgccaacttactgccagccgcgtcgccagcgatcaggaggtccgttttctttgaaactgaacctgtgaccttggctcctaatccttctagctgcttcgtgagtgctggccgcgaaaactcggcaaacttaccggtaatcacaacggttttacctgcaacaaaactatctttgaccactggtttggtcggtccggtgtaacgcaggttaacatcagcttcgcgcaactgagtgatcaacttttgaaccgttgcggctttaaaatacgtcacgatcgcttccgcaatggtcggcccgatatttggcacatctgcgatcgcctcttgactggcggtcatcagatgatccaaatcgccgaaatgctcggccagaattcgtgcggctttaccgccaacgtgccgaatgcccaacccaaagattaggcgttctaccgagttttgccgactgttgttgatcgcacttaacaaattattaattgatttttctttaaacttatctaatttcgccagatccgcagctgtgaggtgatacaaatcagcgacatcttttaccagatgtttggcctgcaactgtgccacaatcttcgggcctaagccatcgatattcatcgcgttgcgagacgcaaaatgggtgagctgctcttggacctgtgccggacacatcgggttgatgcaacgcaaagctacttcatcgtcgagatggaccagtttttggccacatgacgggcagacctctggaatcggcgccggtggcgtatccgctggacgtttagcaaccagtacccgcgaaacttcaggaataatgtcgcctgctttgtgcaacatgacggtgtcgccgatgcgaatatctttatcacgaatcatatccgcgttgtgcaacgtggcacgtgccactgtggttccagcaagctgaacggggtccatcactgcagtcggcgtgaccacaccggttcgaccaactgtccagacaatgtcatgaatgacggtctctgcttcttcaggtgggaatttgtaggcaatttcccagcgtggcactttaacggtgttacctagttgcgcttgcagcgctaaatcgttcactttcaaaacgatcccatcaattccgtaaggcaacgcatcacggtcggtggtgtacttcttaatgtaggtgtcaatcgcctgcatgtcaccagccacttctgaacttggatttgttgtaaatccaagtgcctgcataaacgcaatcgcctcatgctgcgtggtcacgttaaactgctctggttcaattaacgtataaatgaaggtatccagctctcgagcagcggtgactttggcatctaactgtcggagtgatccagctgccgcgttacgtggattggcaaaaggcgtgccgccttcagtttcctgccgcgcattcagcttggcaaacgccgccttaggcatataacattcaccccgtacctctagtgaaagtggctgctttaactgcttgggaactgacgcaatggtcaacacatttctggtcacatcttcaccgacattaccatcaccacgtgttgagccttgaacgagtttgccgttttcataaatcagagataaagccaacccgtcgatttttaactcaacattgtaatccaccggatggccgacattgctttgcatgcgagcatcccattcactcagctcttcgaacgaaaaaacatcgcccatcgacaacatcggaattgggtgttgcaccttggcaaagtccgaattaatgacatccccgacttcttgagttggcgaatcaggcgtgactagcttgggataagcctcctcgagtgcctgtaaatcgcgataatgatcgtcatagacgttatcggtcacagttggcgcatctttggtgtaatactcaagacgccattgattcagttgcttccgaagcttttcgacttccgcctgagcttcttcaagtgtgaattgtgcagctggttttgctaacacagcgagcctcctctaaaaatatgcatcccgacatttctgagtcaaactgcgaacgcttatgatgccactttgacaatcggagcaaaggcagctagcagtcgtttgatgccgttgtctttaaaagcaatatcgagttcttgatcatcgccggtacccgtgactttcaccacggtaccagtcccccacttgcgatgcttcaccttgtcgccagcttcccaactggttttgcctgcacctgttattggcgcggcttgcacagtaacgggtgttgctgttttttgatcagcgtgccggctatacggggagctgaatgcgcggtcagtacgattaataaatggaatgtcactttttggctgggtagtgccaatgacttccaacaagtcaggattaatttcttcaatgaaacggctagcaggattgttttgccgttgaccatacagcatccggccataggcattggacagatacagcttctgtttggcgcgggtaatgccgacataagctaagcgccgttcctcttcgagctcgctttcatccatggaagcccgactcaatggaaagagtccttcttccatccccactaaaaagacaaccggaaattccagtcctttagcagcgtgcaaggtcatcaaggtaacttcttgtgcatcttcttcaacgtcatcctgatccgataacagcgccagttcagccagaaaatcaacgaaaatgtcgctgtcttcattttccggctgataccgggaatcgaatccttgggtcaccgaaagcaattcttctaagttttcgatgcgggtatcggcttccagattgtgggccgctcgcagtgttgataaatagccactatcctcaagaattgcctgcatcatctcggtcacgtttagatcttttcgccgtgtacccagctgctggatcattttaccgaacttagctaactgtccgcgagctttaccagcaatcggactgagttcagcattcgccgctgcttccagcaaggaccagtcatgctcattggcaaaggcctctaacttttcaacgcttgtgttgccaataccgcgttttggttcattgacaattcgattaaaactcatatcgtcttccggattgaccactaaccggaaatacgctagcgcatcgcgaatttccttgcgatcatagaacttatgcccgccaatcattttatatggaatgttggacttcacaaacgcttcttcaatcgcccgcgactgcgcattggttcggtacagaatcgcaaaatcaccatatttgcgatgattatcagcgatctctgcttcaattcgtcgaatgacaaaaatagcttcatcagtttcgctttgagcgcggtaataggtaatcttgtcgccttcgcgattttccgtccataacgttttggcttggcgattctgattgttctgaatcacatcattggccgcactcaaaatagttttagttgaccgataattctgctcaagcaaaatgacttgcgcctttggatagtcttttttgaaatccaaaatattctgcatattggcaccacgccagccataaatgctctggtcggcatcaccaaccacacataaattatggtagccttctgccaacatatgcacgagctggtattgcgcttcgttagtgtcctgatattcgtcaacatgaatgtaccggaacttacgctggtagaatgccagtgtttctttgtctttttcaaaaagcacgatggtctgcatgataagatcatcaaagtccaatgcctgatcactgcgcagacgcttttgatattcagcataaacctgcgccacaactttggtgaaaggactgttagcctgttcattggcataagtttgtggatccacgagttcatttttagcgctcgaaatagcacctaaaatggatttaggatcgtagcgctttggatcaagattgaaatcagccaaaatatgcttcactagcgtcagttgctcagccggatcagcaatcgtaaaggcacggttatagcccagtttgtcaatgtcgcgtcgtaaaattcggacacagagcgcatggaacgttgagacccaaatatcgcgcgcaatctcagcatcaaccaacttgccaacccgctcgcgcatctcacgggcggccttatttgtaaacgtgatggcaaggatgttccatggattgacgtgcttttcttcaactaaataagcaatccgatgagtcaatacccgtgtcttgcctgaaccggcaccagccataatcagcactggcccttcagtcgccaacaccgcctcagattgcttatcattcataccctttaatgcggcatccattaccatttaacgaatcgtcctttcagaaaaaccaagtgaaaaattccttgacctattgtaccaaattttggaggggagcgtgagcgggtggtgattgaagtatatgggtatcttttccattctatttggtttgagctttcgccttggtccgagctggctccgcggcggcaggggctggagattgcggagtttggcacggccagaaaatttttagcctctgacagatcggtgcaatagttgataaaatcaatgttctgtccaagcatcctcctccaccctgcctaccagttctgctacactagagaaaacaagttggaggcagcaacgattatggagacgaaatatgggcggcactctttttttgatggtggcttgttggcttatgtcggctggacgattcttggcactttgatcacgatttttacactaggcatttgttatccatgggctttgaccatgctatatggttggaaaatcaatcataccgtgattgaaggtcatcggatgcacttctttgggtcggccgtgagcttgttcggcaattggattaaatggttgttgctgacaattatcacgttggggatctatggcttctgggtttttattaaattagaagactggaaagctaagaacacgcggtttgttagctgacgcatcgtgattgcattggagaaggcatgttatgaaaaagttttggttgggttttggtcttttattgctcattttaacagctggctgcggggtacaacataaagtggctaaatcgagcagttcagcggcttcgcttcgcagccgcaagtcgcctagttcgcgatcctcagctgcgattaagcagacaagcatgctcgcccggctgaaggcaaaatcacaaacgacgctcgtgtatgcaccgtttggcgacagcctctctgttggtttgtttgcgaatagtaaaacgagccggtttaccaccctttttgctgaccaattacatcatttgactgacaagacggtgacagaggaagggattgcagaggtgggaaaaaccgcgactaatcttggtgtccctgctctgccagcgttgattgcccagcatcctgatttgattaccatcgagtttgggacgaacgatgcggttggcggcgccacaccaacggcgctggctgattaccgccaggctttgacaaccatcgtggcaaccttgcagaagcaaacaacagccgagttgatccttatgacgacctggtcgccaaaccatggtccttatgccgccgccgatttgcaatttgatgctgtggtcaaacaaatcggtcaaacttatcacgttccagttgccgatctggcgaccatctggcaaaaccatgatgacgtcacaggccctgccggtacagccatcaccgacttcgctggtaacggtccgcgcgatacttttcaccccaaccagcgcggtcatgatcagattgctgccttgctcaagaaaactttggaggaataacttatgcaagatgttttaaaattttgtcccaactgcggtcaaccaattaaaccaacagacgacttttgtcctaactgcgggtttgatttgcggaaagcccgacttgaagcccaatcaacccaagaaccagcatcgacgtctcctgccgaggcaccaaaagcaactcagtctgcgacagttgctgcttcaacccagccggcgcagcaacaagtacataaacgccggcgctggccatggatcgttgttggtgcggttgtcgttcttttaggtgcggcctatctcggcggatcgatgtactatggtcaaaatcgacaagtcgctgagttggctgatgaaatgactagtggagatgccgatgacatggctgaagttgccattgcaaacgatggcacaccattgactgaaagtgaccttaagccgctcgcccgtttgactaagaatcggctttatcgcagcaccttgcgaaccatgatcatggacaagcaaaccaatggcatggttcaggtcgtcaaacaaggcagttacctgctacttttcccgaaatacaaggttaagcttggtaccgccaacgtcacagtcaaaaccaaccttgacgccgctgctttcaccatggatggcaatcaaattcaacctgaaaatcgttctggcagttataccattgccagtcaattacctggtctgtacgccctcaagctgagcggtacgcacgaaggaagtacgaaagacttcaatcgtgaagtcatcgtcccgcttaaagggcaaccagaagcactgaccttggatgccgcaaccgctgccaagacggttacaccaacgcatgacgccacaagcggttcttcaacatctgaatctcatgatgacgatgatgatgattatgatgacaatggtgtgaccaaaacgaaccgccagtatccttctgatgcttcaaagcgcaatgataatcattcaacggatggcgtcgtcggtcgctgggaatcaggcgacactgccactttcaacttcaacagtgacggtacttatacggcgaccagcaatggcacgccaacaaatggcaagtgggaagttgtttatcgcgatggcaacatcttgaatatcaagttcaccaaagatgatggcagcagtgtcgtcgaacctttcgcattggacgatggtgatttgattgaaactaatctgaagattaagtgggatcgagactaatgcttgactgaggtgaacacccctttgttcagaaataagactggtgcgtgccgtcttattttctcccgattccttcatctaacggtgttatactacatgctgtcatatgtttttagttgttaggaggtcgttgctatgttacattctgaaaaatggcggccattgatggtcaccttgatcgtgatcgcggcaatttttgcagccttctttgtcctagaggccttcagtggcatgggaatgggcttcttccacagcaatatgatgtccaacgtctcttcatggggcagtcatatcggcggttgcatgcgctaaccgaaacaattgcttaacgtcgattcaatcaaaccgttgcgttttttgacgcagcggtttttttctgggctgaaatcacgttatgcttgcttacgcaaacgtatgttcgtataataattgcagaggtgattttgatggcctacgattattcccacgaaccgcatcgaacggttttcctgattgacaataaatccttttacgcttcagttgaaagcattgaacgcgggctgaaccctttaagaacccttctcgtggtcatgtccgaacaagagaatacaaatggcggcctcatcttggcaacttcgccaatggcaaaaaaaatatatggccttaaaagtaacgttagccgtcaacgggacttacctgtggataagcatctgatcgtggtgccgccacgcatgaatctttacatcaaaaagaatctggccatcaatgatatttttcgtgagtttgttgccaatgaagacttgtggccttattccattgatgaatccattctcgatttaacgcacacatggcgactctttggcaaaacaccacgtgcagttgcgcaattaattcaacatactattcggcatcgacttggtctctacacaacagtcgggatcggtgacaatccgcttcaagccaaaattgcgctggatgtttatgcaaaacatgatcctaatttaattggtcaaatctcctatcaaactgtaccagataccatttggcagatcaccaatatgacagacgtttggagtatcggtcaacgaacagcagcgcatctcgcacgtatgggcatcacgacaatgaaacaacttgctcacgcaaatccgtatgccttaaagcaagaactgggcatcattggcacgcagttatttgcgctagcatggggcattgaccgcacaaaaatcagcgaacgcgtcatcacccgcgaaccaagcattggcaactcacaggttctgccgcgcgattatagcaatcaagttgaaatcgaaatcgttattaaagaaatcggcgaacaggttgccgcacggttgcggcatcatcacaaacgagctggtgaaatttccctaggtatcggcttttcctatgctgaaagtgaaaaagacgggcgtgacgggtttcaccaaactaaacgaattttaccgacgaatcgggatggcgatcttgttgccacactgcaactgatttttcggcaaaactggcatggtgaggtcattcgtaacgttgccgtttataccggccgcttagccccagataccggcgaacaactcaatttctttgagccggttgatcaacaaattaaagcaaccaatttagaacgcacgctagatactattcgcgatcgttttggctttaagggcttgatctacgctaaaagtgcgatgcatggcggaacggcgattcaacgggcatcactagtaggaggacataatggcggcaatagctatgactaaagatttgaagctaatgatggcgcgattaaccccccttttcaaacgacgccgtcaaacacgttactggctatcactggtcaatcaaacctatacaccggcatacaattttttcatgaacgttcagcctaaagatcagcgccaacgttccattcccttacacagcctaacgaactatgatctggctgacttagaaactttcattggcctgcttcgtcagcacacgcaactcacgattgaatatgtcggctttgaagagatgcgctggcctgaatcaaatcgggtgattcaatggcggccgcggcgcgatgaataaacgcgtcaatttcaaaaagtagccaagaaaaaagagcgctggcacagcactcttgcggatggtattttaaattcattttgttaatacgcaattgaataggaatgccgctcatcaaccacaaaggactccgccatttcagggccgtgctgagcaagaatctgatcagcaagatacgcctgcaggtcttcgtggaagtaagtctcaaacccaaacccccaggctgataaaagatgccgcccgcgccgccgacccgcacggaaattttcataaatcgcgtggtaaatcgtccgtcccgtcaacttgaccgtcaccggcaataccacccgttcaccatgatgttgaaaacgaacattcactgttcggaaagtcataaagcgaatcactagcaataagcatggaatcatgatactgagacccaccaaggccacaaaaatgataccgagtaccagcccaacagcgctaattgccatggcaccagaaacgaccacgctcaacccaatgacaaacaaaatcaacagtagcgcgggaaataaaatcacaccggtcactaagacccagagtaatagtttaaatgctattttcatacagcctccaaataatcatggcgctcattcaacagaaaccagatgcacatcactgacaccgcgaatgtcgccaagtttggttacaagatcatctaacgttccctgcagtgccgaaatatcaaatgacatcacaacactagcccaattatggatcggaatattttggttgatggtcacgatactagcttgcgcttgcgacatggttgtcagaacttctgataaaatgccgcgatcgtgatgcaacatcaacgagatgaccgctttacgcgatgccatttctgggtcgggtaaaaaaacataatctttgtatttataataggttccacgggaaatgccgacctgtttgacggcctcgctcacctgcttaacctcgccattttggagaagtgcgcgcgccgctatgactttaccgacgacttccggaagcatcgaactgtcaacaatataaaactgcttcacgctaaaacctccaaaacgattgactaaaactaaatgtccttgaataatagacattcgttcagatatgttcatattgtaacagtgattgtcatttctgcaaacccactgtcaacttgtaaaaggtttgcaataaaaaaagtcaagcaaaaagaccgtttttacggtcttttaaaaaaatagcagcgtttttgaccagagggatgatgacattttgatgagtctgaaagcgtttaagtgaagtgcctttaatcttgatcgtttttgcggtaggctaagactgtcattgcggggagtattagttaattcatacaaagcgtgcgcggacacgtttagaaacctgaacatccgtgacttgaagcttaaatgaatgggtctttgaccagttgggtttcaaatgtttatggacaggtttctgcgcctgcgaacgcatttataagggggccttcacatgaaggtacagcatacatatcatccacatcatttctcatggcattttgtggtagtcgcggtcatcgttggctttgtcgtcttcattgaatgctggccgcatgttagcgacaatacactcatgggaagtgctttagtcactggcggtctgtgtattgggtcaatccgcatggctcatcatcacgacaaggatcaggaaaaacaaaaataattaaaaaatgagtcgcgttttgaacaacgcggctcattttttaatgtggtggtctcaatgattaattcgctatctgggtcaaaaaaggtgctggataattgaccttaccgcgaacacttgccaaaacaccaggcacaagttccttaatcaaatggtcttcagtgacgactgggaaaggcggatcgagtttgtacttggctgctttttgaaagccaagtcggccaaagaattgtcgatcgccgacaacactgacaaaatcacgccgcaaatcagttgctcgcatgtcgagttcagtcacaatcgcgaccccaatgccaccgccttgatattcaggggcaactgctaacggtgccagcgccaccccttgcatatgggcatctggcgtaatgctggccgcggtcattagcccgtagccgaccaaatgaccgtccatcatcgccacaacttcaaaggctgaatcataattaggatcacgccgcagtccggcaactagctctgcctcaccgttataaccgcgattgctggcattgaatgctgcatgtaacaaggcatctacatcagcaaaatcattttgttgtattcgtcgaatggtcatatgcgtctccttttagtttattaattctattatacacgtttccatgcaaagccgtcgatgtgaggatttgggcgcaacccagtagccaaaattgttatataattttggctaagcagctactgcattgtaaaagccctgccagccatcacacgcggcaaaacttttgcttaacaaaatcaagcaattcacgtgagcgtgatgatcctttcgaacggtcctaatggcctttttctggtgtatcttgacgctgcttgaacttgtctcttcttcatgatgaggtctgctgatcggctcctggctgcttttgcttaggcgctgtcgcttcatctgggaaggtcaacgtaaaggttgtgcctttgcctagggtcgaatcaacatgaatggtgccaccgtgttgtcccattaactgatgcacaatcgccatgcccaaaccggactcaccatatttggtgtttttacgtgacggatccgccttgtaataccgctcccaaatattcttcatctgatccttggacataccaataccagtatcgctaatggcaaattcagtctggtgataccccacttttgcttttatggtgatttggccatttttagtgaattggaccgcattttgaacaatgttgaaaagaatctgaacgaaccgatcatgatcagcatatgtcggcagatctgctggggcatcaattgtgatcttatcaccagcctcttcggatttctgcgccagctgttccgcgatgttatcaaggtccgtgcgcgcgttaaacgtctgtttgctgagcaaaatttgatttgtccgaattttttcataatcaaggttctcgttgacaagccgaatcaagcggttcgtttcgttccgcattaattcgatactctttcccttactttcttcagggatggcatcatacgccaagccttcaagtaagccattgattgttgtcagcggggtccgcatttcatgagccgcatcagccataaactgccggcgccgatcttcctgccgttgaatttcttgctgactagcttttagtgaggtcaccatgtcgcgaaaatcatcggccagttccgcaacttcatcatgactgcggcttttaatttttacttcaacatcataattgccttctgccacttgatgcgttgcgcgccgtaattgattaatccgccgtacctgataggacgcaatgaaataactgatgatgaacgccgcaagcgttgacagtacgaacgcgataagcaaattatgctcagttttgctaattgaactttgaatttgctcaactggcgcaaaggcggcaatcacaaagagtaatttttcactcagaaaaaccggttgataatagatcgtcatgctttgtgcatggccgctgattggattcgtcatcatctccgggacggcaacagccgccccttgctttagctttttccaatagcttgccttgatcgctggcatctgacctttttgggacacaggatatttagcaacgttattggcatcataaataacaaaatgcacgtgttgatcgcttaaaatctcttcagcattttgaataaatctggcattgatgacgtaagtattttcatcaaccgcattattttttaaaacatccgtgtattgctctaactgtttaaagccattttcccaaaccgtgttcgtggtagaccgaataaacagaatcgagacaatcactaaggtcaccataatgactgagaaaaagccaatcagctgctggtagagcattttcatcgatcaagccccgaatcatcaaacttgtagccgacgccccaaacagtttgaataatttgcggaccgactttttcgactttttggcgtagttttttaatatgggcatctacagttcgttcgtcaccgtaatactcataatcccaaaccaattgcagtaattgttcacgtgagaaaacctgcttcggacttttcgacaaggtatgcagtaaatcaaattcctttggtgttaagccttcaatttgcttaccatccaaataagcttcacgtgttttggtactgagcttgaagtgatcagtttcaacatcaaaaccgtcaggcggctcgcttgttgtctgctcagcacccacttcggcgcctacctcagcccgacgatgtagggccttgatacgtgcaatcaacgtaatcggtgaaaatggcttggtaacatagtcgtcggcaccaagttccagtcccaatacctgatcactttcagtatcgcgcgctgtgagcataatcaacggcacagtttgactgattttacgaatttcttttgcgacctgcatgccgtccatttttggcagattgaggtcaagcgtaataatatcaaagctgtccggtgcttccttaaacttagcaagaccttcttcaccatcataggcgttgacgacttcccatttctctttttgaaagaacatcgccatcatttcggcgacactcgtgttatcttcgatcattaataatttcatgatgtacccctcatttcacagatctttaaagccttttttgcgttgcggtttcggtgcatcgtctggtgacacatagtcataaggcagtgcatcatgggcttgcaaataatgctttaaccgcgtctcggtatagacaaatcctggcagaaacaacaggacggccaaaaatagccaaacaataaagaaattgtcccatgccagaaaatggatcaaccagcccgcaccggcttcaagtgcgcctgtgatgatcaatgcttggcaaaaccaacgttgtgccaagcgaaagctttcggcattcaccccggcaagataggacgtgtagccccaaaaaccagattgatgacgcggtcgaaaaacagcaagaaggatgcccatcagtaattgcatgcatccggcaataagtagaatcatagacatgcctccataaaaatagcttaaatccgaatttgatgccagtctaaaaccaaacattttgacaagcttaattataccgtggtatcataacgtttgcaccttaatcgggggtgtaatggtctcgacattgcttttcgcacatgcagtgcacctcggaggctcggctccgtcatcaacggaacagttaatataactgcaaagaacgaaaattcttacgctttagctgcttaataaccagctagcgtgatccttccgacttcgctcaagggtcgggtctgggtctcaaattattgagctacggttaatgttgccacctgaggcattaacaagagactagtaggttagccgccttgtgttagccttgctggctggcgcgacatcgcggcgaattttaaataagtcagctataggtgtagagctgcatgtagcaggggtgatggacaggagttcgattctcctcacctccatttatcattatcattagctttcaccagtgttcaaaatgccggtgtaacagcattttatgtttggcagatagtcgctgattatcattagttggtaacatcaggtaacatttaggtaacattttaatctgctaggcaggcggtggccgtccattacgggcggctattttattatctattgttgctactgtatgttatactgtgttcgtctatagagacaatataaccaaaaaggaggaattatcatgcattttctttgggctttaattgttggtgctattattggtgcaattgctggtgctatcactagcaagggcaaatcgatgggctggtttgctaacatcattgcaggattagtgggttctgcaattggtgagggacttttaggccattgggggccacaactggcaggaatggctttgattccttcaattatcggcgcaattattgttgttgccgtagtctccttctttgttggcagatcaaaagactgatagggggacatctttatggacgctttaaaagctgcatttaagtttatggttgctagtactctcatcgttggcggtgttttagttgcaggtacagtcttcgcagctaagggcattgataatgctggagataaactacaagaaaagctacatgactaacacaaaatagccacttcgctatgaggtggctatttttgtgttcaaaacaccaatcgtttgttaaaatgatgcgacgccacgtatacggatttgagaggtgttttagatgccccattatgctgtctttaactttattgttggtattttgtttctgattttgggctttgtgttcttattgttgagtatacgctgggaaaaaccgtcaggaaaccagcgaggtatcactaataagtctggagtgtggactggatcaatattcatgctattgggagttgcaaccattttaatcactttattgactaagtgactatttgtcacctggttcccataagcaggtagaaatttttgacttggataacaaggcacgaaattcggactctgttagctatttagatattatcgaaacagtcattgaactacggagggagtcgcgaaccacgaccccttttttacatgattatcgcagttcgcgacaaccattcctcaagttactcttgttcagcgtgcatcagaatgcgtctctcagcacacaaaaaaacgggcatctctgcccgccaattgaaaacgacaagtcatgtaatcagtttcccaagcagaacgatctgctaaacaagaaactggctatttttatgaccaaagaggttagtgtaatgatgatactgtactgcctggatttcagcgaggcaaaaagtaacctggtctataaaatgcgccaccggttagctatgccgtgcgtcggttaaaacggatctacccgcttatcgcctaggactatcttaattatatcataatcttttggctattgatactatacgttttccgtaaacagtcctcttaactgctggatcatgctaaccactgaataaggtggctcttggcttgctgtggtaactgctccacgattctgataccagaattcggtcaacatggccacggcaatatcaaactgcgagtacgcttgtaaggcatcaatcgccgctgtgctgtcaacggcattgtgaacatagtcttgcgccgctgtcaggtagttgctgatcaaactatcatcagtattagtttgcacacgcaggctatttttaatgtcattagtagttacagtcatgtgctcatctccttataaaaataggggcgtaccctaaggcacaccccccactaaattatgcttttggcgtggctgctaccggtgtgatgtcaacaattcgagcagcgtctggatcaactacttcgtaatcgttgcggatgacaaccgccaaaccttggctataactgtcgaaccgttcccattgagtgttgacttcgttcttttgggctaagaagattgcttgagcaaagtctccaatgatgatccgataggtgccagccttatcagtaggaagcaccttattagaaatgacgatcactggggcaccaaacagttgcttgcctgatggtgcagtgattgaaggttgtaacaagtatcggccctcgctgtctttcagtgtatcaaggtagttgaaagcatcctgattgacgataacagacaaggacagtgctggatctaactcaacattgaaggtttgcttgatgtcatcgagaccagtacccgtgatgtgcttgaagttatcgttggtgcccgtcttgccagtcagaacactgataatgttgctattgtccgtgttttgtaccagcttcttgagttgatttttaacctcggcaacaatatcaacttcactgtcttctaccagttcattagacagataaatcttgccagcacgggtagcaaccttgtagtcaacacctttaaacatattgacgtcaacatcggccacgtctgcaagttctgccttggtggctaaaacgccattgttggtaagggcgatcggataggtgccgacaggggtacctacttgcttcacagtgacgtatttagccaggtcataatctgattgctttaagtcccaaacatcattgatgacttctttaggaacgactgcaccagcggtggttgtcgttaatccgtcacgttgttcacctggatgtaagctgattcctgagacaacttttaagagagggtataatgaataaatcaagggcctacacgttcagtgttgattatttctcaacaccagaaagtgtagacccaaaaaaatgcagccgcggctgcattttttaatgaagtaaaggtctcgtaacgttggctaatagatacccttttcatcctcatctactagcggatcattgaagtttttgtggaagtaggtgctgtcaatgatcttgaatttgccattggtgaagcgagcgatgatctcaccgtattgtacaatcaattgctccgtgttggggatgtcaattttgagacggccaatcggggttttggtgaggtattggtaatttgcgccaaagaagcctttcaagtcgtcagtgctggtttcttgtgagtaaggtaagaagtgggtcatttttgcagttgaaaaagctgcgaattcaccttttggaaatccttgtagtgatgaaggcatttgtgtcatggtgtgattcctcctgattaaagtgctttgctactgtggccaaaacgcgtgattcagcagcgctgtttggttattaatttacttatcatgatggtaacacaataatagaacaattgaatgtttgcgccgcggcctgaaaacgcttaatattaagtctggacgttgatcggaggtgagcatatggatcaaagtctatttcaaaatggtaacttccaacctttggcgagtcgtatgcggccacagatgcttgatgagtttgtcggccaaacgcatttgctagggaaggataaggtgctcagcaatcttatcgaacatgacgagattagttccatgattttctggggtccgcctggtgtcggtaaaacaacattggcgcggatcattgctcggcgaacgaaggcacagtttgtgacattttcagcagtcaccagcgggattaaagaaatcaagcaggtgatgaaagaggctgaacagaatcgcgagctgggtcagaaaaccattgtgtttgttgatgaaattcatcgtttcaacaaggcgcagcaggatgcctttctgccatatgtcgaacgcggcagcattatcctgattggtgcgacaaccgagaatccttcgtttgaagtcaatgcggcgctcttgtcacggacgcgggttttcgtgttgcacggcttgaccagtgctgaattggttgacctgttacagcgagcgttaaaagatccgcgcggttatggtctgcagaaggttaagatcggcaaaaagctcttagctcagattgctgattttgctaacggggatgctcgaatcgctttgaacaccttggagatggcggtgacaaacggcgaaaccaaaggcggcgtgataacggtcacccaagcagatgtggcccagttgttgacgaagaaagccttattgtatgacaagaatggtgaggagcactataatctaatatcagcattacacaaatcaatgcgcaattcggatgttgatgcggccatttattggctggctcgaatgctggaagcaggggaagaccccttgtatgtcgctcggcggctagttcgatttgcgagcgaagatatcggaatggccgactcacgcgcattggagattacaattgctgtttatcaggcgtgtcaatttattgggatgcctgagtgcacggttcatctcacacatgcagtcacctatttggcacttgcaccgaaatcgaatgcactctacacagcgtatgaaggcgcaaagaaagatgcgaccgaaacgctggccgaaccagttccacttcagattcgaaatggggtaacggatttgatgcaggatctgggttatggtaaggactatcaatatgctcacaacacaaaagataaactaacgaccatgcaaaccatgccggataatcttatcggcaaaacgtactatcatcccacgactcaaggcagcgaagccaaggtcaaggaacggctagagcagatcaaggcctggcatgcgcaacaccctgaccccgattcgccgaaaaccaagaaaaagtcatgatgctgtgcgattacgtgtgcggcaatccgactacccgtttagaggaggaaaaaaacaatggcaaaaattctcgcagtcaacgcaggcagttcaaccctgaagtggaagctttttgatatgccagctgaggttcagctggcagaaggtttggttgatcggttgggacagccgcaatcaaaagttaaaattaagtatggtgatgggcagaaatatgaaagcgatacgccaattgctaactatcaagaagccgtcgccagtttgatgggtaacatcaaggcgttagggttggttgaacatctgcatgagattactggtgtgggccatcgtgtggtagccggcggggagacttttgccgaatccgttgtagttgatgatgctaccttgttgcagattcaaaacctgcgtgactatgcgcctttgcataatccggttgaagcagactacattgatgttttcaaaaagatgatgccatgggccacagaagtcgcagtgtttgatacggcgttccaccaaaccatgcaacctgagaacttcctttacagtattccctatgactattacaagaaatatggtgctcgcaaatatggcgcccacgggacaagtgtgcgttacgtcagcgcgcgggcagctgagatgcttaacaagccgttagaagacttacggatgattgtgatgcatttaggctcaggctccagtgttaccgcagtccaaggcgggcagtccattgatacttccatgggctttacgccgttagccggggtgacgatggggacacgatccggtgacattgacccatcacttgtggcttatctcatgaagaaacttgatgtcccagatgtgggtcagatgattcatattctgaacaacgattccggcctgcttggtatttccggcatcagcaacgacatgcgggatctggaagctgacgaagataccaagccacgcgccaaactggcattggatattttcgttaaccgcgttgtgaagtacgtgggttcgtacgcagccttgatggacggcgtggatgtgcttgtcttcacagccgggatcggcgaaaacggtgacgagattcgcgacaagatcatgcgttcactcgattacctcggggctaaaatcgacaatgacatcaacaacaagtcgcacggtgttgaagctgatctcagcacaccagattcaactgtcaaaacattgctcgtgccgaccaatgaagaattaatgatcgtccgtgacgtcatggcattgagctaagcgttaatgacttctcaattaaaaaaccatctctcgactgaaggagagatggtttttgtgtctgcataagcttctgaggaatggacgagcaaacagacaattaattggcgttaatcccctgatctgaatcaatcatgacccctttcgtttcatcgaaaacacagatattgccgtaattttctttataagtcatatgattgccgccatcaataaagtaccgcggtgattcgtcaggatattgaatgactttaaccgggcatttaggataaccgtcactgaatgaagttggcggtagagatggtttgacattgttttcatagtcgccataaatcaaggcagttggcgtgtgaccggtgacaatcgttttagcgatcggattgtgagcaaaaatgggatgttcccgatttttggtttcgtccatattatagatatacggctcacggacccacattcgattaaatggcgtcgtttcttttaaaggatcttccagcgataggtctagaccggcgtggatgagcaacagcttgtcaaactcaacagcagttggcatctcggcgatgaattgaatcagcggtgacatgtaggtcaacacggcttgttgtaggttgcttttgcgtgctttagctggcgcgtaatcttgcaccatttgacgtaaggtagcattgccgccattgatgaaccatggattatctttgttggcgagataatccagcagcatctgatcatgattgccacggatcgcgattgcctgactcgcctgcacctgctcgtgaatttgagtgagcacccgcccgccgtatggatagccatcaatgtagtcacccaaatagacggtcaaagtatggggatactttgcttgcatcgcccgcactcgatccattgtttccagatgaccgtgaatatctgagacaacgatcatggtcataacgtttgcctccttataaaacgcatgctccagtcccaaaacctgcagatagggcttttggtcgcaatagtcagcgcttgactgtcacgattaaaacgacttatatttcggttcctaacaggactgcgccgcgttttgcaaaaactgctgataggaccagtttactttatttttagaagaatgtgcgatattaataggggaataggggtgaaaagatggataaacgcttaatcgtcatgcataatctgagccgtcattatggcaaacaatactggtggcagcagaattcgttggaagattggctgatgatgattctcattcagcgcaccagttcaaagaatgttgcccaagccgtgcataatttgcaaccttacatgcaggttgatcgcttgatggcgttatcgcaatcagagctggaaacgttggtgcggccagccggcttttatcggcaaaaagcgcagcggattcacgatctattgacgtggtttgtggcccaaggcggtagttttgagaagattgcagaaaaaccggcagctgagttacgtgaaaccctgctggctctaaatggcattggcaatgaaacggcggatgtcatgctaatgtacacctttggcaaaaaaacttttgtagctgatacgtatgccatgcgtcttttcaaccggctcggttttggaccgtatacgaactatgccaaaatgcaggctgattttgcgccagcacttgatcaaatcacgttagacgaagctcgcgaatggcatgccttgattgacgaacatggtaaaacgcaagttcggcatgcgtatgacgaccggtttttactgcagccagatttgactgaggcggcatggccgccggaagcggttcaagtagagccgccccatgatgatccgggtagcggcaagtggcggcacgcagccgatccgtcagcgatgaatgaaaaataataattcttctgtctgtgatatttttgaggacgcaccagaagccaaccatttccgcatactgatgatttaactctagcgataaagaggaagattgaacaagaaaatgtgagtttcagtgctccatttgttcatggaaaggacactgggggtgagcgactattcggcacttccggtgtctctttttttacgtttaaaagtaaacttcgccagtttgttaacaagctgatttttcaacggcctacgtaaattgaccagttttatttaagttactcatgttggtatccatttgacatagccatcctttataatgggaaaattagagaaaataaattcaagactagaaggttttgatggtctgatgttggtggggtttggccgttctcaaaaaagtctgccacgcatcgtctgaaaggcggaaatatctattaaaaatgtgagggggtattcaacatttgattattagaatgtgttaagttttcttttgggcatgagggagaatcactcacgaacttacaaggggtcaatatgattattgtaaaacatattcggttaattgcagaacacacacttatcagcgatgcctcatttacactgagcactgggaaaatttatggactttccgcgccaaatggcagtggcaaatcaactcttttacgttctttagctggtttacgaaaaagtgacggtggaaccattagttttagcgatcttccatctcaaacttccatcaaagaacagtgtttctactttgagaactcttcgtggctagattcaaatttaactgggtatgattatctaagcttgataaatcatctttggaaggctgatcctaaacatatcgaagaagctataactacttggcagatgcaagactttattaaccgccctattaagaagtattctcttggtatgaagcaaaaggtgatattgggtatgtatcaggccacagacgctcgttattggctgtttgatcagcctacgctggcacttgataaacaatcggtgactacatttctaaattatttgagtaccgctcgaaagaagaataaaatggtggtttttttcgtcacatgcaggagatgaagttttccatatatgcgatcacatcctatcaatcactaatcccagtctttttcttgatggagcaaacactaatgcgtagttattcaaaatttgttatcaaaaccacattgcgaaataagttcaattttattccggtgattctccttattggggttacactttttttgctcatcatgaatacctctgccattaaaaaacaggggtacaaagcaagtatccaacaaaatattgccgaaacaaactcgctcatcaatgtctacacaaaaaacatcaatgaggctaaaacaagtaaggatcgtgaaattccatacagagcccgagagcaagctaagcaagttagatctgataatcaactttcacttgaattagctacgcagcaaaaatggcggtcctcacttaaagttcaacttcagattattaatgctaccgacatgcaaacgattaagcatcatccttcatcggtttctcctgactatatatcctcggtatatgctaccagaactttatacaaacgcctgatcaagttaaatttacggcccgatgttgttggaatggagacgcaagggtttccattcacattacgaatggtagatgttctctttcctgttgcagttgttttagtcatggtcaccttgctcacatcagtcttcacacaaacttttattgaccatattgatctagatgatatgtggccgttatccagaagtaagctgatcttcaccaaaatcggattttcagttgtttttgcatttgccatttatctggtctgtcttgtacttggtttcgttggagctagtatgataaacggctcaagtagtttagactatcctattgtgatggtttccaattcgtcaacagatatcatctcagttcgaacgcttttgttacaatcgctacctctccagctcttatgtataattttcatgacaatgtgcgtatacttgattacttatttaattcgaaatcggttagcagcgatgtttatgaatgtactcatcttctgtggcgctagtctctctgtactaaagattgagccaatcagtcacatggtccatctgttacctttctcatacttcaatacgattaatgtgcttacaaagcaagcagctcatgataccggcaatcagcagttaacttttgctacaggaatatgggtattaatattttggattgcagtgattggcgttctaattgccgtagtaaactgggttcactctcgacgacttcagcatcgtacggtttcttagtgacatatttaaaatgcagtctaattactattaacctactagtatccccgaaagcttaagtattagaaaaatcaagaagttgtctgaaaatacgggactgacaatttgatgaaaatgaagtagggatgacacacaaaaagatcacggcgattgtcgtgatctttttgcgtcttgaaacttatttttcgacagcttggagcttttgattgtcgtcgagttgtgagatacccattaagtgatgacggtactatcccctgtcaagttgacacttataaaaacgaaaacacaatttttcggccaaagcccagccatttaggcttgaggccacttaggctccggtttctaagcgcgcctgtttgcgctctgcccaagtttacccgaaaaaaacagtgagtacaaagataacatactcactgctttctcaaattatgctttttgtaaggcttctttataatcgttatttgggcagacgacttgggtgccagctttgctctttttctcaactaagaaatgtccgcagactgggcaatcacggccgactggtttgtcccatgagacaaagtcgcagtctggataacgcgagcaaccataaaagacgcggttacgcttgctcttacgttcaacaacttgaccgatatgacatttcgggcagacaaccccgatctctttgacaatggccttggtgttgcggcaatctgggaatcgggaacaggcgtaaaacttaccatagcgacccattttgataaccattggcgcaccgcagatgtcacagttgaagccggctggttcgtctttgatttgaatcttcgcgatcccagtttcggcgtgagccacttctttttcaaatggcttatagaactgatcaatcaccttaacccaatcagcctcgccggtttcaatcccatcaagttcagattcgacgttcgccgtaaacttgatattcacgatgtccgggaagaattcaacgatcaagctgttgacgatctcacctaattcagtcggttcaaaccggcgagcattcagtttcacgtagtaacgtttctgaatggtttcgatagttggcgcataagttgacggacgaccaacgccattttcttcaagcgctttgacaaggtttgcttccgagtaacgggctggtggctgtgtaaagtgttgagccggatcggtcttcaacattttgacatcatcaccaactgcaagcggtggcaaaatattgtccttttgatcgctgtcacgtgatgagacatacaacttggtaaacccttcaaacttagtctgactaccgttggcgcggaaagtcacaccgttttggtctaacgtcacggccacagtgtcaataatcgccggggtcatttcactggcaacaaaccgactccagatcagccgataaagtttcatctgatccttgtccaaaactgccgtcaaactatccggtgtccgtaatgtgctggttggccgaatggcttcgtgggcatcttgtgccccttcctgcagtttaccttggcgaattttgacagcagcataagcttcgccgtatttctcatgcaggtaatggctggtttcagttttggcaacatttgacacgcgagtcgagtcggtccgcatgtacgtgatcagcccaacggtgcctaacttaccacctaagttaattccttcatacagttgctgggccaacatcatggtctttcgggtgcggaatcccaacttacggttagcttcctgctgcaaggtactggttgtgaacggcggggatgggaagcgtttgcgttcctttttaacaacattcgtcacagcaaacggcttagttttgtccacttgacccaaaatcttttgaacggcctcgttgttctttaaagactgctttttattcttcaggccatagaaactagcactgaactttttactacggcccttttggaactcagcgtctaatgaccagtattcttctggcgtgaagtttttgatttcattttcgcgatcaataatcagctttagcgcaacactttgaacgcggccagcactcaggccttttttaactttcttccataataaaggactgatggaatagcctaccagtcgatccaaaatccgccgtgcctgctgggcatctacaagatccatatcaatgccacgaggggttttgaacgcatttttaacggcatctttcgtaatttcgttaaaaacgacgcgatttttggcttttggatccaaacctaaaatgtgactgacatgccatgcaatggcttctccttcacgatccggatcggctgcgagataaatcttgctagcttttttagcatcttttttaagggatttaatcacatcgcctttgccgcgaatcgaaatgtactttggctcgtagtcgttatcgacatcgacccccatctgactcttaggtagatcgcgaatgtgccccaaacttgcaacaactttataggttcgaccaagatacttttcaatagtcttggctttggctggcgattcaacaatgactaacttcttgtcggccatgaacgctctccttccggtggcattgcctagtaggcaagccctgattaatttgtgcgattctgacgattcgtcgtcagtaattgatgcgtcctaaggcggcaatggatcatctgccaccggcgcgaccatcaaagcaatcgcaactggtgccagtctaatggtcaatgccacctgctgactcaaaacagttgctatcataagctagtcattttgctcttgtcaaatcaaaagaaattttttctactataaagtaagcaataatgtgcacctcaagggtaaaaattcaagttttctaccaacgtctctggaccagtcaccaacgctgctcctgcctgaatcagcgcatttgtacctgctcccaaaggcgcatcaattcgattaggcaacgcaaaaacttcgcgattatgttgcaaagcatagttagccgtgatgagactgccgcttttcatctccgcctcagtcaccagcacaccatgggcaataccggcaataattcgattgcgagcgacaaattgaaaacgctgtgggccggttgctggtggatactcacttaaaacaagcccaacatgcgcaatctgcacctgcaaatcgcggttcttggcaggatacacctgatcaaggccgttggcaatcactgcaatcgttggcagtcgggcactgagggctgcctcatgcgccatcgcatcagctcctgctgctagtccacttacaatcaccattgacggtagttgcggcaataactgcgccagcgccgtcgctgaatagccggttgcacgccgcgaaccaacaatccctaacgttaattgattcaacagacccaactgcccacgataaaaaagcaccaacggcggctgcggaatttcccgcaatcgtggtggataagcagcatcaacatacgtataaacggcacgtgtttggcagcaattaattgttgactaaactggtcagtcaaacgtttcttgagttctgcctgaaacggtgcgagatcgtcttttcctcggatagcttgttctaaagcaactgccatccgcggattctggcgtgtggcaatgtgccatgctagtaaaaaattgcgcagtgtcattgttggtcgtcctcccgcaaataaactacgcaaacacgacatcgacacactcaatgaagcactaagagcgcagtcgatcacggacaggcccaaaactgcggcgatgaattggggtaacgccgtgcgccgccaatccggcaagatgtgcctttgtcccgtatcccatgttgtccttaaaatcataaccaggataaattttatcgtacatcatcataagccgatcacgaatcactttagcaacaatactggccgcagcgatgctgatgctgttggcatcgcccttaattaagcgtttttgcggtaagtcgactggcacgtgcattgcgtccaccaacaaacattccggagcgactcgcagatggtcaacggcttgagccatcgccaattcagtcgcatggtaaatattttcacggtcaatcgtccgattatcagccacgccaatgccaactgcaatcgcttcagttaaaatatgcgggtaaagcacattgcgttcatgtacggtcagctgtttcgagtcattcaccggccactgaaaatggtgcggcaaaatcaccgccgccgtcacgacagggccagcaagtggtccccgccctacttcgtctaacccagcgacatactcataggttccccataactgacgctcatacctgctacgataacgtaaagccacctcttcggctgcttgatgggcctgtcgccgttgatacgctgccagtaatttgccagcaccgatgcgactgtcttctttaagtgccgccaaaatagccggtgcaacttcgtcagcagccagcaatgctttatactcactcagcgtcggcatctgtctcaccaggcttctcgagggtaaagcgtcccaattttccttgtcgtgcatcaaaaatcaagcgctcagccatccgatcgtaagcctcagcgaaaccttgtgatttcgtcaacttaaccagcagatcatggggcgcttcatttaaatcatcatcggtgacatggtatgcctttttcaaagcagctggataatgcgccataaagtaagtcagcccatacaagccaaccatgtcttcttggaaaactgcatcggcaattgcacctgtaaaggctaaccgcatcccaatcgtttgtgaggcaaacttcggccaaagaatcccaggggtatcaagtaattgaaagttatcactggccttcaaccactgttgattctttgtcacgcctggtttgttgccggtcaccgcgatgttacgccgaaccagacgatttaacaccgtcgacttgccgacattggggatgccaatacacatcgccttaatcatcggattacgaatgccgcgcgcctttttccgggcaatcttttccgccatcaacttcgtcgccaattgcggaatttgctgcaatcgcttggcatgctgggcatcaatcgcaatcgccgcaaacccttgatcctgataatattgaacccatgccgccgtcaacgccggatcagccagatcctgcttattcagcaccataatgcgcggcttatcagccaccagctcatccaacatcggattgcgcgacgattccggtgtccgcgcatcgacaacttcaagcacgaggtcgacttgtttaatcttttcttgaacttgtttccgggctttggccatgtgaccgggaaaccattgaatttgtgccatttttgtaactcctttagtactaagacaattaaaatctcagtatgaactatttcctaacgactagcatactgtatttatgtgaaaagtaacaactgcctgtttttaacctcgatagctacaaaagacttgttggtacgctcagtcacatactttttagtcgttaaccatctcgccaagcttctttcgagtttcttcatcccctggcagttgcacgccgataatattgccagcccccaaaagcttcagaaaagtctcaatcaaatagagttcgtatgcattaggaacgttgagcagcaaccgttcttctcctaactcttcgacctttagctgatcccacatttgcttaaaaacgggatcatccttcaccgcggaatagacttcaaataagacctttgaatccggcgttcgactatataattggcgaaactttgccgtaagcgcactggcataattttcccagtcaaccatgacaacacgaaaatgcggatcattgaacgtgcaaaaaaacgcgtacacacctcctaaaaggcatatacgcgcatatcataacctatttgattttcacttggctactgcatccacagccgccttcatcatcggatcatccttggtcaactgtgcactcaacttctgcgcgagggctgccaacgtatcctgatccgctgttcctgttgcgtcaagcttatttgcttgctggaacgttttgacagcggcttgggtggcatcgtcgtattgactattgacagtgacggagccgactttaagtgccgtgagcatttgttgcaaggacttcacatcgctgcctttatcgcctggtttgagctgagtggcgttgatcaaggtgatcttcgccgcggctgggtagtcgaccttgatatcaggtgtcaggcctttgtggttaatccaagtgccgtttggcgttaaccatttagcgatggtcagcttgagttctttgttgctgcccatttcgccgacattttggacagtgcctttgccgaaactcttttcaccgacaagcggaatgttgctgttttggtgaagtgctgcagcggtgatttcactggctgaggccgaattaccatcaattaagaccgccgttttttcagtgactttaaagccgtcatcgagtttcttgccagccttatagacttccttggcaccgttgcggtcttcgacttgcagaacggtttggccgtttttagagaacatggagctgatggacaaagccgcactcatcatgccgcctggattttgccgtaagtcgaggacaaaggatttggccccttctttgcgtaatttcttaatagtggccttgaattgtttgacggttggttcgctaaaagtcgagatagtaatgacgccgacctgtttgttggccgaagcaagttggccagtgacagtgtcaaccgtgattttctgccgcttcatcgagaaggtcgcttgtttgctgccgcgcttaacggtgacggacactgtggtaccgattttaccgcgaattttggcaactgccttgctaacggtctgtttggagacatctttaccgttgaccttgagcagcacatcgccgacttgcatgcctgcttttttggcgggcgtatcaggtaaaatgctggcgatggaaagactgtcatgattttgctggacggtggcaccgataccgccaaatgaagccgaaatcgtgtcatcaagattggttttatcgttattctgcaagtaaacggaatatggatcctctaacgttgccagcatacccttaatcgcaccatcggttaatttggtcgtattgacgcttttatagtagttattggtaaccgtctcataagcagcaataacgggtgctagttccttggggacacctgttttcaaaacactttgttgcgcttgctgataagaaagcgcgtaaccgcctgctacaccaccgccaagtgtgacgatgacaattatcaaaacggcccaccacggtaatctacgtttattgatacgaatcgcctcctgtgctttcactcgcctcataggcgcgatacgtttcgtcaaaaacggccatgcctggcaaataattgccgtttagttccagataatcgcttagtcgatggtaatccttttcttgcttaggaaagctttgatccaaaaaggcatttttcgcaaattcagcaatttcactatggtcattggggttacgcagggtcatgagatattcgtaaaaagtccgatgcattattgatccttccatgttttgtcgataaaagcctgccgttgtgcatgttctaatgcataacggcggggattcttagcataaaactgttggtgctcaggctcagccggataaaacggcttggcagcttcgatttgcgtcacaatcggatcactgaagcgcccactagctgctaaggccgtttttgaatcctctgcagcttcgcgttgggcatcatccttcacaaaaatcaccggtcgataattatcgccgcgatcctgaaactgacccatagcatctgtcggatcggtttgctgccaatagatgtccaacaacttcggatagctaatggtgtcggcatcgaaggtgatttctacagcttcagtatgtccagtggtgtgagacgaaacctgttcataggtggggttggcgacatggccgccagtgtagccggacactacattcaaaatgcccggctgctcttcaaagggttcaaccatacaccaaaaacatcccccagcaaaaatagctgtttcttttttcataaaatattcagcttctttccaatgatcactgattatccgggaggtaaactgcgaactctaagtcatcgttcgtcggatctagtttagttgcccgaagcgtcatgccattttggagtttaaattggctcaattttagcacaacgtttcctgccttactatcaagactgacccagctagggattttataactatgcccaatatagctcattacgaaactaatcgggactggcaatgtaccgacgttcaatttctttgactttagcaaaacatcgccatttttaagtaccaacggatcaaaggtcaactggaacttgacattattgccaagaaatttgaacgaaccattcaacgccgcctcattattgccaagggtgacggcgtatttaattgggctgtccttcagataggtttttaaataatgtgccatgattcggttggcactactcttggtgactttaaccgtgaaaaccgggtcgtttgaaatcgtcttagtctctgtggctgtgttcagtgaaaccggcgctaagacggttttggtaaaccaaattccgctacccaagataaggccaatcaggattaaaaatgcccatttccaccagttaatcattgaccagctgatcgatttttgtttgcgctgccgtttcttttctgtcaccctaatcactcccaatctttctttgtggctgttagtttcgtcatcaattgtttagtcatttgcgcataaccggcattattaggatgaaaatgatcttgcgaaaagatcagcgggttgccatctccagatgttgcttccttcaaagcctcttttgcagaagccttgttggcgacagtttccccatttgataagaccttatcgatgtcaatgtaatagacatgttggaaaccttgcaaggtcttttgcgttgcctgattccacgcgctcacgctattagtcatcgctgtcatttttggaaaataaacataaaacggattatagatgccaaaaacataaatcggtgccgttgcgttctccttacgaatagttgtgagtaaggtcgttagacatttctgaaaagccgtgctaccagcagtgatctctttttcagacaagctaagaaaatgttgctgcaacacatgcatcagatcattgccgcctgccgtcacggtaatgatattggcttgcttcaaatctgtacgaatcttcgcctgtttattgatgcgactaagaatctgggtgctggtgttaccactgacaccatagtttttcgtcatgacttgatattggccggtagcttccaaatcggcctgagtgagtccaacaaaaccaccgttattcgtggcatcgccaacgccgtatgtcagcgaatcgccaaccgccgtcagcttgagttgcttcggctgatcagccgtcagtttgacttgactgggcgcagcggcagggccgaatacttgccagcttaaaaaagccgctataccggctagcaaaatgacgccgaatgaaacaagaaaactttttaacatggccatggtgcctcctgtgtttctggtcaaatgactggtattaataggctattgtacttgacgttgtacaaattaacaaaggcgctccgtctgaatgatcattgacaatgaccaaaaacagtcgacaagggcgcccagtttgattcaaaaatggtgccggctttgcttctctctaaaatcagggcacaagtagccgcagatgcccgcctaaccgttttaggcatcaccagctgtcgttgccttgatcatgcctgaaaccgtgcatacggcgttctcaagccacaagtgttcgtgctttaaaaaagccggcgcttccgccggccagttaaattttattaaaaattaatcaacgtagtacgtaattgcaaacgcacctggccctgtatgggttgcaatgactggatcagtcggtcgcaccagaatcgggacactcggtagcacttctgcgatgcgccgaccaatgtcttcacctaattccttagcgccggccgttgaaataccaatacttttgatgttgctgagtttggccattttagcaattgtttcggcgatgaaattgttaatcgtcttcatcccccgacctttgcgtaaggctttcaattcgccattttgcagttgcagaatgaccttgatgttcaaaaacgatgaaattaagcctgaaacacgactaagccggccacctttgaccaaattgtctaaattcgttacgccaaggaccagtgtcgtgttgtcccgcacttgctcaagcttatcaagaattgttttcatatctttgccggcttcggccatttcagcagcgactaagacctgaaaagccatcgctcggtccgtgaactgcgtgtcaatcaccgtcactttgcctttcgcaatttgagccgcttgccgcgaagaattcaccgttccgctgatcgtttcagtcatatgaattgccaaaacttcgctgccgtctgctgtcagtttatcgaaaacatcggcaaacgtaccgacagctggttgcgaggttttgggcaggttttgcgccgcagccatttcatccataaaatcatcccgtgtgatggtttcgccatcaatgtaaacggtattatcaatcataatggtcagcggtacaaccgtaatgttatgttggctgatctcttctggagtcagttgaacggaagaatccgtgacgatcttgatatttgccatgtctgagccacgctttctgttaggttcgtttatcgaactcattatagcaaagtccagaaatattgtcagtacatattatctagttatcataactagattaagttgtattgtgaaacgtaccatgctaaaatcgtaagtgaatcgaagcgtgcccggcaattctcgtaaagaaatctgtaccggttgcaccaaggaggtagaagatgcgcgtggcaaaatcaaagcattatgaatttaataatgaaatgtttagtgcgataacccatgcatttgccttagggctggcagtggttggcacgattgcgttgggtattaagggcgccaatagtggcagtcagcttgagttaatcagttacttaggatttgggatctccctcatcatcttatatacggcttcaacggcgttccacggtttctattttagcaaggcgcgccatgtcctacaggtcctagatcactctggcgttttcatattaatcgctggctcctacctgccttactgtttggtcgcgattggcggaccattagggatcggcttgctaattgccatctgggcgctttgctttggcggcatcctctacaagctgttcttcttgaatcgcttcaagcatctggaaaccatgatttacgtcattctcggctggctttgcttaatcggcatggtgccactgtggcatcacttaggaccgattggcttctggttactggttgctggcgggttagcatacacaggtggcgctatgctgtacctgcaaaaaggcatcccatacatccatgtcatctggcatctgtttgtcattctcggcagcctgtgcatgtacatttcaatttaccttttcgtttaaatgctaactataacaaaaaagatcggctcgctccgtcagacggagaagccgatctttttttgcacatgagtcaattttagttaaaaaatcgaactacaaatgcgcataactatttaagttccttaaaaaatttctttagctgctaaacgcgtcagatcatttttgcttttgccaaacttcataagtatgcgtcaaagcggggttttgatcttcgacagttcggctggaggttttagtaaacgcatcccaatctagtggaatcattttagtgtcacctgcaaaactgccagctagacgggtcacgagcaaggtatcaaccatgtctttaaaggcgctaaagatttgagcaccaccggcgatgactaatgcctgatctgcatgttccttcgcataatcaagcacttcagcaacctgatgcaagacaatcgcgcctggtgcctggtaatcagcctggtgcgtcaaaaccacgttcgtacgatctggtaatggccgttttggaaaactttcgtacgtgcgacgcccaaccaccatcattttcccttcagtctgagtccggaaataatgcaaatcatctggcaaatgccatggcaaatggccgtctttaccgattacaccatcccgatcctgcgcccacaaaaatgctaccatttaaaatccccctcgtttttgatacgtctgatggtactgcaatcagtcagaaccgtcacttaaacagcttcgatatcgccaataataagctttctcgccgacaaggcagcccaagcacgtgcttcgcttaaacggcaactggtgctttaatggccggataaggatcataattcaacaatttaatatcttgcatatcaaaatcaaaaatatcgtgtttatccggattcaagaccaaggttggcgcctgccgtggcgtccgcgttaattgttctttgatttggtccaaatgattgacatacaaatgagcatcgccaaatgtatgaatgaagtccccaacttgcaacccgcattcatgggcaacaagatgggtcagcaaggcatatgaggcaatattaaacggcacgccaaggaaaatgtccgcagagcgctgatacagctgcaaggaaagtttgccatcattgacataaaactggaagagggtgtgacaaggcggtaacgccatggttggcacatcttctggattccaagcggatacgatcaagcgtcgcgagtatgggtgcgtcttaatctgctcaatcacatcccccagctggtcgatggtgtcaccacgactggtatgccacgcccgccattgcgagccataaaccaatcctaaatcaccgtatttagctgcaaatgactcgtcagtgagaatacgttcgtcaaacttggccatctgttcacgataactggcggcaaattcaggatctttctggctgcgatgaccaaaatcggtcatgtccggaccatgataatcggggctggtaacccacttctcaaaggcccattcatcccagatgtgatttttatgctgcaataggaaacgaatgttggtgtcgccacgcaagaaccaaagtaactcgcttttaatgagaccaaagggcacctttttggttgttagtaaaggaaaccctttgctaaggtcaaaccgcatttggtgaccaaaaatactgtacgtgcctgtatgcgtgcgatcaggcttgaaatggccttcatctaatactttttgggcaagatcgagatatggctgctctaacattgtcttcttccctccagtgggcgtgtgttcaaacatactgatccagttcggcaaatcggtcgaattttttatcaattgtttggttgatcttgtcaatttgggcttgtaaatcacctagtttgacataatcttcaccgttgacttcggccatagctgccttgactttggcgagtttatcgtccaactcgtcaagctcattttggagtttatcatactctatctgctcagcatatgtcagttttgttttcttctttggcgcggcttttttcggtacagcgtcagcggctgatgtttttggtttggctgccggctgcttggtttgttgctgagccagataatcagagaactcgcctaccgctcggtcaatctgcgcgttgccattgaagatcagcaattgatcagccactttgtccaaaaagtaacggtcatgtgacacagtgatgacggtgcctggaaattgatccagataatcttcgagtacggtcaaggtggcaatatctagatcattggttggctcgtccaaaagcaaaacattaggttgacgcatgagcacctgtaacaaataaagccggcgtttttcgccgcctgacaagcgaccaatcagcgtaccatgcatactgcgcggaaaaagaaattgttccagcatttgggttactgacacgcgttgaccatctgcttgcacgacttcttcgccaacctcctgcaagtaggtgatgatgcgtttgttcggatccaaattggcactcatctgggtgtagtagcccaaatgaacggtctcgcctaattcaatagaaccgctgtccaatttttgtttgccagcaataatattcagcaatgttgacttgccagcgccgtttttgccggtaatcccaatgcgagtgcctggctgaaccagccaattaaagtcttttagaatcggctgatcgtcaaactgcaaactggcatgatgcatttcgatgacttttttgcctaagcgggcgctagcaatctgaatgggatccaactgctggtttgcttccggtgccgcatctttggcagcttgcaaggtctgaaagcggttgatgcgcgcttgttgtttcgttgaacgtgcctgggcaccagcatgcatccaagctagttcctgcttgtaaagctgggcctgcttgtgattagccgacttttcggcctccaattgctcagcctttttggcgacataagcctgatagttgccttgatactggaataaacggccgcggtccaattcaaaaatccggttcgtcacgcgatcaagaaaataacgatcatgcgttaccacgaccaaagcgccgcgataattgctgagatacttctcaagccacgcgattgaatcaaaatccaagtggttcgtcggctcgtccaacagcaataagtccggcgattcgatcagcacttgggccagaccgacacgcttttgctgaccaccggaaagatcgccaacacgcatgctcaaatcatcaatgtgcagctgcgtcaaaattgttttgatatcggtttctgcagaccaggcatcttcttgcgtcatgcgggcatctgcttttgtataagcggcagttttttccggattcataggatccttggtatattcggctagtgcttgttcatattggcgaatcgcttgaaaaaccggtgagtcaccatgataaatggcatccataatcgccaagtcaggatcaagatcgggaatctgagccagatagctgatgcgatattgcttgggtgttttaatttcaccagcatcaactgaatcaagtccggctaatgcgcgaataagcgtggttttcccagcgccattcaccccaattaagccaactcgctcgccttcgttaattaaaaaatcaatctgattgaataattgtttgtcaccatatgccttactcaggccttgcgctgttagcgtctgcatgttgtccctcatttcactcgtatcgttgtccatcttagcaagaagcagcgcacaagaaaaggccgacatcaatgccgacccgtacgtgatcacgattagatccgcggatattcatcatccacggtatgtttttcatcgatcacaatataaagatgaccgtttgctgcaagcttgctactctggtactcgttatcaagcccgcttggatccttttgcttgaatgggaagtagatttgaacgcgctttttgtcttccgcgttaaagaccaagtccatcttttcaatatcttgatacttagtggcgcgaccaaacatccccatctccagcgaaccggtgttgatatcgcttgacttgacgtggtcagcttcaggcaaaatctcaaccttaaagctcttgcaaggatgaatctcttgaatctgaccgccgtgaatgcgtccgtaactcgtggttactcgactgatccagacgtccgccagttcatcatgctcaacagtccattcgtcaccgttacgaaaatgaaaaatcaattgctcaaaaacatgttctgccattggaaatcccccttcactgtcatgcagaacgggttagaaacgcactggtggccaactatgctattttaaagccgcccagctgatcaatcgtcctgtttgacgttgttgaatgtgcttacatgctcatcataacacactcacaaacgatcttgagacatttcagttgcgatcggcaacaacttttttagttcattgggcaaagctccagcgacgacacgctgctcgatttgattgagtgctttgcccatcgctggcccgggacggacccccgctttgatcagatctgcaccggtcagcgctaattcttttttactatgaatcggtaaggccgcgtaagcctcagctagctgctgctgatcaaagtcaggcgtaagcagtttttgaacctcgctagccgttgtcacggccgcttcaccagcttggtaaagatcccaagcagtcggattcggcatcacctgcagtagcttgacagtttgcgtgaccaaggtgatcagctcattggattgcttccaggcctttagcatcaccagcggctgtgttcttaaaaggaaaatcaatgccgcccagccgcttgccaaactggtcagctgcgtatcaggcaactgagaaaattgcgttaaggctgtttcatgagccgccattttcggggcgtaggcaaacaagcgagtctcaataaaatcttgcaagccagcacgtcgatcaatcccagtcagcaaccgattaaattctgcggcgactcgttctacagaaatgtgcactaacagtttggcattgtcggcgattgccgttttggtggctggctcaatgccgaaccccaattggctctcgaatcgaactgcccgcatcatccgcaaagcatcctcatgaaaccgttcatgaggattacccactgcccgcagctggtggtgctgcaaatcttttaggccgtcaaacaaatcaatgatcgtgccatcatgccgaacagctaaagcgttgatagtgaaatcccgacgctttaaatcttctgctaaggagcgcacaaaagtcacatgatcaggccggcgaaaatcctgatagcgcgattcggttcggaaagttgtcacttcatagccagtcccgtgatcaagcaccatcactgtgccatgctcgatgccggtatcggctgtccgcttgaaaattcgcttaatttctgccggatacgccgaactggcaatatccacatcgtgaatcggcagccccagtatcgcatcacgaacactgccgccaacaaaataagcttcataaccagcagcttcgattttttttaaaatcggaatcgctgccttaaaatctggctgggtcaaatctagtcgcatttcaaactcctttttccaaaccggcaaccaccattaccacaattaagccgaaatatgacatttctgttagaataagcttaaattcttttttgggaggcggcctatgtcacgcaccacgcgtacttgttgggatcttttaatgattgttcttggttgtgctttatatgggttcgggcttgtttatattaatattgcgaatcacttggctgaaggcggcgtcaccgggattaccctgctaatccgctattggtggcatctcgatccggcatacagcacaattctgctgaatattccgttgctcatcgttggttacaaatttttaggcaaacgcgccctagcttacactgtttttggcaccttgatgctttctgcttggctgtggatctggcaacgggtacctttaaccatcaacctcgatcatgatctttttatctccggggttttagctggactgtttggcggttttggcagcggcttgatttaccgccatggcgggaccaccggcggcacggatgttgttgcccggatagttgaacaacagaccggcgtgccaatgggacgaaccctgttggttttcgatgccgctgtgctaacgatctcgttgacgtatctgaacatcgaactcatgatgtacactctgcttggtgcctacgtgttctcacaaattgttaactttacgctggatggtgcttacgcggcaaagggccttttaatcgtctctgacaaaagccaagaaatcgccactgccattatgaacgaattggaacgtgggacaactttcttacatgctgaaggcgggttcgcccacgatcgcaagcaggtcgtttatgctgtcgtttcgtcaactgaaatcgcccaaacaaaacggctgattgaggccattgatccgcacgccttcatcagcatccttgatgtccatgaggccttgggcgaaggcttcacctaccagaaaaaacgccgccgactactatttggtcattgattcgcaacgattaatccgtctcggcgttgagttcatccaaacgggcctgcatctcgtcgtcagtaggtaccagtttcaaatatcgcactaaagcggctttcaattcggcgcgagcaccagtcgactggaagaaatcaatgatatcgtggagaaagtccggggaatcctgaaagcgattgaacgctaaaaggtaattctcacgggcttttttaatattctccaaccgatcgtagcttttagccatattccaataaatttgtgggtcaacatcaccactacgatcgatttggtcaagaaagtcaacattttcttgatcacgctcttcctgcaccaaaaagttgctccaagcgagcatattaccttgatcttccggatcaatcgccaaagccttttgtaaatacgtctcggctaatttgacattgtcttcactaagcgctaatttgccgcctaaggcatatagcgttgggttcgtatcatcgaccatgacgccggcctgaaccgtgtctaaggccttgtcaggctgattctgggcctcataagcacgagcaagtggcaaatacgcattggcgtaacttggatcactgtcaatcacggcttgaagattggtgatcgctttagctggatcatcaagttgtaaatacaagccgcctaattcgaaccggccattgagatccagtgcatcaacaccgacatcttcataagcagccactgcgtcttcatactgccctgtttgcgctaaactggccgccaaccgtgcttcgatgttaaccccagcaagttcagttgtaccggccgctagcagctcgttataagcactaatggcctcggcaaaatgaccccagtcaaaatagaattcgcctaaagcgaaggtcaccaccggctcgtctggcgccaatcgcttcgcctcaagcagtttttgctcactgacctcatataaaccaagtgtttgataaacatcggcagcgctcaccagactttgaacataggcaggatcacctggctgaatgcgactaagataattcaaggcggcgtctgtatctccgtcagaaactgcaatatcagctaaagccgtcgccagatcgccttggtcagggtatcgccctaggagcccctgataaagccgcttagcctgaccgttaaacccaagcgcatacagttcttcggcaaggttgtattgggtttcgtcgtcatcgtgggccaatacttgggtgaatagctgcttcgccgtttccatctggccagcttcaatggcatcaagcatttcttttgcgtaactcatggctgcctccgttgatttcattttataaaaagcctaaagattgtcgttactgctagtttaacattgcgttttgctgattccgaactgatgagcatcaaaagctctccagcaacacttgactgcgcataccgctattgtcgctcgtcccgcccctgatcgctggcgaatgacgccaaaacgcgcaaaaaccgagtccagatagactcggtttttggttgtttcatcattgcctcaggtgaaccgcttatttaacggcgtccttgagtgctttaccaggcttgaatgctggtaccttggatgctgggatcttgatctcggcaccggtttgtgggttgcggcccttacgagcggcacgctcacgcacttcgaagttaccaaagccgatcaactgaaccttgtcaccctttgaaagagagtcttggatagaaccgaatactgcatcaacagctgcggttgcatccttcttggtcaaaccagttgcggttgcaacactttcgatcaattctgctttgtttgccatgaacatttcacctccatattgattagatgcgttaacacctaaacatgcccattcctgacctctcaggaatgaagaaacaatgataatatgtatcaccatttcaggtttaaacatagcatagcaagcccgttgtgacaaggtttttgccaaactttttgctgtctgatcaaggatcggttatcgaaaatcacgatttttgacatatttttttaaatgaaaagacaatattcagccatcgccgaactacttgcgtttacgtgcgatgatgtgaatcggtgtaccggaaaaatcaaaggcctgtcgcaattggttaatcaggaatcgctcgtacgagaagtgcagcaggtcgggatcattaacaaaaaccacgaaagttggcggtttgacagcaacttgcgtcatgtaataaatccgcaagcgttttccgttaactgtcggtgtcggtgtaacagtaatggcatccattaagacatcatttaggacactgctttgaattcgccgagtttgattttctgaaactgccacaatcatggctggcaagctctgtaaacgctgtttcgtcttggcagaaacaaaaataatcggcgcataatccagatattggaattcctgacgaatcaggttttcaaaatccttcatcgtgtgattatctttctcaactgtatcccacttgttgacgacgatgatgatgccacgaccggcctcgtgggcataaccggcgacctttttatcctgttcgcggataccttcttcggcgttgatgacaaacaaaacaacatccgaacgatcaatcgctcgtaatgcacgcatgaccgcgtatttttcggtgttctcgtaaaccttaccacgtttacgaatcccagccgtgtcaatcatcgtgaaggtttcgtcaactgcttcgaacttcgtatcaatcgcatcgcgggtcgtgccttcgattggactcacgatgacccgattttcaccaagaatggcgttaactaaagacgatttgccgacatttggccgaccaatcaggctgaacttaatcgaatcgtcttcaactgacttatcttcggatggaaatgctgctaaaacagcatccaaaacatcaccaaggccaatcccatgggtcccagaaagtggatagggttcgccaaaacctaatgaataaaaatcgtaaatatcttggcgacgttcagggttatcaaccttattgactgccagtacgaccggctttttagcccgataaagaatctgggctacccgttcatctgcatcagttaccccgctttcaatatcagcgagaaaaaggatgacatcggcttcatcgatggcaatttcagcttgatccttaatttgcgccagaaaaggttcatcgcctaagtcgatcccaccggtgtcaatgacagcaaattctttaccaagccattcactcgtgccatagatgcgatcacgcgtgaccccgggcgtatcttccacaatcgaaacccgctcaccgagaatacggttaaaaatggttgacttgcccacattcggacggccaacgattgctaatgttggtaagaccataaaacggcctcctttctgtgacggcgtcatgggatttgtttcccataaaaaaagttgagccaaggctcaactttttaggttcaagatgactacttgttatcatcctgatcatcattgcccttagcagcatctttcaaggcatcgcctaagatgtcgccaagtgagaagcctgaatcatcttgctgatattcagcaggaatcgacgtggattgatgacgatcattgccacgacgaggacgtgaagaacgacgacgatcaccacggtcgctattgtcacgactgctgttgccgccttcatgagattcttcttcagagcctgctggacgttcctgcaaagccttgatggacaaagcaagacgatgtgcatcagggtcaacggaaagaaccttgacctgcacttcttggccttccttaaggacatccgctggggttgctacgtgttcgtgagagatctgggaaatatgaaccaaaccttcaacaccagggaagacttcaacaaaggcaccaaaagtggtcaaacgtttaactgtaccagtcaaaacagagccggccggtgccttttcttcaatgtcgtcccaaggttgtggcaacgttgctttgatggacaaggaaatgcggttgcgatcaggatcaacgttcagaaccttaaccttgatttcttgaccaaccttcagaacatcgcttggcttgtcaacatgatcaaacgaaatctctgaaacgtgaaccaaaccatcaacgccgccaagatcaacaaaggcgccaaagttggtcaaacgagcaactttaccttcaacggtgtcgccaggttgaatcttcgcaaagatttccttacgtgcttcagccttgctggcttcaacaatcgcacgatgtgaaagaatcagacgattttcacttggttcgatttcaatgatcttaaattcaagttccttacccttgtattggctaagatcttcaacaaaatgatcttcaaccatggatgcaggaacgaagccacgaacaccggcattaacaaccaatccgcctttaacgacgctggtaaccggagcggtgatggtttcacctgcttcatacttagcttggatttctttccaaaccttttgcgcttccaaacggcgcttggacagcaggaactgcccattttctttatctttgccaaccgttgaaagcacaactaaatcaagcttgtcgccgacttttgcaacatcgtgaatgtcatcgattggctgagttgataactccttgatcgggaccacgccttcgacgcctgttccttcgatcccaacgatcaattgtttatcttcaacggcaagaacgtctgccttgacggtatcaccaatctttactgtggtgacactcttaagggcgtccgccattgtttcggtgttctcattaacgttattatcactcatgccaaaaaatcctcctatgcagctgtatactggatctattgtacttgaaaacgaaccaaattaccacctattattttaagcccttgactatttcgtctttacttggcctatcagggataaaattcgttccaccacttcatcgatggtcattgatgtcgtatcaattctaatcgcgtcagaagcctgacgtagcggggaaacggcccgatgagagtccttgcgatcgcgttcggcaatctcctgttcgagggtagctagtggtgtctcaatgcctttttgaatattttctttgtagcgtctttttgcccgttcagcaactgatgccaccatataaatcttcacttcggcgttaggtaaaacggtggtgccaatgtcgcgaccatccatgacaatattgctggatgcagcgatatcccgctggcgtttcactagttcagtacgtaccttgggtaacgctgacacttgcgaaacattgttggtcacgtctggttcgcgaatggctaaggtcacatcttcatcattcattaagacgcgctgttcagggtcacccggttcaaaccgaatcgtcatgttggcgagatgctgcatgatagccgcctcatcgccaaagcccagctggtctttgatggccatgtaggtcacggtgcgatacatcgcgccagtatcacaatagataaaccctaactccttggcgactcgtttcgcaatggtacttttcccggcactggccgggccgtcgatcgcaatttgcatactttcctccacaacacacgaccctgctcatgccaatacgcatgcagaacagggtcgtgtcatgattatttcactttcaaaaccgtgcccggtgcaatgctggaacccgcactcataccgttcatctggagcaactcatctaaggtcattccatgattgacagcgattcgataaaggttatcgcctgcttgaacggtatatgaactgccagccgtgctggcacttgcttgctcgctaggctgcgctgatgcactggtctgttcttcttgttgggaagtaacgcttggtgcttgactaggctgagtcgacgctgcctgtgacgaggccactgaagtcttcgaggctttggaagccttcgatgatttctttgattttgaaactttactgctctttttagtactttggatcacaacgcgatcattagaaaggttagcgccattgcggctttgatcaccagaaatcttgacataaataattggtgccaaaaccacaagaattaacaagatcgctaaaatccaggtcaattttgaacttccttgcctttttttcttggtggcaacgcggctcaaattaccttgatcatcacgatcatcgtcaaacagcgtttcccaaggtttacttggatcctcaccattggtgcgcttgtgatcctcattgtcatgttggtgttcatctttttccgccatcacgatccccctcactactgcgcttattgtatcatattgaccagcgtcagggcgtcggttatctaaagatttggtgaaatactgcctgccaagaagctgattttggttgttcttgtggcacttcaggctgtagttggcgcaatatcgtagtggtgatctcgccacagcacaaagccgtatgcggttcaattggcgaatcaaaatgttgcagcagaacagcacgacggcattctgattcattaacaaaagccgccatcgctgcgaaactagcctgtttctcagttagtctgtgctgtaattgctgctgcgtagcctctaccgaaaagccagcgtctacatacgcttcaatcagattgatctgcggatcgtcaaaagtgcgatacgcctcaggatgcgcatagatgagccgaatcaatgccgcatctggcaacatccccgccaaaatagcgccgtgctgaacatcatgatcggtcaccaaaagcgccgctagactctgcttgccatcacggccggctcgtccgattgcctgataataagcttcaagcgattccggcacataggtatgcacgacgaaccgtacatttgccttatcgatccccatgccaaacgcactcgtcgcacagataatctgcaactgatccgattgaaactgtcgctggattagatcgcgttggtgccgatccaacccagcatgataaaaggccgcagcatggccggctttttgcaatcgtatcgctaacgtctcacacgcggctcgggtagcactataaatgatcgttggccccaccacctcgtgcaataactgatccagtcttaaagccttttccttatctgttaagccggtctcaacgccaaggaaaatatttggtcgatcgactgacccagccaaaattgctggcgattgcatgcttagatgttggacaatgtcacggcgaacgggctccggtgcggttgcggttaaggcaagaatcgcatctgcttgcaattgttggcgaacttgtcccagctgcaaataagcaggtcgaaaatctggcccccactgtgagatgcaatgcgcttcatctaccacaaataagcctagggccagtcgtttgagcgccatgagcacatcagcgcgttgtaaaatttctggtgagacaaaaatatagtggtaacttgccaatcgtttgagaatttgggtaaaagcaaccggtggcatttgcgctgacaaggcaatgacccgtttttctccagctgcttgcaaacgaccaacttgatcattcatcaaggcaatgagcggttcaacaattaaacttggcttgttactgatcaaagtcggcaattgataacagagtgatttcccgctgccagtaggtaaaattcccagcgtgtcatgtccatccaacacccattggatcaaagccttttgtccaggtcggaattcttgaaagccaaaatgttgttgaagttgtgcttcaagttgtgacacgcggccacctcccttgaaaacttagaatctggaacaatcgaatctgaaaaaaagtacttccaggaatggctgccaacaatgcctgatgatcgtagatttgcgtcacccgatcaagtgcacggtgaattttaagcggcaccaaatgctcaatcggcaacgtttcacccataattgccgcgagcaacagatgttcattaatcgtgctttgcttacggtggctgcgattagcaattgttggcaacgccatgccagcgcgtgcttgcgccaaggtctgctgcgccggtcgcgaaacgaaatcgcggggtccgccccacaacgccgtccacatactcctagtattagcgagctgctgaaccagtgccgctagcgaatcgagtcgttcaaagtgagcctgcaatgttgctggcatcagttgtccggcgtagtcatggccaatcatgttagccgctagcgtgtcagctaattcagtcggcagtccttgaaaaaggctgcttaatgttgtaacggcagctcgatgatcgacctgctgataccactgcttcacaacttgctgtgtcacccaattaacacttattggttgataagcacggttcgcataactcgcctcagaaagcacttgcacgcctaaaaagaaccgcggtgcgaacaccggtaagttcatccacggttgataatgtgtcggtaacggtaactgggtaactgctgcttgcttgagatgctgccctttttccgttaaaatcaagccggtttcagtttcacgcagcactctttgcactttcaacgtcgtgatggccgctgaaaaagcttcttttgacagacttggataaagatgcaaccattgcagttgttggtgaatcaaggcggcgtaaaggattgaaatggtctgcttaccagttaagagtccaaaaacagcccgctcacgccgcggctgctcactgaaaaattgaatcacaaaatcggtcagcaaagcttgtcacctcatttctcaacattgctgtttaagtgttatgtatcgtataaaggagtttgaatatggctttatatggcagagtagaacgtccagagtgtattgcttgcggcttgtgtcagatgttggcacctgccctttttgattacgatcaagctggcattgcttattataaaccagatcgcaacaccggcactgagcctttaaatgatcaggccacgatcgactttcgattggcctaccaacgctgcccgacccacgctatcaaacgtagcgatcaaccgttcaacgcgcgcccgttttccgagacggggaaagcttaactgctatagtttcagattacgcgaaccaataggaagattgacgtgattcgtcgcaagacaatcgattttacgctaaagaaaaacatccgtcgcttaacaaagctgacggatgttttttagttgattgatcaaatcattaatgactaggttgaatctcacgccgagctaaccacggtgccaaggccttggcgatcgcgaagaatgcaaccgagaccacaattcctttaattaaattgaatggtacaacgccgattaaaacgtaacgcgtcagcgacataccaaggttaaaattgaagaccgccatgtacatcggcgtgatcaccagccaattgagcacactcatgacaactgtcaggcttgcggtacctagtaccagaccttcaatttgccgcaacaagctgtgcttgccacgaatcgtgtaaacaactggaagcaggaacccaacgctcgcaatgaaagctgccagatcaccaattaaattgacgaccccgccgcctgttaaagcaaaatgcacaagactccggataaatgcaacgccgatcccgccagccgggccatataataacccaccaagcaaaacaaccagatctgatagatcaagcttcaggaacgggaaagcaggaatgatcggaaatgaaaacatcatcaaaacatacccgatcgccgctaacaacgcgataccaaccaaacggtgaaccttggaactacttgccataaagcattacctccgtgaggccgtcttccggaacttaaaaagacctattcctccttcagggggaataggtcttgattgaatgtagattcaaaaaagccccatcttcttccatctagactatcactatcggtaccggagtcacaccggttccaccgcataagcgggtcgcggactataccgccggtcgggaattgcaccctgccctgaagacgaaccaagattatttaattaacagctttactttagcaaaggcaccggaaaagttcaagcgtttgcactgaaaacgttaacaatttcaccaactacttattttccgattcacccgctagttttcgcaaggcttgcagttcttgcggcttgattggccgatgttcacctggctgtaaccccaccaaagttaagttgccatacgcttcccgagatagttttagaactgggaagccgactgctttaaacatctttttaacctgatgattcatgccttgatgaatggtcaaagatacgatcgccgtttttttagccttatcagtcgagataatgtctactttagcaggcgcagtcatcttgccatcaacctcgacacctgttttgagcggagccaaggcaggtcgattcggtacaccttgaaccttggctacatattttttctcaagcgcgtaacgtggatgcatcaaatggttggctaaatcgccatcgtttgtcatcacaagtaagccgcttgtatcgtaatctaatcggccaactggataaagacgctcagtaatatccttaaagtaatcggtgacgacatcacgtcccttattatcttgaacagcactaatcacgccgcgcggtttataaaagagaaagtagcgcttagcctctttgccaatcggcacgccatccacttcgacttcatcatgcggaccaatcttgatgcccatttcagtttcaatttggccattaactttgacatggccagttgcaatcaacgtttccgcatgtcgacgcgaagcaataccggcatttgcgataattttttgaagccgttcagttttggttgtcatgttgttgattttgctccattttcttttcgtctatagtagcttcctcttgatcatcatcgtgccgaaatgccgtaaacaaatcaacctcacctgtatcggcaggcgcatcagctagcggtggtaaatcagcaaggcggttcaacccaaaatagtcaaggaaaaactgagttgtcgcatataaaattggtcgaccaggggcttcttttcggcctgcctctttgatgagttgtcgcgcagccaaggtagttaatgcgcctgagctttgaacaccgcgaatttcgtcaatttcaatccgggtaatcggttgctggtacgcgataatcgcgagcacttctaacgcagcctgcgataatcccgcagctggcggcccggcaaaatatttcttgattgcaggtgcgtacgctggtttggtcagtaaataataccggtccgcaaactgctgcaattgcaggccacgctgatcatcagcagccagccgttgtcgatacgcgtctaattgctgtcgcatcgcgctttcgctgatttctaaaatgccggccagctcacccagcgtcacgccgctttcgccagctgtgtaaaggattgcttctagtgctggctccattaagcagcctccttcaaggtcactgtgattggatcaaatggcgcctcttgttcacaaataacctgatcatttttcatcaattcaagcaaagccagaaaagtcgtcacgacttgctcaaccgactgaaccgacagtaaatcagcaaagagacattgcccgcctttttgcaatgtctgtagcacttcgccgattcgtttttcaacggatacaggttcggtttcaatgtgggcaatggtttggcgagtggcttgttgtgccttcatcacacgcgccatggccgcttgtaaatcaactaatttcaccgaacctggcgcaagtggcacagccattttggcgtctggcaatgtggttggcttggcataggcttgtgcgcgtttagcttcgcgtgctttcaaatcctttgccgcttcttggtagacttgataggttaataattgtgccactaaatctgctcgtggatctggcgcatcatcaggagccatcgtttcgggttcaggttgcggcaacaaaaggcgacttttcaagaccatcaaattagcggccatgacaaaataatcgccggccacgtccagcgccagatcctgcatttgatgcaggtaatctaggtattgagcggtgatctcagcgatcggaatgtcgtaaatgtcaacttcattcgtccgaatcaagtgccaaagcaagtctaacggtccggagaagtcattcagcacgagtgtcagtgccatggtcatcctcttttcgaaacttgttaaaggcggcgattagtggtgcatgttcaagggcacccatcaatttcttgtttgggaaaagttcagtcagttcagtcaacgcggcaaatgccgttgcttggtcacgaaaattaggtgaaaagcttaaatgccgcaccaaaacaaagtcagcacttagttcaatgccaacgacaccaacaaaatcattcttatgtttgtatagatacaacgcatgggaatcatcttcggtgtacatcttgagttctgtctttaaatgcccaacatctttcagatccggaataaaagacaacaatcccatcgcgatcttctcatagtcgtttttgtatttaaccagcatgtttgcctccaagagatactctcgtaacactctatcatagaaacgcggcagtagcaaagggcagagcgtgaacgtatgtgtcaagtttttctcggttctacgctaatcaagtttaatcctattgtccgatttggctccgcggcgattcggggtggcgaccgcgcagctagagtggtgggcaccactgagcccatcgccgctccgccaacgctctgctttctatcttagtattcgagctagactgcccatggcaatgctgatggccacaatctcttagtcatcaaacatattcttagaaaggaacaccctgtcaaaatagctacccgcgcggatgcgttttatgatagaccgcaaccagatgttgattgcttaaatgggtgtaaatctgggtcgtgctgatgtcgctgtggccgagtagttcttgaaccacgcgcaggtcagcaccgttttcgagcaaccttgtcgcaaagctgtgacgaagagtatgcggtgtgacatctttttcaatgccgatacttgcaatatatgctttgaggttcttccagatcccttggcgagtcattggcccaccgtgaaaattgacaaaaacgtttttaggttgtactcgtttgagtaatttgggtctggcctcttgcagatagcgatccacccattgtgtggcttgcggactaatgggaaccagtcgttctttgtcccctttaccagtcacttgaagtagattcattgccaaatgcaattgatcaagacgtaaatcaacaacttctgaaacccgtaacccagtggcatacatcaactcaaaaatagcgcgatcacgtaatcccaatggcttgtcggtatctggtttggccatcaaagcatcgacttcttgactcgacaacgttgctggtaaatgttgggcacgttttggggtgtcaatcttggtcattggatcagctgaaattgccccttcacgcagtaaaaaccgataaaacttgcgtaaagcagaaatcatgcggctaactgaagcaggtgccttggtggcattctgctcctttaaaaaggactggatggtaccgaactcctcgggaaatgtccttctttttcgggccgctagccaagccgaaaaagtgatcaaatcctgctgatagctagtttgggtggcttttgccaatccgcgttcaacatttagataatgaataaaatccgcgatcaacccatgcatgatgttactcccgagacgccttggctgcggccgtcaaaatcgtatacccagcttcctctttcactaagccagccttcaacaaatggcccagtgcgcgcttaaaggcgcctttactgatgccaaaggtttgcttaattgcttcaggatcactcttatccgtataagcaatttttcctgaaggatcatgctgcaaaactgccaaaatcatgccagcatcatcaccgatggcctgataggcacgtggttttagcgacaaattcagctcgccattggcactaaccccgatcacgcgagcatgcaaaatttgcccaagtcgcggttcagcatcgcgctcacttggatggataaaacccaaataaaaatcatcggtcaagacacgcgttccagccatcttcaaccgataagccgtggcagtaacatcagcattcatctgctcaggcttcgcgcgatttgcaaccgcgtggatgatactttcatcagccagattgccccacatccggtcttttttgtcgactgttaaggcaaccattaattgatcgcctttttgcggccataaacggctgatttcaggtaactggtcttcactaaccacaatatctttgtctggtaagccgatgttcacaaataccccaagatccttacgcacttcgactactttcgcaaaagcgtaatggtcgcggccaactgtcggaacttttgtggttaaccgagcctgcccttgcttattttcataggcaaaaccctcaacatcactgccaacttctggaagttcagccaactcactgcgatcaatggccaaagtgacgccatcatgctgagcaaagacttccgtgtcattgtgatccgtcacttgtgcggtgacaatactgccattaaaattcatttatttttctccttaaaccagcgccatagttgccggtcattaatgtccaggaacaagattaaaaacggtcaagataacataggtgaggccactggcgatcaccggtccagccgcaatgccctttaagaacacgacgccaataattgtgccaaaaaccaatgccacagtcatttccgggctcattgccagcagaccgacaccctttgccgacaaaacagcgactaaaacgccgcacccgatcgcaatccagccagccggacttttaatgacattaagaagctctttaaagccgatctcacccgttgcaattggcaccatgatagcggctgaaatcacagtcacgccccaattgatcccttgcgtctgaagcaatttcaaaaagttttgagtttgcgggatcagcttgagaaccatcacagcactgaccccaattatcaggcttttatttttgccgacaattgcaattgctaaaatacctagtaaaaaaagccaactctccacaagtgttccctccatcatgatgctgaccaaactgccagcgttatcgcttacgagattgcatactgtttcttattataagccactcgcacgcacctgacgacctctgctcatacatttatcagtaagttgctcaaaacaggcaacgctactgtttttttggaagaaaaaaaactcccaagtttccttgagagcttttcctaacctttaacaggtcattttgaagattaaagggcgttggtagcacctttgtagatgatcccacgacgggagtcaacagtaatgatctggccatcggagatgacgctggtagcattttcagcaccaacaacaactgggatacccatagcaataccaacaacagctgcgtgactggtcaagccaccggtttcaacaaccaaggcagctgctttttcgattgctggcaaataatctttgtcagtcgtcttaacaaccagaatgtcacccttttgcatcttagcaacagcttcttgagcgttgcttgcgatgactgccttaccaatcgtggattcgtcgccgacacctgagccttgaaccagcttggagccaatgagttgaaccttcatcacgttggttgtgccagattcaccaacaggaacaccggcagtgatcaagatcagatcgccttccttagcaaagccaaggtcttgggccttctttgttgccaagtcgaacatagcatcggtgttagcaggcttttcagcaatgattgggtaaacgccccagttgaccatcaggccgcgttgggtcttttcgctgaaggtaatggcaagaatgtcagccttcggacgatacttggaaatcatgcgggcagtgtagccggattcggtcgcagcaacaatggtcttaacccctaagttgcgagccgtgtgtgcaacactttggccaacagcttcggtgacgttcttgttactgtattccttcaatgcgaaggcatcctgatccatcatcgctgcttcggtgtattcgtcaatccgagccattgcagcaacggattcaaccggatagtcaccattagcagattcgccagaaagcatcgttgcatcggtgccatcaaacacggcattggcaacgtcgtttacttcggcacgggtaggacgtgggttttcttgcatggaatccaacatttgtgtagccgtgataaccggcttacccaaagagttgcacttcttgatcaagcgcttctgaacgatcggaacatgttcaaatggaatttcaacacccatgtcgccacgagcaaccattaagccatcggaaaccttcaagatgtcatcaatgttgtcgatgccttcttgtgattcgatcttagggaagatctgaacattaagtgcgttcttttcttcaaggagttcacgaatgtctaaaacgtcttgaggcttacgaacaaaggaagcagcaatgaagttgatcccgttgtccaagccgaaacgaatgtcatcggagtctttttccgtaatcccaggcaagttgatggcaacaccaggagcgttgacacccttcttaccaccaaggacaccgtcgttttgaacaacggtaacgagttcacggttcttttcgtccttttcggtgatcttcatgtcaatcaagccatcatcaaacaaaacatggccgccaacgtgagtgtcatcataaaggccaggataggtaacagcaactttttccttggtgcctttcagacttgcatccatggagatgcgaactttgtcaccggtgtgaaagtcgatcttaccattcggggtatcttcaagagttgtccgaatttcggcacccttcgtatccagcatgataccaacggtcttacccgtgatcttttcagcttcgtgaaccatgttcatccgtgccaaatgctcttcatgatcaccatgtgagaaattgaaacggaaaacgttggcacccgcttcaatcaacttaacgatgatatcagtggtgttacttgcaggtccaagcgtgctgacgatcttggtttttttcataagtgaaatcgctccttgaaattatttaaacagacgttaatgtcgtttgtttacgagattaaaatgttaactcttccgctaaggtgtagagcgaaagttctgcgtgatgcttggcatcaaacaaggtccgaacatcatgtgccgtgatcttgttgttttcaatgccgacagccaaagcgcctttgccttgcaacaaaagttcaaccgcgtatgaacccatttgtgaagccaaaacgcgatcacgtgcggacggtgcaccgccacgaacaatgtgtcccagaactgtcgaacgtaattggaaatcgccatatgcggctaattccttggcaaattgatcagcgtgcatcacgccttctgccaaaagaatgaccgcatgcttttgaccacgttcacgagaactttgcaacttcgaagcaattttcttaacgtcaaagtcgtgttctggaatgatgacatcctcggcaccaccggcgacgcccgaccaaagggcaatgtccccagcttcacgacccatgacttcaatgacaaaggttcgttcatgtgaagccgcggtatcgcgaagacggtcaacagcttccacaactgtattaacggcagtgtcaaagccaatcgtgaagtccgtgtaaggaatatcgttgtcgatcgttcctggcaggccaatggtgttgaaaccgtgacgcgtcaaagctagtgcaccgtgataagagccgtctccgccgatgacgaccaacgcctcgatgccaaacttgtttaattgttcgaccccgcgcaactggccttcttcttgcgcaaattgtggataacgtgcggaatataacatggtcccgccgcgttgaatcttatcaccgacagttgattcattcattttgaaaatgtcgccggcaactaacccagcaaatccataattgatgccatatacttcaaggccttcgtgcatcgccttgcgagcaacagcgcggaccgcggcgttcatgccaggcgcatccccgccactggtcaaaataccaatgcgtttcattatttcacctcatgcatattcttttgcgatttgtcccatcacaaatactcattgagtttaccacttttcagaaacaaagtccctgaaaatgagaacattttacaattttctctattcttcttgtcgttttcgcaacaccacattagccgcaccaaaccgcgattcaagatcagccatcaagctggtgtcagcagtgacccagtatcgcttatctaacaaaacactctccttgctggtcgtgtcgacagtgataaccggaattggtccatgggcagtttgcaattttttcagtaaatcggtccgggcgtcaacattatccgcatccaagcgaataaataactgtgcttttggtaaggcctcaagtaacggtgcggcatcttgaatccggttcacaatgagttgcaagtcgtcattgcgtttttcaactcgcccgttcactagtaccaccatgtcggtctcaattttttctaatgttggatatagattgggaaaaaccgtcagcgaaacggcgccagtcgcatcctgtccatccacaaacgccataggcttcccagttttggtccggatccgcttaatgtgtcgaaccagaagcaaaatatcaaccgtgcgaccttctgctaaatccaccacattgactaatgtgtattgcgttttcaaaggggcatatttgtcaaccggatgaccagaaaggtaaacgcctaaaacattagcctcttcttcaagccgttcgcctgccggcatttccggcaccacaatcggtttaggcgctagcactgaaaatagcccaacatcattgccagcaagtttaaccgagttgattaattcatctaagttcgcaattgtctgtgcccggttatcatcaaagctatcaaaggcaccggcaagaatcaatggtttgaaattatctgcctttaaccacttcggctcgaggcgctgtagtaaatcgcgaaaatctttaaacgggccatttttacgagcggtaaaaatggcttcggaaaagtcgcggcgcatccctttgacagacaaaagtccaaagcgaatcttcccgtcgctcaacttaaagcctccattgctggtgttgatgtcaggacctaataaagctacctgacgcgctttggcttcttgtacgtaagtccggagcttcggcaaattattcatactagcattcatcaatgccgcaaaaaaggcggctggatcatgcacttttaaatacgctaaccaaaatgcgaccatactataagcaactgcgtgagaacgattgaagccgtaattcgcaaatcgatcaatataagcataaaccgttttggcagtcgcctcagggaatccttgcttgaccgcaccttcaatgaatttatcctgttcggctgccagcactgatgatttcttcttactcatggcccgccgcaacaaatccgcctcgccaagactgaacccgcccatgacactggccacctgcatgacctgctcctgataaaccaagacaccataagtcggtttcaaaatcttctccaaggcgggatcaggataagcaatcggttcttgcccatttttgcgggcaatgaacgtgtcgatgttttccattggacctggacgatacaaggcgttgacagccacaacatcttcaaaatcagttggccgcagtttgcgcaaaacatttttgataccagcagactcgaattgaaaaacgccgttagtatcaccgcgggcaaacaaagcgagtgtcggttgatcattcagcggaatctgttttggatcaaacgtccggccagtatcacgggtgacaaaatgactggcggcggctaaaatattgaggtttttcaaacccagaaaatccattttaagaagcccaagtgcttcaacatcatctttgggtacctgcgtctgttcaagaccatcgccactgggttgcaaggcaacggtgtcagttagtggttcttcagaaagcactatcccggctgcatgcgtggaataatgtcgcggcaacccctctaatgctaaagcggtttgaaacagcatgcgattttttggtgaatcggccaccaaatttttcaacggctgactctgatcgtatgctgtttttaaatccatgtgcaacaagtttggaattgctctgctccaagtattactttcaaactgactcatgccgaaaacgcgtgccacatctctgatcgcctgtttcgcgccgaacgtcccaaaagtaataatctgagccatgtgatttcggccatatttgtcatggacatattgaatcagctcgccacggcggttatcaggaatgtccaaatcaatatcaggcatttgcgctcgagcaggattcagaaaccgttcaaacagcagatcataagcaatcggatcgacttctgtaatagccagcgcgtaactgaccaaggagcccgcagctgatcctcgcccagccccagtcataatattgaccttgtgagcgtaattcatcacatcccaaaccaccagaaagtaatcagcaaatcccattttgataatgacatccagctcatattgcaaacgctgctgataggttgtcggaatcggctgatcgtgaaaacggttagcgaggccttcttgagccagtttggtcaggtaatctttagacgcaagctgatctggcgtttgataatgaggtagctgcggctgcttaaacgtaatcgtcacatccgtttgatccgctatctgagccgcgttgtcaactgccgcctgtagtccagtagcaacaaaaggtgcacttgcatctgctggcggttttaaccaccatggcccagcatcggttaaaactgggtcacgaaagttcaactgactaccatcaccaatcgctgccatcactttttgcgtaaaagcatcagtcggatcacgatacagtacgttacctaacgccattaggttaagttgctgactagtcgcaaatgccggcaatggcgtatctaaatgagcctcatccagaccaacatacaccgcttccggctgtttattatccagctcctgtaaaaaagcgacagctctgtcgtgatcgttagcagcaactgccgccgaaaatggtgaatccggtaaggtgatggcgactaagcctgtcaaaggcaataagtccgcaaaagccaccggcgaagttgctagcattatctgcgtggagatcttaagtaactgatggtagccctgattatttttggcaatcactaaaagtttggcatcatcaatcgcgatctgcatgcctaataacggcttcaagccagccgctttcgcctgtcgataaaactcgactaaaccataaacaacattagtgtctgttaaggcaatggccgaataaccgcgtgattttgctgcgctgataagatccgacagtgccaacgggctgtgtaataaggtataattgctatgaacctgtaattgggtaaacgtcatcttgccacctcgcttctattataccggaaatactcacaatttcagttgaattcgcttgtggtcgtggtaagatgacgacagaaaagagggattccatgcgttatctacctactattatctggggcgtgatcctcggccaagttgtcggcttcctgatcagcgccttgagcggcggcagctacgacccgaagacaagcgcgattatcagtgtgatcttcgttgtcattttattcttcttcccgccaatcatgcagcattttgcaaaacctgcggaaaaaccagaacattaattaaatcgtcaatgacgtcaaagtgcccgattattgctagactggcatgtctaacaataaccgggcactttgcatgtgctgacgtttttggaatgagtgacgcaagcttattttgtcacatacaggtaaagtgctgtggtggaataaccaacatcaattttgacgccgtgactcttgattgtgctaatggtcgtcgcattatttttagacttagcatccttcgtcaatttcttaaattgcgagaaaactgacttggcatcagcaccgaccgaagttgtgagtaacccgaagtcagtggcaaacgtctgcatcttcttgctgtttttcaaaactgataatggtaccacaacggcaaaccccattgccttgccatcaacaatacttgcgcgataatcgccgcttgctgattttaagattgaatgaatgcccgtcttcgccgttgccggcagttgggatgctttggtattggcattggcctgagccatcagtgtcttcaattgctgtgcttgctgagccattgccattttctcagttggactcatggtcgcagcgttcttttgagcattggcacttgcagcctgtgcctgttttagcttggcttgatccgctttaggtagactggataccgccagcatttgattaaactttgccgcaatcgtgctataagttccgagcgattgaccagctttcaccgtgacgttagtttgcatgctaccggcttttaggttcaccttttgagccacatcgctaacgggcacattgaccacaaacgtgcctgaattgactggcacactgccttttccggcatcacttgtataactgacgcgatccacaccgcgggccgtccctttaacaatggcgaccagtccgtcacgcccatatgaggttttggtagtgcttaattgttggccgcaacctgctagcacgaatgccaataagccgaccatggtatatttccaaattttcattaaaccgaacaatcctttcgctatgcacaattcaataacgaccaacagcataagcgttccttggctgcttgacaagcgaaatatgactcactgtcacattgacggtaaaacattaaagttttgatcagcagttgccttgattaatgggtgttcctgcaaataatcggcaatcaattcggtcatatctttttgattttctcggatgactttatcaggaccaaacattttaaaattaccgccaccagccgcacggtattgattaaccgccacatcataagtctgagtgggctgtactggcgcaccgtgataaagcagccgagatactcgactgcccacgggctgatgaatatccaaagtataatcaatgccctgatacatgtcataattgtaatgctgaggttttggccgctcaaatcggggcgtcaccgtcaacttgccatcagcatctagcgaaaaatattcggcgcactgttccagagctgcttttaaatcagcgccggttaaccgcaacacagctagcgtgttgggataaatgtaattcgtgacgacatcccgcatgtcgatggtttcaccaaaccctcgcccttcattgttaaacaaagctgtgcccgaaatgtcagtatcggtgctggccatttgtactttttgaataaactcaatgtacggcacctcatgaacccgcgcagcaaatggatcctgaatgcgcatatccccttcaacatgagctaatggctggtctaaccaagtttcaacagtttgattcagatcagccgctgactgcaaaatggttgggctcgcaattgatccgcctgttttgactaacacggctttgctagcagtaacttggtaaccgctcgctgtctgatttaagtcaagtgtgatcttaccgatcgcttccccgcggtaacctggctgggtgatcggcacaccgttaactaatccggccaattgtcgatgttgatgacccgtgactaaagcatcaatccccggtacttgggtcagcgcatatccgacattttcgccagttaatggctcagtcggctgaccggtctgcaagttacgctcaaaaccgccatgataagcaacaatcacaacgtcagcttgttgacgcaacaatgggacatagtgcttggcagtcgctaccacatcttgaaaagccaagccggcaatatgggccggtgcttcccaatgtgggatatagtccgttgtcaaacccagaatggcaattttgacccctgagcgctcaatcaattgataaggcgccccaaatgctggttggccattttcggtgatattagcgttgatggttggataggtcaatgttttcaacgcttgccgcaaatagtcgctgccgtaattaaactcatgattgccgataatgccggcatcatacccaacctcgttatacagtcgcgtcaactgatctggctgcttgctgatcttcgcaacgtaataggccagtggtgatccttgaagccaatcgccattttcaatcgtcacaactggtccttcagctgctgccttctgagcatcaagcaccgttttggccttggctaatgaaaaaggcaaatcctgatcccgtttcacataattagttggcaagacaaaaccatgcgtgtcacttgtcgatagaatggttagtttcattttttccctttcttttccgaatcatcagcagccagatcaatcattttttcaactaacagtttttgtaaaacagcattaatggccattgtcacaatggcatgctgggttgtcgtcatatctggtttattgacgcggctaatggttaaaccatcgctaaaatccgaatttgcctgctcaattgcgctgctaaaagtgagaataaacgcatcgtaagcttgcgcaaccggccgattggcaagtgaaaattgaatacctgccgcaatagcatccaacgcaaaaactggctttagcattgcaatgactaaaatattggctaattgttctggacgatactttttcttaagcggggctttaataaccccctttttaacataattattgaccatcgtggatgtgatctcgccaaaccccagcggtgtgacaatatcattgacatactggatcacttgatccatatacaagtcaaattggggcagatcagtccagcgcggaaactgcgcctcttgaagttgccctagataatcggcaaattgttcgttatcagccatatgctgccacctctttcaagaagagtataccatgtgagctagacttgataaccattcgtggaccgattgatgctaatattttacccaatgatcaaagtacagccttcattggtaaggtcgcttatgttccgacttctagctgctcgtactcacgctcaccataacgcgtgcacctgcccagaaacctactccgttcaccataacgcgctcgccagcccagaaacctgcgtgtaaggaccatgaacgcaatgaccaaaacccggtcatcacgttcaaggccacttacacgccggtttctaaacgggctggcgagcgctcacacacacaaaaagccaacacctaagatgttggcttttgattatgcatttgcgttatcgtcggacttcttaaccacttgtgcacccttgtagtaacccttaggtgaaacgtggtgggaaatgcggtattcgccggtcgctgcgtcgaattgcaagttaggcacattcaacttgatatgaccgcggcgcatacgcttcttggtctttgacgttctgcgtgctggaactgccatgagcggaaaaccccttttttagtaagatttctaaacaactttatacggttgatgatcaaaatgcaagtccaatcatcatcacgcgtggacagaatgctatctgtcacagcaacgataatcatacatgaaaaggcgcgtcaaggcaagggtctttacagaaaaaatcagttgccagccggtttaagctttgactggtactgtttttgccttaaattgcaactgatcgtccgcaaccgtgatgacgacttcttgacccggcatcacagtcccgcgaatcaattctttagccagcggcgtttcaaccgcactcgtaattaaccgctgcagtggacgggcaccaaacgctggctcataccctttatgggccaaccactcctgcgctgccggtgtgatatcaagcgatatctgttgatcggccaaccgcgtgcccaattgcttaagatccttcacagcgatcttttcaacatctgctaatgatagtgggttgaacatgataatatcatcaatccgattcaaaaattcaggcttaaaggctttgccgaccaattgccgcacattatccttggcttgttggctaacggtaccatcttcttgcacaccgtccagcaggtactcggagcctaagttggacgtcatgatgataatcgtatttttgaaatcgacggtacgtccctgaccatctgtcaaacgaccgtcatctaaaacttgtaggaggatattgaaaacgtccgggttagctttttcaatttcgtctaacaaaacaatggtatatgggttgcggcgaactgcttcagtcaactggccgccttgttcgtagccgacataaccaggggccgccccgactaatcgcgacacactggctttttccatgtattcggacatatcaattcgcaccatgtgtttttctgaatcaaataaatcttctgccaatgctttagcaagttctgttttgccgacaccagtgggaccaaggaacaagaagctgccaagtggccgacttggatcttgtaaaccggccctggatcgcaaaacagcgtccgagacagcgctgacggcttcattttggccaatgacacgttggtgcagattatctgccaaatgcaataacttctggcggtcaccttcaaccaacttcgctactggaataccggtttcccgcgaaatcaccgcagcaatttcattggctgtcacgctttcttgaactagccaagattgcggacgatcgctgtgttccatcgtctgcagctctttttccaactgtggaatcgtgccatgttgcaagcgtgcagcagtttcaagatcgtagcgactttgggcatcttccaattcatgcttggctttatcaatcgccgacttcttctcgttaagttgacgaatatctttcttttctgcttcccactgagccttgagcttatttgttttctcttttaagttggccaattcagcgtcagcatctgctaatcgcttcttgctggcaggatcagtttcattcttcagtgcttgctgttcaatttccaactgcatctgtttgcgctctgccacatccagctcagtcgggcgggagttcatttccacgttaattgtggcacaagcctcgtccaccaaatcaatcgccttgtcaggcaaaaaccgatccgtgatataccgattggacaaagtagctgcagcgaccaacgcggtatcatggatccgaactttatgaaaaatttcgaatcgttccttcagaccccgcaaaatactgatcgtatcttcaacactaggttcctgaaccagcacccgttggaaccgacgctcaagggctttatctttctcgatgttttcccggtactcgtccagtgtcgtggcaccgatcagatgcaattcaccacgggccagcatcggcttcagcaagttaccagcatccatggagccttctgccttaccagcaccgacaatattgtgaatttcatcaataaaaagaatgatttggccttcactctttttgacttcttttaagaccgccttcaagcgttcctcgaactcaccgcggtacttcgcgccggcaacaagacttcccatatcaagtgagatgatagttttattcttcagattgtcaggtacatcatttttgacgatccgctgggctaaaccttctacaatggcggttttgccgacccccggttcaccaatcaaaactggattgtttttagttttgcgactcaaaatacgaatgacatcgcgaatttcttcatcacgtccgatgatgggatccatcttgccactgcgcgcttcttttacaagatcggtaccgtacttttccaaactcttataagaggcttcggcatttttgctggttactttttcaccaccgcgcaggttctcaatcacctgtcgtaatcgctttgcatcaaccttggcatcgttcaacaagaattgggtgatcgggttgtagcgttgttgataaagggcgagcaagactgcttctgtagaaatataggtatcgccaaattcatccttcacgctgttggcatctgtcagtagctgcgacaggttttgggacatgctttgtccgtatgcgctagcgccttcaacgacaggctctgcttccagtgccgcatcaatcgcagcattcaagccctgcacattcacaccggcttcacgataaatctgttcagccaattgattaggctgcaccaggcttttcatgacatgtgggatgtcaatttcttgatgacggcgaacttgggcaatttgttgtgccgcgccaagtgcttcggcaacggcttgcgtaaaattatctgggttcatgaatacggatgcctccctgaaaaatatcgtcttacattatagttttcattttcacaatacgacattggtcagttaaggtcaaactattttttaaatttcatgatgatttaaaaaaatcgtaggaagtccgtcgctgtgttgcttgcacaactgagcctcaggtggcctagattgctccgttttggcactacggtctttaaaatcgcattaaataatctatgtgaaggcaaaaaggaacaattttccaatcgtacaatcgaaaaattgttccttttatttgtttatttgtctgactgagaattttgtcacgagctcctctattgacagctaggtacgacagttcaatcctcaaaggtctattttttggtatccgtcgcatccgttgacagttcctcttttggtgcttgaactggcttaggggctggcttgtcagttttattggattttgtcagctccgtgatccgctgttgcaactcacgaatctgttttttagcactcgaaacagcactggttgagatcaaccaggtcacaacggcacctatcaacacggaaaccgcaataatcactatcaacggccactttagctgaataccgaagaaattaaccgaaacgtcttgcccattcaacaaggcaaaaacaattaaaatcaatgccagaactaacccaataataaaacgttgttgacccttcatacgacctacccctttacttcttattaaacataccagcagctaaccaatcgcccaaatgcgggaacaagatataaaaatctgcgccaagattcataaaccacggtgcattgatttcccgaactggtcgaccaaatgtcgctacaattcgccgcgctaatttatctggatccaaaaccagccaagaaacgctagccaaatagtctaacgcattggcttcgctaaagaaattcgtggcaattggtcccggattaaccgtggtcaccttaacaccgaatggcttcagttcaagacgtaagccattactatacccaagcaccgcaaatttggttgctgagtagatagctgacttaggcgtcgccatttttccagccattgaagcaatgttaatgatttgtccttgctgacgcgtgaccatatcgcgacccagcaacttcgtcagatacatcatccccagcacattcacccgaaacatgcgctctactacctgcatatcggtatcgaaggctgtttcaaaatgaccaaacccagcggcattcaccagaatatcaactggcccaaccgtttcgtgaatttgatcaacggtcgcttcaattgcaactgggtcagcaacatcaacagggaaagcataagctggtcggccggaaagcgtgctggcctctgcctgtgcttgacgtaatttctcccgccgccgcgccaaaaagacaacggttgcgccttgctttgctgcctcaagtccaatcgccttgcctaagcctgacgatcctccagaaataaccaccgtcggatgttggttcatcatgatttcctcctctgttttgatattcacttgctaccgctgagctttatgatttaactgtggcagcaggttccgattgttcactccgaaatggaatgttaatttcctcgaagtctttgacaacatgcgtatttggaaaaatctgccgcgccgttttttccaacatcgctaccccgggactcagatatcgtgccgaaatatggttcagcaagagccgcccgacacctgcacgtttagccaacgccgctgcttgtacattggtcgcatgataatactgcttagccaattggctttcatccggtccaaaggtactttcgtgaaccaacacatcagcgcctgctgctaaaggcagcgcgcgattgcacatgcgggtatccccgaaaatggcaaccgttctgccaggttgcgcagggccaatgaaatcgtggccgtcaaaaatccggccatctggcaaggttacagtttcgccggccttcaaagccgcataaaccggtccagaaggaattttagcggcacgtaccttatcaatcaacaactcgccaggatgcggtttttcttcgatccgaaaaccaaagctcgtaattcgatgatccaagcgatcaaaagtgactttgaaagtttgatcttcaaaagccacgcctggatgctgtaataaaacaaattttaacgggtaactgagatgactttgagaaactttcaaactggtttttacaaaatcctcaatgccagaaggcccgtaaatcgtcaacggatctgtgccgccttggttggagcgactggccaaaaaccctggcaagccaaaaatatggtccccatgcaagtgagtaataaatactttggcaatttttcgtggtcgaatagcggtttgtaaaatctgatgttgtgtgccttccccggcatcaaacaaccaaacctcattacgctcatcaagtaattttaaggctaaactgctaacattccgggacttggaaggcgaccctgcgcctgtgcccaaaaattgaatttccataccatacttcctattctgtcgaacttcactttgtagtctaccacaagttactcgccattttcgcggtttcaatgttggtaagccgagatttgcaaggtttaaaaaagacgaaggtggacggctaactgcaaccgctaataaaaaaactgagcgacttgatgccgctcagcctcatgaaatcaaccgacatatttgtctcatcaacgcaatcaatcagctgtcggaagcttaatttttcaccttatccagaatcgttttcgcaactaatgccgcatattgtggattgccattcggattcatatgaaccatgtcgttatagaaccaatcaggatgaccattagacttgtcataccaatcaatcaccgtcagattcttatactgcttctgggctgcggctaatttgctattaacatcattctgccaagcgcgcgttggtacgcgtacattaatccagaagacttgccgatcaggaccgatggcttgcatcatttgcgctagctgatcatctgaaaatgggccgttagttcctaacccaatcagaacgatattgcccagcacaccgcggtcagcgtaactgcggaccaaatcaatactattgatcatttgccgagaaacagcagcgtcaatcacagctttagggaacagctgttgaagcccattttcaccgtcaagcatgacagagtcgccaatagcagtgagtccaatgtcttgtgcctgttgcaattgaatctgggtcaagccgtattgttcatactcacgattgactggatgcgttttagcttgagaagcatacttggcttctagcgccttggaacttgattcttcggccgctttattcttgtcagccttcttttgtgcagcaatactggaacgcattgctgccaaccgcttttctttctctttagcggaaacaccacgcttctttaactgctgtgctaaaggcgagttgtcaccttctgctttaacagaaggcgctttggctaatccaacactaccaatagctaagataatcagcgccacataactaacccagcgcgttttccccatacgaactttaggattagccaagccctttaggaatgcccaagtcttgtgataattaaaatgtgccgccggttgttcaatcaagcggtaagaaagttcggtgataacaacaattagcaccacttcaatcaccggatataatactgggtgatccgcaatgttacgaaaacgattctcccaaaagatcatgacgggaaactgatacaaatacaagccataactacgactgccgatatagctgaacaaaggattacttaacaatctgtcaaaatgagctgccggatgcgctaccactgccaccaaaatcgttgtcacaattgagaacaataccattccgccttcataaagaaagctgctctgggcatcaattgtgaagaccatgactagtaagccgagaaagctggcagtaccgagaagatcaagcccaatcacccattttttacctaagtgttgcgaaagccggccacttggccaaataaaggccagcgctgctccgaataggattgagaatgcacgggtatcagtaccgtaataaagccgacttggatcaaacgctgctggctgtacatgggcaatggtcatcatatacaagattgccatccaagcgccactggcggccgcaagaatcagcacaatgttcgcaatctgatgccggctcttaaccaatagcaacagcgccaacacaagaaaaggccaaatgagataatactgaccttcaatcgacaacgtccacaagtgcgtaaatggggattccccatttgcatatctagcaaaataggattgcccgttcaaaatctgccaccaattgtacacatagagtaaattggtcaataccatcatgtgcaagttatgcagcaagttttgcgagaataacgtgatataggctgctgtcccaaagaggacggtaattaacccaggatataggcgtttaaatcgtcgaataaaaaaacttttaaaatcaattcgatgattgcggtcaaattcgatcaacaacccatccgttatcaaatagccggacacgaccatgaagatcggtacgcctaaatatccgccccgaaacaactcagggcgtaaatgatacaaaataacaccaataaccccgattgttcttaaaccatcaaatccatgaatgtaccggcgctttcgtccacgcgtctgtttcaattgcggccccaccattctgtctaaaaataacttccccagccgttcagccgaagatcattcaacgaactcaaatgtaaaatcatcaatggcgactaaatcgccgctttcagcaccagcatcacgcaaagcatcatcaacccccatgctgcgtaattgccgagcaaagcgcatcgcgccatcttcatgatcaagattggccattttaaacgcccgctcaatcttgtcaccagtgagcacaaacgtcccgtcactatcgcgggttactttcaaagccggctctggttgatacttataatcagccgttttaaccgccgcttgtttcggctcaaaatgcggtgctgttttgagtacttcggctgtcttgtgcatgagtggcgtcacgccacgatgcgtcagactagaaatttcaaagatatgatccgccgcgacgccacgagcaagtaacgctgccttaaaatcagcaaatcgttcagccgcgccgggcaagtccatcttggtcgcgaccacgagttcaggccgcttcaaaatgttatcgtcataagcccctaattctttacgaatttgatcgtaatcatcaagcggctcgcgtccattatcaggatccatctcaactaggtgcagtagcacacgagtgcgttcaacatgccgcaagaactggatgccaagaccgacaccttgtgaagccccttcaatcaaaccgggcaaatcagccatcacaaaatcggtaccatcatctaattgaaccataccaagattgggtactaacgtcgtaaattgataagccgcaatttttggcttggcttgggttacaactgataacagtgtcgatttaccgacagaaggaaaaccaaccaacccaacatccgcaagcaccttcagttccaatttgatgaaacgatgctcgcccggttcgccattttcggaaatttccggcgccgtatttttgggcgaaacaaagtgcatattaccgcgaccaccgcggccacctttagcaacaaccaaagtttgacccggctcagttaaatcgcctaaaacctcgcctgtgtcagcatcggtaactgtcgtaccagccggcactgcaatccgccgatcttcagcagcgcggccatacatttgcttgccttggccattgccaccagctgacgctttaaaatgccgttgataacggaaatccattaacgtgcgcaaaccttcatcaacgtataagatgatgctgccgccatgaccgccgtcaccgccggccgggccgccaaacggtacaaatttttcgcgccggaacgcgaccataccgtcgccgcctttgcccgcctgaacctctacttgaacctgatcgacaaacattggcgatctcctttcagaaaaacatgtcatttgattatacgcgatgtttatatttcagtacagcgtaacgcatacctcaactattttaacacgtcccaagccggtactcacccttcatgcacaagaattagaaaacattgccaatatgccgcgtcagtcggggtactgacagttgttgaatgtttttgcacgttttaggttgcttttgacggtttcatcagtataatgaagaacgaggtgaaacgaaagtgcttacagaagaacgtcggcaatatattcttgcccaattgcaacagcataccgtcatcaaatctaaggcacttatggctgctcttgatgcttctgaatccacgattcgccgcgacttggacgagctagaggcagcaggtgagctcaaacgcattcacggcggcgccaagcgcatcaatggcctcggcgatgaaccggatgtcgcgagcaaatctgcgcagaatttgcgcgccaagcaaacgatcgcgcaggcagccgttcgtcagattgagcccgatgatctgatctttttagatgctggaaccacaacagcacaattaattccttttttggccgacattggtgtcacagtcattacaacgggagttgataacgcttctttgttagctgattatcaaatctctacactcatgctgggcggcatggtcaagcccacaaccaaagcgttgattggcgccacgacggctgaagccttgaaccattatcggtttgatgttgcctttattggaactaacggcgttcatcctgagtttggtcttactacgcctgatccagaagaagctgtgatcaagcgattggccattcaccaagccagtaaacctgtcattctggcggatccaagtaaatttgagcaagtcagtttcgtccgctttgctgatatctccgatgccacgatcctgacaagttcattacaaggactcccaaccagttatcagcgatttgaaaatattaaggaggttcattcttgatctattcagtaacgctcaacccttcgattgattatgtgatcgagttaccggaacttgaacttggcgctgtcaatcgacttacgcacgccgttaaattaccaggcggcaaaggcatcaatgtgagtcgaattttgcaaacattaggcctgccaacaactgcttggggctttttgggcggttttaccggtacctttatccaagatcggctcgatgcgattgacatgccttgtgacttcacaaaaactgctggtgatacacgaatcaacgtcaaacttaaagcagcatccgaaactgaactcaatgcaagcggtcctaccattgacgctgctgaaattgccgccttcaaaaacaaattagacaaacttgaagccggcgatgtcgtcgtcatgtctggcagtttaccaaaaggcttgcctaacactttctatcgggatctgattccggtgattcatgcccacaaggctgattttgtcatcgacaccactggtcaagcgttactcgacacattgcctgaccatccccttgtcgtcaaacctaatcaccatgaattagcagcattgttcggcgatccagaatatacaagcacagatgccatcatcaaagctggtcgccgcctacttggtcttggcgctcagcatgtcttgatctccatggagggggccggggccttaatgatcgaccaagatcacgcttggcatggcaccgttcctaagcagccagcggttaattccgtcggcgcaggcgatagtatgttggctggttttaccggcacatttgcgcagacacatgacacgttggaaagctttaaagtcggcattgcctgcggttccgcgaccgctttttctgaagatcttgccaccactgacaaaatcgctgaagtgaaacaaacaattagtataactgaagtttaggaggacaaaatggacattcgtgatttactactaaaaaatgtcatgatcatggacctcaaaggaacgtccaaagaggctgtgattgatgaaatggtcgctaaataccatgcagaaggtattgtgaccgacgaaaacgagtatcgccaagatattctgaagcgtgaagccgaatcaacgactgggattggcgaaggcattgcaatgccgcatgctaaagacagtgcggttactcgagcaaccgttcttttcgccaaaagcgatcagggcgttgactttaacgccttagacggccagccggttcacttattcttcatgattgctgcccctgaaggtgccaacaatgaacatctggcagcacttgcagcattatcttccctgctcatcaacccgaagctcgtggcagatcttaaacaagcgaagacaccggatgatgttttagccttgtttggtaaggcgcaagctgaaaaagaggctaaagataaagctgaagaagccaaggaaaaggctcaggaagaacaagaaaaagctgacaagcaagcagaattcaaggcagaaaagcgccaggaacggccatttatcgtagcggtcactgcttgcccaacagggattgcccacacctacatggctgaggcagccttgaaagaaacagcggaaaagctcggtgtcgatatcaaagtcgaaacaaatggctctgaaggtattaagcacaaactgaccgattccgatatcaatcgagcagctggtgtcattgtcgctgccgacaaaaaggtagcaatggatcggtttaacggcaaaaagttgctcaatcggccggtcattgacggcattaaaaagcctgaagaattgattgaagaaacgcttcaaggcaaaggccaagtctttcatgctgcaggcaccgataacagtgatgcggccagtgaagaagcttctaccggcactttatggaatcgcatctacaaagacctgatgaatggtgtttcaaacatgctgccatttgttgtcggcggtgggattatcatggcgatctcgttcatcctcgaacaatggctgggcaagacatcgatgtggttcaccttcaccaacaacttgggaacctttgcctttagcttcttagtacccgttttagcggcctacattgctgaatcaattggcgatcggcctgcgttgatgcctgggttcgtcggtggttatatggccaccgttgcaacggcctccgttgtgaaggctcaaaacccagctggcttcttaggcggtctggttgctgggttcgcagctggttggatgatcgttggcttgaagaagctgctcagcaaaatgccacattcacttgacggtatgcgcacgatcctgctctatccagtcatcggccttgccatcatgggtctgctgatgttcttcatcatcaacccgattttcgccgctatcaatggcgcattgatcagcttccttgaaggcatgggtactggtaatgcgattctgattggcgtcattctagccgccatgatgagtatcgatatgggcggtcctttcaacaaagccgcttatacatttgccatcggtgtctatcaagcatccggctttaaagatggtcggtggatggccgcggttatgattggtggcatgattccacctttggccattgcggttgcttcaaccttcttcccgaagaaattcaccttgcaagaacgcaacgctggtctttctaactatgcacttggcctgaccttcatcactgaaggcgcgatcccatttgctgctactgacccgctgcatatcattggcagctcagtcatcggctcagctattgctggcggtttgacccagttatggcacgtcaacgtccctgctcctcatggtggcgttgttgccttgctgctaaccaaccagaaacttggcttcatcatgtcgcttctgattgggaccatcattgccgccttaatcctcggcttctggcggccagtcgcaaaagaaaacaaataagtaaacaaaaagcttggcgatcaatgtcgccaagcttttttgtgccgtgagaccgaaccggaattccacataagagcttgtggtgcgttagattcctagccaaaaaattcgcttgccgtgccaaactccgcaatctccggccagatggggtggcaacgcgtagctagagcggagacggcgcttcgagcccgccaaacccgcggtctcgaagtcgcctaacaacatcagctccagagcccgtcgctgtgttgtttgcacggctgagccccatctagcctacgattgcttcgccttggcactagatctttaaatctcaagattgtttgttctcactgatggttatgaacgatgtcctaaacgctcctacgatttgattaaacccgtcgagctggtgtcggctctgccgtcagcgacagcttcaatgcctgcgcaacttttttagaaatacctagctcctgaatatcttcaaggggagcttctttaatcttattgatcgtcttgaatttccgtaagagcttcagccgcgtcttgggcccgacccccttgataccttctaatcgagaggccaacgagttcttggcgtgcagctgccgatggaaggtaatcgcaaaacgatgcacctcatcctgaatccgttcaagcaggtaaaagccttgcgacttaggatcaagattaatcagctgatcagcattgccaaataacaatgctgccgttttatgcttattatttttgaccatccctgccacaggaatatcaaggttgagttcgttttccaaaacatccttggctgcgttcatttcaatctcgccgccatccatcaagatcaaatctggtaacggtgcacgctcctttaacaaccgggtatagcgccggcgaatgacttcgcgcgtattagccgcctcatctgcgccattatgcgtcttgtcagcatccaacttgtactttcgataattgttcttagctggctggccatctacaaactgcaccatcgctgacaccggatcagctccttgaatgtgactgtgatcgaatgcctcagccacatgccccattggcaagttcaaagcggccatcagctctttcatcgcgccaatcgtggtacgattatccaattccatcaaacggaatttgtcttcaagcttaatttgactgttcttagcagccaaggccatcaagtcccgtttttcaccgcgctgtggcgttctaactggaatctctaggatatctgccagtactttattatcaagcccagcaggtacgagaacttcgcgtggtttcacattattcttgcggctgtaaaactgtaaaataaatgattcgaattcttctttagcagtgttcaccactggaaaaagtcgtgactcacgtttcattaaacgtgcttgacgaataaagaagacctggatactgatccagcccttatccatataaaaattgaacaaatcacgcgttgtattgtcgtgtgaaataattttctgcttctccaccgtctgttcaatataatgcagttgatcccgaatttctgcggctcgctcaaattgaagatttttcgcagcccgctccattttagccgtcaaactggctttagccttgccaacgttcccattcaagaagcgcttaatacgttcaatttggtccgtgtattccttttccggaacagtccggaagcaggcacccagacactgacccatgtgataatacaagcacggtctgccttgatagccgttacagcgccgcaatggataaaccttctggataaaatgcatggtttcttgcgctgcgtagacatttgggtatggcccaaagtaataaccgccatctttacgaatagtaccagtgatttcaatcttcggatcgcgttcatgagtaattttaatgtacggatagccagtcccttttttcaacttaatgttgtaatacggctgatatttttgaatcagcgtaatttcgagcaaaaaggcttctttgtcagttgaagtcacaatgaaatcaaaatccgctacctgtgacaccatcgccgcaactttaccgtcgtgtgaactcttgaaataagaccgcacccgatttttcaggtttttggccttgccgacataaataattttgccgttgatatccttcatttgataactgccaggcagatctggcagcaacgataacttgtgttcaatgtgtgctgaggccatcgtaatctccttataaaacaaatgttcgcctaacattataaagattctaaaaatggattgcaagcaagcggctttgatcagtgatggcatgactgcccccatttagcaatggtcacttcacaccaaaaacacctcaaccagtgccgcttaccagctgctgggtgaggtgtttttgcttattgggcaagaatcttggataggaagtcttgtgtccgttcttcttgcgggtgttcgaacagttgttctggcgtccccttttcaaggattttgccgccatccataaaccatacttcatcggccacactacgggcgaagcccatttcgtgggtcacaacaaccatggtcattccggttttagccaaatcctgcataactttcagaacttcgccaaccatttcaggatccaaggcactggttggttcatcaaacagcatgacatcaggatgcatcgctaatgcacgagcaatggcgacacgctgttgctgaccaccggaaagactggatggataagcatccgccttttcggctaagccaacttgatccaagatttctttggctgttttggttgcttcttcatcggtcacagctttgactttaagtggtgcgagtttaatgttttccaaaactgtcatattggggaacaaattaaaactttggaacaccattcccattttttctcggacattatccagctctttctcgctcaaaccaactaaatcagtaccttcaaaaaggatttccccttttgttggttgattcagtaaattcaggctacgcaggaaggtacttttcccaccaccggaagcaccgataacaacgatcacatcgcctttgtcaatggtttcggtgatatcgttcaaaacaacattgtcgccaaactttttggtgaggtgattgatttggattaaaggtttatgctgcatgattcatcttcctttcaaaatgactcaagagcttggacagcccgaatgtcagaacaaagtagaggaccatcgcgacaaggattggttgaactcccttgtatgtcgcggtttggacaaccgttaactgataaatcagatcggtaaccccgataatggaaacaatcgagctttccttaatcaaggagataaattcgttaccaagcgctggccaaatattcttgattgcttgtggtaaaacaacgcttatcatcgtctgccgctctgacagaccgagcgaacgggcagcttctgtttgccccactggaatgctatcgatcccgctacggataatttcagccacatacgccgccgagttcaaggaaacagcaatcaaccctgcaattagcgcaggaatatcaatgaagatccctataccgaaatagacaaacatgacttgaatcatcagcggagtgccacgaacgaactcaatgtatgacacacctatcaaatgtgatagtttattcttgctcaaccgcagcaaggcgaagatcgtgccgagcagaaccccgaagaaagcaccgatagcactaatcaacagcgtatactcgaccccttttaggaagtaggtccagtaatggatcatactggtatcttcagtattggttttcatgtaactgccagcagttttgagatactggttaattaaacctttttgcttaatctctgccaagctcttgttggcggctgccactaatgaatcagagttcttagcaaaccctatcgcggtaccgactgtgtcgcttgataagttgaagtgaccgggaatctcaactaacgaatcatcatttgacgtgtaagccttcgctaccgcaccttcagcgacaacaccagctaccttatgtgtcttcaacgccaaaatcaggtcggtgaccttagtcaagcccaatgtggaactcgtcttcatctgttttttcgctaacgtctcttgcaagctgccattctggacgccgactttcttgttcgcaaaacttttatggtctttgtagatcttagcatccgttttgttgaccaaaatgtcttgtccagacttgtagtacgtatttgaaaagtcaactgacttccgtcgggcattcgtcggtgacatcgccgccaacaccatgtcgaccttacccgtctgcaaggcgaccagaagtgagttaaagttcatctgtttaatgaccagctttacacccagatccttggcaatcttacgcgcaacttcaacatccatgccaacaacttgattcttgccattcttgttgactaaaaattcatacggcgcataatcagggctcgtgcccatcaccaatgtacctttttgttgaaccttggccaagctgtcatcagcatggaccgtttgcatattcaatgtcacaacagccgcaaaaacagcgactaaagcgatcaaccagcgtctcaaatgcttcataataccctccttgattacaagagtgtactatacactcaaattgatttttatgcaatatgcattcatatttttccagatttttttgttcgggcgacttacctagacgcgccccagtgttgatgctatactttcagcaaggaaaggggtggcgtgcatggcactgaaaatcaacacacaaaccaacctgaatgacatgttcgataagtttgccagtctgcctggtgataaggagaacgcaaccgggccagatccaaaacaccacgacaagttggccaagaaagccaaagaaaaaacagaaaaagaagcaaagaaatagcgaagtgcgtgggcacttcgcttttttcatacctagaaaccgattattttttggcttgtgggtagcgtttcgccaattcctgaaggttactcgttgcaacatcatcaaaatcaatgtctgcccacaaagcaatctgtgataaataccacaacacatcgcctagctcatgttgcagcttgactttatcaagatcctgtccctgaaatgtatatttcttgattaaatcgatcgcttcgccgctttcacttgccaaccctaatgacaggttagtcaaaacgtgttcattgccagctaaggtgcgatttgctttttgctgatagtcattgaaattcatgctttatcttccctccaagccagccgtttgttcaagccaagaccagacagcctcataaccttcaccagttgttgccgaaaatagaatcacatcgtcggtctgattcaaatcaagtcgctgtttgatctgtttggccacatgcagccgtttactttttggcgtcttatcaatttttgtggccaccaccagtgttctgagctgataatattttaaatactgatacatactgatgtcatcagcagtaggctcatgccgactgtcgaccagcaaaacaacaccgcgcaatggttgccgcgtcgtcagataagtctcaatcatggcggcgaacttcgctcgtgcggttttgctgaccttagcatatccatatccgggtacatcaacaaaaaagagtcgactatcaagatcatagaaattcaatgtctgcgttttacctggcacaccagaagtgcgtgccatggctttgcgctgaatcagtttattgatcagtgatgacttgccgacattactgcggcccaaaaaggcgatctctggatgaccgtcctcgggatactgagcggccgcaaccgcactaatagttaatttgacgtcatgcacgtccatctcaaacggcctcctcttggctttacctcaacgtgatgtctaaacacaacaccgcttcaaatagtttagcatattttacgcagcctcgccggagaaaccggtcgtgattcgggtgacaccttatccgcaaacacggccgtggctaacctcaaaagaattttttaataggacggatttacaattcaagtgcaacaaattagtcaaatagaaaagactcatagccatgagtcttttctatttgactaatttgttgcacttgaattgtaaatccgtcacatctatattaaaccatgccaagggcctttgtaacaatctgtcaacaccatgttttgcaaaaaagattttcctacacttgataaaggcgtggtgactatggttttaggactatagaaatcacaaaattctttgaaggggggagcaggatgtcggtctatgaagctttgaacctgatgatcatgttcggtgtattcatcatcgaactgatcgatttggttctacagctgattgatcgggcaaacaaataagccgtcacgtacgcctatagggggctcgtgatggcttaagccattacacatgagctgccattgagcagcattgttgaaccatggagtcgccggttcccgccagcggctttttttgttacatctatattaaaccatgccaaagctgtttgtacaatctgttcacaccttgaaaaacaaaaaagaaaaaagccatcacaactggctgaagaattgtgtgatgactcataaacagtgcctaatcatgcgtaaaagagtatcgacagtagtccaaacaaaaggtgttgacagattgttgcggctcaactgacgaagctttcaacgttattcaataatcttagacttccgcgtgatatggtgcattttctcgatccacgggcgaatcggttcttttaggaaaagccctagaaggaagaacgcgacgccgaatgccacgaggatgatgagatcttgccacagatttggccagtagatcccgccaacggtttcgcgcagcaagttgacggcataggtgaatggcagccatgggttaatggcttggaagaacttacctgagagtacaacggggaagttgccacctgcgccggagatggataggactaaaataatgattcccaggcccttaccgatattgccgaacagggaaattaacatgtatagaattgagacaaagactaggcttagcaacatcgcaaacagcaaatacagcggcttgtcgacaacgtacgtcccgattaggaagagattaccgagggcggcgatgaggccttgtagcatccccagtcctgcaaacgttaaccagcgagcggtgtacatctgtttgacggtcgcatgagccagcgattccggcagctgatattcggtaatgagaatggcgccgagcagcaaggcaccgacccaaatacataaggctaaataaaagggggcactttgtgagccataggttgggatatgatagaaactcgtttgcttgagctctaccggtttagctaaaaagccggcttctttcgtggcatcacgtctcagcagtttgatcaactgcgacagatcaacggatttctcgccttttttgattgccgttgcgcctttttgaatggcatctttcaatgttggccagtcatttttgattaaggtttgtgcatcatccagcccgctttgtagttgcggcattttttcgttggctaaagcaagcgttgatgtcaggtcactttcaacgcctggcaggtcttgattgatgaaattagttgccttggtcaatttcgttttaagacttgggaagtcattttgatataagtcagcgactgtcgtgataccactggtgatcaagttcatatgaccgttcagcagcgtattggcatcagtgagttcctgcttcaaggctggtaactgtttttgggttttaaccaaaaacgtgttggcttgtgtcagtaagtcctttgttccgctgagtaaactcggcagttccggcaatacttgatcgttgattttagtcagcgttgtggtagcatcagcaagcgcagccttgaaagcgttcagtacttgcttcacactcgtgccgagatccagatccttgagtgtattggcatcacttgcaaatttctgagcgacatcattgagtgtcgccaaacgactttgtaactcattggtacttaaatttggcacgtctttggcgagatcgctggcggccgtccgaacagcagtagcggtagtcgcaacatcacgcagtcgcgtaatggcaccggccaacggttgatcgtccttaccggtcagcttgttaagactggtttgcaggcgggttaatgtatcggccagactggtggcattggctgccactttgccttggcgatcagctaaagcggttaatcgggccaccattgcctgtttgatagcggcggtatcactgctagtggccaactgctgcaactgattttgcaaggtagttaagtcagcacttaaactagtattcgcggcggctatcaatgtcagaccagcatcgaccgcattttgaaccacatcaagtgctgtgctgacttttggcaagacttcatctttggtcatgccaatcgccgcctgagcgtttttgccaaagtcggtcagagcaggcaaagtgccgtcaacttgattgacgacggtaatgccctgactggtgacccccacggccttcgtaaccgctgattctagttggccaaagttggtggtcactgtattaagctgcgcaccggcttgttgcacttcaggcaacttgctgcgaacatcgaccgccaactgaccggcatcggccaccatcggtaaatatccgttggctgccgttaatttttgggccatttgattgacttcaggcaagtaggtggccatttcgttggcggccgccagtttttctcggatggctggcattttactctgcaaaaccccgacttccgcgatgtatttttcaattgtcggtaattgatcgtttgtattggttaccagacttgcaaagcgccgaatcatcggcagattgtcatccagcttaatgcctgcctgattgaagacggtcaccaaggttttggcaacggttgacacaaattcgtctgaaatggtgttttgcagcgtggacgccccgcttgcagtaattttaggggcgatggcattaattttttcattcacataataatctagctttggtttgtgaatcttaccatcgacaaaactaagcaagtccgttgagaaatctttgggaacaacgacacctgcgtaatatttgccgcttttgaccccttcctgaaccgcctttttggagtccacaaaacgccagccgagttgcttgttatgctttagttgggtgaccagctcatcgccaatggcaatttttttgtcacggaattcggttgatttatccgctgaatacacggcaacagtaagatcttgggtattgctgtaaggatcccatagcgcccagacattgaaccaacagtagagactggggatcacaaccagcgccaaaatgagtaagaaagcgaatgggcttttaacaattcgcttccagtccagtgcaactaattttcctatgtttcgcattgtgctcctccagtgattttcaaatttgtatttgtagattataacatgcgaatattcgtatttcttgattcacagtagccagtcgtctgtgggctgactggtttacttcattagaaaaggtattgttacgttaaccaatatcggggatgtaaagtgccgatagcaagcgaatattacccttatttttaaggacgatgatgcctaacactgtatagatgtttgacagcgcaaaattgggaaattgttgaaaaatcaataaaagagaaccaccttgatgaacgaacagaagatagacatgcgtcgaattcaatgggaaaatgaaagcgatttatcggaaggaggctgaccatgaaccgaatggtgcatgtcgatattcaggaaattgtgaaggaagaaaatgtcacccatgattggcgtctattgatggtcttggaaggtcagatcaaggtggcgatctttcaaactgattataagttggtaaaagacaatttcatcattttaaaccctaacgaacgattttctattagcgcaacagtgccagctttgatactcgctgttaccattaatgcgacccatttaacgactatcttacctgacactagtaaacaacgtttttggaatcttccaatgtcatcgcccaatcaaactagcaataaccttgcagcgtgtcggcggctactgcatcgcatgatgatcaccagtctttctgaggatgtggacgaggctacagttgccgctaccggattggcattaatgggtcatttgcgtgctcactatctttggcacgaagaaagcaagtcaatctttgaccatgaccagctcgtgaatacagtgatcaccaaattagaaaccgagtatgccgaggatattagcttgaggttagtagctgatgaaatgcatgtctcttacaattatctgtctaaaaaatttaaggaacagacgcatctcaactttaatcgttatctcaacgctattcggttacgacatgttgagctagatttaaagtatacagataaaagcattacccaaatcggtatcgataacggttttctccaacctcgaacgatggcccgaaattttcaagaccgatatgggatgtctccgcaaaagtttcgacatacgctcgcagcaaacctgccggccattgacagtactcgacaggtcatcacgttgtctcgagaggaggccttggtccggatagcaggacagctggcagaagaggatcttgcatctatacagcccgtgacctctcaacaaaaaagattagatgtccaaacggcccaagtacttgcccacaagaccgccacatataccgtcaatgttggcgacgtgttgaacttgaataaccaagaatgtgtcacacaattgaatcaattgactgaagaaatgccgattgcctacatcagagtatttggcgttagcaaagttagaactgatccaatttttagcacggttgtgacgagtgagaagaatttaatgagtgctttttacgcgatactcgcagtaggggcccagccaattattcgtttatcagtagaaatggtgttgcactgttcgcctgaagatttaatagcccgatttgaggccattgcgcaaatgtttggtaaaagtgttgtccgccgatggattattgaatttgagtatgactgccttgtcagcgacaacgaagatagccaaactgtgatatcgtatttccttcaaagcaacaattggcaacgcatcggtgttcacgtcacggaaaagaacttccatcacaccgaaaaagacaagaaaatgaaccttggcaaccggtttgtctatttatcatgtgattatctgttccttcgaactgaaataaaagaagacttgtccgaacttaagtcgcgtcttgatagtatccaagcgcggctggcaccggatcggcaatacgcgcctgaaatagcactggatgattggaacactttggctggtaacgatgcggttacggttggaaccttctttcgctcagctttaatcaaagagatactgcgacagaataatggatttgataatgtcagcttttggctcagtatcacaagtcgaatcagcattataccagatacaacggatgagtgtttgtccttgtttttgtatggcaccattcggcgaccagtttactttgtcgtgcggtttctggacgccttgattggtgaacgcatcttgagttcgccatggttcagttgttaccgcaacggtgaagattatacagttttattttccaatcctacctatatcgatccgcgtatgtcgattagtgatagtctcatgcaatatcagtcgcaggaattacaactacagcttgttggacttagagggcaacgttatcgaatcgacagtgaattgttagataaggattgcggtggtatctataatcagtggcttaaggttggcgcagtgataaactattctccccaatatattaagtatttagcgaccatgacacagccgagacttaagatcgaggatatcgcaacaacagatggcaagttggtcttgtcggctacccagtcttttaatagcatgcgtgtctatcgtataagaccgctgaatgattaaggatcacaataacacaagtagcatctctgcagaagtgtagggatgcttttttataacttcacatgtgcgctttgaattttgtccgacaatattagctctaatcatgatagcgcggataatcggcttgtgaaagcgctatataaaaacgaataatagcctatgagccatgaagtaactacctacaatatggttatcagcaaaattttctgaaggtgggtggcaacatggcaacggttatcggtaaaacgtccagatcatcagagacaatgctcatcacgtcattgatggcaggttattcgatggtttacatggacaaaagcatgatttcaacagcaattattccaattgcttcgcagttccatttcagctcaggtcaaactggcctaatgatgtcgttgttttttcttggttattcattgatgcagattccgagtggttggttagccgatcgcttcgggtcaaaacgtgttttaatggcctcactgtctatcattgcctgtttttcatacttattcggtattgccaatggcttacttttcttcatcgttgttcgcttttgtgccggggtagggcatggtggttatccgccaagctgttcaaaagccattgcggaaaactttccaaaagagcggcgtacttttgttcaatcattgattctttcaacgtctggcattggaggcattctagcgttcactttgggagcccaactagtggatatgaactggcactatgcttatatcgcaatgggaacacttttcttggtagcacttttgtttgtttggcgatttgttccaaaaggtcaagacggcaatcgtaaggcgagcgatcaaactgaaaaaacgagttttctggctatgcttaagaaccgaaatgtgttcgttctgtttctggcgatgcttctgttaaatgttttgctttacggcaacatgtcttggctcccatcttatatcacgtctacctttaatctaagtatcagtcaagccggcatgatattagccattaacgctgtctttcaaacgattgccacaatttttgctggtcaactgctctctaagttgttcttgcataaagaaaagcgggttattctgatcgccacactgatggttgctgcactgctggttgggtttgtattgtcgagtaacctgtatatctcggtcgtcttgttactgctcatcagcatgattagtgtgacggcttttacagcaatttttacttggccacataaaattatggatgccaatatcattggctcttcaattggcattattaacactgggggcacacttggcggctttttagcgcctatggtcattggttttctggttcaggccgctggtggttcgttcgttccggcatttctgttcatggccgtgatgagcttactgtgcggtatgactgttattgctgttaagacaaaggcttaaaacaaagaggaggaaatgaaaatggatgcaaaagaacgcttaatgcagattgttgaggacaagcaaaatgagtttattaaggcttcagatcagatttggcataccccggaaacccggtttgctgttgaaaagtcggttcagccatactatgacgttttagaaaaagaaggttttgagatcaaaaaaggcattgctgatatggattattcatttgaggcgacttggggtaaggggaagcctgttatgggtatgcttgctgaatatgatgcgttggggaatttgagtcaggtagcaggagcgactgagcatcaaccaattgttgcaggcgataatggtcatggatgtggtcacaacgtgttgggtacggccgcacttgctggtgcagtcgccatcaaaactttgatggaagaagaacacctttcagggacgattaaactgttcgggtgtcctgccgaggaaagtggttacggaaaagcttttatggctagagatggtattttcagcgacctagacattgctttagcaaatcatccaatggattctatgtccgggtggggcagtagtagtttggccgttctgcaatgttactaccaattcactggcattccagcacatgccgccgcagcaccagagatggggcgcagtgctttagatgctgcggagttaatgaatattggggttcaatttctgcgcgaacatatcattgattcagccagaattcattacgcgtttattgatgctggtggagaatcagccaatgtggtccaaccaagtgccaagttatattattttattcgcgcgccacatgtcgaccaagctaaggcgatctttgctcgagttaacaaaattgcggaaggggctgcgttgatgaccgaaacgaaattgaccaaagagtttgatgcgggatgctccgattttatcgctaacaaacctttaacccgcgcaattgatagaaatcttgatatcgtaggacctttgaagctgactaaggaagaattggcctttgaaaaaaaactctctgagactgtttctgatgccagcaagcaaaatttatatcatcgggctaagcattcatttcctgattggactgaagagcagatcaaagcagaagctgattctggcattgctttgcacaagttgccgcttgaatttagtgatgaaactgctggttccactgatgtcggggatgtcagccaagtcgtgccgaccgctcaatttacgaatggctttgaacctcaaggcacctctccacacagctggcaatgggtttcaaatggcatttctagtgttgctcataagggactattgttaggtggcaaggtttttgcattgaccgcctacgatgccttagcgaatccgcaattggtcgaagacgcaaaagaagattttgcagcacattttgggaataagttgtttgaatcgcctattcccgctgaggtaaagcctcggtgattagatcgaggcgggtttctcgtacattgagttgatttgagtgtaagatgcaaatcaacaatcaacacatcttttcaaacctttgtcttgacattcacaagcgcgggccgtatagtccttccaacaagactgtaggtgttactcagcacaactttcaaagcgagctgaatgacatttataaaaacaacactttgagaagaagagtaaccttggcgcagacgctgtagaaatccctgttgatggaaaagggtcatctgcaagaaggtgaagatgagcttcgaatagttattcgtgcggttaacgctcacgagtcggttacggccgttatgctgtcaggtatcaacaggtactggagacgatgtgtcaacatcgtgaataagggtggtaacgcgacactgtcgccccttgactacaacaaaagtagttaaggggcgtttttttgtggcagcgcaaggttatctaaaataaatcaaagttgtttaacgagatggtcttgatagtttgctggtggaaatgtttggaggaggatctcttatgagtcgttggaaaaaagctatcttcacagggattgcattggtttcattattaacactaacagcatgtggcaaagcagctagtagcaatagcagtcatactagttcaaaaagtgagtcaatcatcatcggcagtagtggctcggattatcaaatttggcaacatattgctaaatcaccgcaggccaagaaggctggtctgaggattaaagtcaagcaagtttcagatggcaacgtcactaactcagctactgccgagggacaattggatgttaatgcattccagtcatatgcttactttcagcaatataacaaattaaatccgagcgaaaaattagcagcattaggcacaacctacctggaaccaatgggactgtattctaaaaaatataaacagctgcgagagattccagatggtgcaacgattggcatctcaaacgatcctgctaatgcgacacgagggttacttctgctagcaacggccaagcttgtcacccttaagtctgacttcaatgctttaagtaccgtgaaggacattcaagccaatctgaagcacttaaagtttaaagaggtcgacccatcggtgcaaatgctgcccgatttggacgcagaactgatttcgaatacgcgggcacttgatggtgggctgaatgttttgaaagattcattggtgcatgagaagttgaaccaaacgacacgcgccaacgtcaatatattagtgaccgcagtgaaaaatgaaaaaaaggaagaatttaaaaagttagtgccgctttaccatgacccaacgattcagagttggattaaaaagactttttctggcacgaaacttgatgtgaataaaccgatcagttatctccaacaaaaataataataacgagatcgctgtgaaaccagtacttatggggctgtagagcagctttttgttgaaggggatcgagccattaagcaattcgggttataatgacagtaatcgtaaaaattaagctttaaacactgacatttattttcgaaaggggtcgttgctatgtgttcttcaatgacaattaaatcgctacaaggtgatattttctggggccggaccatggattacaacaccagtttctttcatgaatcaccagtcggcggggttcctggtaaaattgtcagtttgccagcaaacaaggcattaccaacacaaagtgccaaatggaccacaaagtatgcagcggttggcgtcggtattgatcaaagtacggcacttttcgacggcgtcaatagcgaaggcttggctggcgacttgcaggttttggtagagtgcagctgggcgagtgcggattctttgaaacagcgtgggctgaaagctattaaaggcgaggagtttgtgaccttggccttgacgacatgcaaaaatgttgacgaagtacgcgctttggcgggtgagtatggcctgctggatgaaccttatgagtttggcggccaaggggtgaaaatcccattacattacacatttgttgatccatcaggtaaagggattgttgtcgaaccaaccgatcacggcgcctttaagctgtatgatagcatcggcgccatgacgaatagtcctgaatacgggtggcatgaaaccaatttgcgcaattatgtcagtctgaatgacaataactatcctaaggggtccgaattaggcgactaccatattgagccgattgagttaggcacaggctacgggatgttcggtttgccaggcgattacacatcaccatcgcggtttctgcgggcaatgtttgtttcgcgtaatcttgatcccttcaatagcaaagacggcattcgcgtgttatacaatgctttcaagactgtcttgattccgcaggggctaggtcgcgacccacaacatcaggttttaacggattacacgcagtactggtctggctatgatctgacgaaaaagacaattttcgtgcaagattcagacacattgacaatgacaacgaaaacacttgatccgactattattgacgtcacttatgaagatttggctaaaactgaacagttcaatcaactgtagactgacatcattgatatgaaaaaaggcaacaccgaacgagagaccaatcattggttttggggttcagtgttgtctttttgatttgtcatctaacgagtcggagtggtggcttggtatcgttatttgtcgtgtttgtgcttttgccacccagcgatcggaacaactcgattattcgttgtcgtttctgttggattactagtaggttgttggggtgctggtttggcggcaacaagttcttgaacgcgactttcggcagctgtagcaagtgcctgtcgctgggttggtgtccacaggtgggaggttgttgtagatcgaatgaaaatagcgaccatttgtccaatgactgcgcgctgatcaggaccaatggtttttttgtcatatagtagcatggacatggcagccttaatgtcctgagcggtccaattctttggatcgtggccgaacaaactctgaatcgtgtgggcaaggaacaacgtggtggcaccaaagagttcctgattttgaactggcttaggaacctgcagccacgttttggattctaaaaaggtcatcgtcaattgaaataattcagccatattttcggaatcaaagtcaacgtcattatcggggtcactgaaggcatcatcaacaccaggaagatcaaaatcatcattgccgaatggtgatgtgagggcctcctcttccgtcaaaccgagcagataggtggcagtgacgaacacgttcatcaaggcatcaacaaattcaaggatagtcaatttaatctcatttgttgcaatcaaccagagcataaatgtttttaacagttccgccgcgatcgctaacgactcgctgcgatccaatgcatcatcatgataagtctgtaaggtctcttgcaaaccagctgcaacgtgttcagtatcaagtgcttgaatggttgaacgaaggttatcaaaggcatgcacgaaaaaggtgacgaggattaatcgaatttcatctggtggcacttggctaaagccgggaactgtcagcaggtgttgataacttgtgcttttctggaaattttcccagtatctatcgatttcgcgactggcatggcgtcgcagttttaattcgtagtccatgatcggcctccattaaaattggttggattcactaagaacagtttaacagtaacaagcttgagctgatagctgttagcattatttttagtgcacaaaaaggaaaagcgttgcccgtgcacggacaacgcttttgatattgaacgttattattcaaacatttttttcgtggcatgcatcaatgtcttgatgtctttatcataccgcggtgttttaactaaatgactcattggaatgccggtgaaatgataagcggcaatctcacctgaacgaacagcactttgctcagtgaagaccatttggaatggttgttcagcgaattcaccggtaaaggcaaggtttgttgaatgtgctggaatcacgtctggccgatcaaccttggcgcgattgttgaagagtgccgaagcataaggcatataaacagggatgttgttgatgatgcttgccataatcttatcttgatgatcacgaatattaccaggaccgggatcaactttagcaagctgaccaatcaattcaagggccatctctttacccgtcatttcgatatacggcttgttgacaaattcaccgtagcgccgtggataaaggaagtagccccacaagacggtctcgtttggtttctgggtggtaaagtgcggctgatgatgtaccacgattgacatcataacatctttttgcccaagtgccgtgattggttgggttgacatgaacgaattcagggcgttaccagggacttgcgttgtaatacgttcgatttcgttaagcaacaaatggtctttggtcgtcaaggtgaagctgacccactcgctggctgaccgatccgcaaagaacttatcaggattaccaaggttataaaaatgctcagtcgcttgtttccacagactcgcggcagcaccgtagtccatgttttcgactgctgcatgatcaaagtcaccttgagttgcggagtcggtgatcgatccatttgtgaagaaaacggcggtatcatcatcaacggtaacatgttcttcgtcatcagtctctgtgttcagaatggtgaggcccgtaactgtaatttcatcggtcatggccgtgtctttaaattcaaacgcagtgacacgccggttcaaaatgatcttgcagccttgctccttcaggtaattaatcagtggcagcataatgctttcaaattgattatagcgggttcggttaaccccgactaaatgctcaatttgagtaaattcataaatcatcatgtgcatgtaccgccgcaattcctgcgcagaactttgtgtgcggaaggcaaaggtggtttcccacatataccagaaattggtttggaacatgtgcggatcatccttgaagtagtcggcgatgctaacattgtcgagcttttcttcttcggaatcaggcatcatgattaacttcgtcagcaaaaggcgatccgtgttattcaggcccaagtgtcctgcttggatgatgccaatgccgccttccatcaaccgagctttatcaaacgtccgatgttgggcatcgaattggcgcgtgtcttcttcagctgtgagtcccggttccgttgccgatggaatccgactaagcaaatccatcaaatcgacatacgtccggtaattcaacatccgaccgccccgagcaacatagcccttcgtgttttccatgggatgatttttgttccaatattcatccacagtatcgactgttggggcaccatcatttgaaccatggtcatccagtgaatagaaggtgatttgatcaccttgccaatgagcttcctgaatgagataaacagctgcagccatattggccagccctgcaccgatcatgatcgccttatgcttgatcattttcccgcctcctagcgactttcgaacttcttgtatgcgtcagcgtcatctttaaacagctccattttgtttgcgaagtagcatgcggtgccgccagcaaccagcgcaacgcctagcgctgtcaataagaatttcttcatctaaaaacgcttcctttctgatgtcacctatattataggcacaagtaaaagaagcgtctttagtcaaattgtgatgtttgttcgaaaattaacttttattgtgggccaagtgaccgcttgcggacaatgaaagcaatcgacccgtttaacatcaaatcagcccgcttgatcagattgcgttccggttctttcaaggactgcgctaaccacagcagcacttgccctacgatggctgccccataaaagttgcagatatcggcaacggtttgggctggtgttgctgggtcaatgtccaaaacgactggtttcaccatgtcggtggctgactgaaataagaattcttccagcatgtcacggccaactgaatgaaacgcattcagacaaaagacctgattagccatgatatagtcaagcaccagctgatactttgtttcccatgtggctgcgcctaagtcctgcatcactttacggccaatgtcagcctctaaggtccatttcagtaaggcatagatgtcatcaaaatggtaataaaacgtgttgcggttgacgtgtgctgacgtactcaattcggcaatcgtgatgcgatctaatggtttgtgttgcatttgtactttgagaaccttggcaagacgatccttggtttgatcagatgtggacatgtacaatctctcctgtagccatggtcaacatttttggcatgaaaaaccgcttgtcagttgttcaagccgacaagcggcgatgacttactttactttgagtggtttcaattgcgcttcgattttgtcgagggtgacgttggcttctagcaatgctgcggctgcataagccccttcaacaaacgcgacatcataaacatgcatctgtttatcactgacttcttcggcaatgtccaaattcattttcgcactgccgaggtcgtagaaaacaagcagttcagaagctggattatcgccaattgctttttgaatatggtcgagatccgtgccgattttgccgtcgctagtaccgccagctgtggtgatgggaacatctttagcgacttgtttgattaaagtttcaacaccattggcgatcgccggaacgtgtgaaacaagtaaaatgcctagtgccataggatcactcctttacaagtgtttgccttcatagtttgtcggttgtcgatcaagcggtcgcatctaaataggctttcaacaattcgccagttgaagcagcgccgggatcaatgtggccgacactcttttcaccaagataagacgcccggccgcgtttagcgatcattggctcagtggaagcaaccaacttgtcaatggcggcgtcatcgagcttgccttgtttaattaaatcagctgcaggtgcccagacatcgagcattgtcttatcaccggtttttgcttggccgcgcttagcaataccctttgcggcagcatcgacgaggtcgccaaaatcggtgtcggttttggcaagcttagccatttcgagaaaggctgtaccatataaaggaccgctggcaccgccgactttgctcagcatggccattgcaattgtcttgaagtcttgagccagatcggtagtcggtggggttttttcgaaggctgctttgatcgcttcgacgccgcgctccatgttgttgccgtgatcagaatcgccaatcacgcgatcaagttcggtgaggtggtctttttccttggtaatgcgggtttcaaaattcgtcatccatttggctaatgtatcagcgtttaacatcggtatccccccaaccaacagtgtgggctgacgcattcaggtaggtcagccattgtggatcgtctaaagccaacatggtcaatgagatgccagccatgtcgagtgatgtgacatagttgccagctttggtgaagctgacaggtaacctttcagtcttcagttcattcagcacatcgcccatgaaaatgtattgttcagacaacggggtagcacccataccgttaaccaagacggcatacttgtgggcttgtggatctttgaactccgccgtcaacttgctaatcagttgcttagccaattgtttagaggtcggcagtttttcctgaccggtgccaggttcgttatgaatgccaacaccgaattcgatttcatcaggttttaaatcaaacccgggtttgccgacttcaggaaccgttgcagcgtgcaatgctacggcaaaggacttggtgttcttaacgacggcatcgcctaacttcttcaggtcatctagacttaaaccagcttcagcagccgcaccgataattttttcggcaaaaatagtaccagcgacaccgcgccgaccttgcgtgtacagtgaatctttgacggcaacatcgtcatcaacgactacggattcgacggtgatatcgtcaacactggcaaggtctttggccatgtcgaagttcatcacatcgcctgaatagttcttgacgatcatcaaaacgcccgcaccttggtcaacttctttaatagcagcgtaaatttgatctggggtcggggatgtgaagacttggcccgccaccgcagcatcaagcatgccttgaccgacatagccggcatgcagcggttcatgaccggaaccgccgccagagatgacgccgaccttcttatgttgtttgaacgcggcatcatttctgacgaccgccgttgtatcaggaatctgtttcaaatattgcggatagctggcagcgagtccagcaatcatttccgggacaatatcgcccggtgcattgatgattttcttcatatttgcaactcccttctagttatcagtgtaaccctaacaatgctaaaatacagtgattttctagcagatattgatgttcaaattgccttaaaaacggtgatggtgcatgtcatgctaaggtgagtgggtatccagcaaaatcaaatagatagcaatgctttgctgcagaaggacgcataagaaaacccgttttgctgatagcagtcggcaagcgggtgggaaaaacttttaaggggtgcatggttgatcaacttatcttaatcataaagtaagtctaaagtctttgcaatcgcttacacaaaaagacacaacaaatttgactttgttgcatacgcgcctggcagaagacacatctgaaggaatcaggcttcgatcattggcctcgggcagtttagtctttaaaatcagtcactgtttcgatcgtataattgccactatttttgagcaacttcgaaacgggacagcgattttcgatttcgttggtgaaagccttagcagtatcgaaatcaacgcctttgaccatgacctgggcgtgcaccaaaaattgatattcagcgcgggcgccgatgaaagcgaccttcacccgcacggctcctgtatgcggcaaaccgtgctccttttcaaccgcttccagcgtggcttctagacatgtgcttaatgatagccccaaaagttgctctgggttggttccgggatgatcattcatcggactgctggtttgcactttaagtccaccgggaatataagcgtggccctccagcccttcgtcattaatagccgtcgttgtgtatagcgggtggttccagcgttcatcttgcatggtgacgcctcctcatataggtcattgcggtaattcaagttttggtgcgtggatgcgaaacgtcattactgggatcaggtttctgataaggttccgggtcattggcgtgctcaggtggccgttgttcaaagccaatgtctttagtgatgagtggactgccttcccagatgagatgttccaacaacgccattgtggtttgcgcatcgctcaaggcggtgtgggaaggcaagtcaaccccaagcgcctctttgtaatgttgcaacgacggggtgtgctttttgccgatgccgaatgttttacgtgccaaagcagccacatcgaaggcttgcacttgggtgatatcgacattcagtcccgctcgtagcgcacgcaggtcgttacttaaggcaaaacccacaacgagttcatgcttcaacaattgttcaacggcagctttggcaagtggcaacggctgaccatattgggacaacagatcatcggtgatgcctgtgattttgactgaaaatggcatgacgtggtggtcctcaggtaattgggtaaaaatatcgaaggccccatcaacttggtgatggcgtacccggagtaaactgatttctgtcagatcaagttggttgcgatcggcgacgaactcagtatcgatgacaatgtaatcaccacgagccagccgatcaacaacatccttttgcgaccgcagtggggcttgatctgaagctaacatggccatggtggctgcatcaagttgaattgacttagcagcgcgatcattagctgcttggaccaacggcgcttcttcaatggcaaacttggccgcaagtcgcgttgtcaaacggtcggcctgctcttgccgttgacgacgcagatcagctaaagactggtctggattgcctaacgaaatgccgaagagtctggccagccaagtcgcaggagcagttggcatgctggtcaaaacataggcgccgttaagatcggctaaagagaaaacgacctgaccattttcaagccaattttgtaagccaattgcaaggaggtgcacccagtcgctaaaaggttgcatgatcaacggcaatttgttggcggctttcatttgatctaactggtgagccgccccagcgacagctagagcgaggccgcgcgtcagacttttgcgatgattaccaaagtcttgaacagtgaatgcgattgggagtaaggcgccacgcggtcgtaaggtatagcgtaggcgaccgccttcaggataccagcgcgcgaggtcaaactgaacctgcccatgtgtattgacttgattggttgaacttggctgctctggacggtactcgcgatgttggagaatcgccatcatctcatctaagcgaatgcgaactgcggcggcattgtggggttttacgatggggtcacgcaacaatttattcaattgtcggcgagcctgccgcggtgagcgtgtatttctttgccgatcagttgtacgagccatggtgacacctcctttgagtgaaattttgaacacaggaatagtataccaagtggacacgagatttcacatttttgccatgattattcgagactagcaggtaaaaggggcctttacccatgaatgtgggttaaaaacttatttacccaaaacatgaaccgtctatggagaattgaaaagcttattttttcaaagaaagtttgcttacagattaagtttgtggcataactgttgtatggatatcaaacaatcaacagacgaaattgccttcaaacaacgaattttctttgctttgtctgaacctggtcgctatacgattgtccgcatgctttaccacgtcggtcatgagatgggctgcaacgagctgaaccagcacgtggagattgacaaatcaacgatgtcatatcatttgcgaacgcttcgggaaattggcatgattggtactatcccctgtcaagttgacacttataaaaacgaaaacacaatttttctgaaaaattgtgttttcgtttttataagtgtcaacttgacaggggatagtaccgtccaccgtttggggttgtttctatataggtagagggaatttgatcagcacgaccatcagcgctcaatttagccaacgtctcattgccattagccccgcttttatgacccatatcaatatcgaataccagcacgccatcaagccccaagccaatattgtaattaggatgttcgccccaccatttcttggcttgttctgggtctttggtagcgtccttatatccgtgggaaccattaagtggcgttctagttccagacgcaagtggatagactgcaaagccatgctgctgatatccaagcgctactttaagcacgtcgaccatcatcatcaccgcctttcttcataccagcttctagcaaccgacggctgtcgatgatcttatccatcatgcagctaagtaaagcttcgtacgtaccacttgaacgcgtcacttcgaagagcactagtccttcgtctttcttgttaataccgcgacttgataaatcatacagagcctgaattttgtcaaatagtgctaagccaatgttggttgcttctgttagaactgcgttaacttctcccaaatcattaatatccatcataaattgcctccattttccttgacaaaaacatctaatagagacaagctaaaagtcgatgtagatcttttcgcttgtcttcttctcgccttgagttgccgctcttggcgatttttttgtggcctcatttagtgagcgtttctcggctttttgcgcttgccagtaccgatcacaatcagcatcagcctttacaaactgcggccacgtccacccgaacttgctatttatcatttttgccatggtcatagtcctctctaaactgtagaaacgctcccagcacgccaccgttcatgaaaaccatcagcatgacgggtataactgtcggatggataaatatccacgtaataaggctagtcatcggcatcgtcctcgttttcatacagctttaggatctccgatacccgcagcagctcttttgcagccgtgattgccagctcactgttggaaatatacttgccatcaaccgtgacagtactgtcttctgcaatggcatgaacgttaagctgaatgtcgtcaatcaaatttccaagctcgtgatctagtgctatctcttctttactaaacaaattcataatgtttcctttctgactttatgcgcctgccataagttgcttacaatttgccgcctgcccagcagtctaaactttccttgatgccatgaactcgatcaactgcttcttgctaatacgcttagcagtatttacatgcgttaccttgatttcgccacgcttgatgagcttgtcgagtgtgccacggctgacagacaaaagcttgcatgcctcaccaagattcaagaattcaggaatctgtggctggatggtctgctgctgtggcatcatctctgccacggtttgacgtacgagcgaccgaagcttgttctcaaactctggtgtagtgctaatctgtagttgcattggtttagtctcctttctttatatttcttagtgaataatgtaaaaaaatatgctaacaagggagcacttttcttagtatttcttagcaaaattaagttataacacttggtgcgagcacatgcaaactttttctttaaatttcttagcaaaatgttaaaatattacgtagaggtgattacatgtctagtagagcgccctttttaaaggatgtaggtcaaaatataagaaagatcagacttaatttaggcttaagcatgtcagaatttgcgaagttggtagatcccactagtaaaactattggaagcgggacggttagcaactgggagcacggaaagaatgccccgaattcaaaacggctaaaaagaatttcagaattgggaaatacttcagttgaagaaattttagggatagatgagtttcatcgcgtaatcttacaggcttcaaacagcttacaaaatcagatgtctaaaacagtcgttgaaaagtttggcaagctcgatatggatgccctgcaccctatacaattgagctttcttctggctgctattgaatcctcgcaatatttttctgtagatgaattaagagacttagcgagtcctctggcttctatgtcgcaaaattttccgcccgttttcgatagcaaagatgaacttatgacagaaaaatccaatgacaaaaaatcgtttgaaaacttcgttgataaatacttttcggaagctaaaatcaagaacaactagtttttaatatcatggccgaattttaggccgccaccttttccccaatttcggggaaaactctccaatctaacaccgcctgcccagcgtgacggataggagaaagcaaatggcaattaagaaagtaaagcttaagtctggtgcagttcgctaccgcgtaacggtcaatgctgggcttgttgctggaaaacgcaagaatattgttcgcaatgttcaaagcatgcaaaaagcacgtctactagagtcaaaactcaagctagacgtggccaatggtttatatgatgaagaagacactaccccaccggttcagacctttagtgatttgtacaatcagtggtggccgatctatgttcaaactgtggaaggaagtacagcctataagactaagcagcttttcaataaccacttgatccctatgtttggttctaaaactctcaccgcgataaaaaccggcagcattcaaagtgctgtcagtcagtggcgagaaacaaccaccaaggcatacaaggaacgtttcatttattttaaaaagatactctcatttgctgttaagatgcagtacatcgaaaagaaccccgcagacggtgtcgaattgccacgcggggtaggatctggaaagtcaccagtttactgggataacaagcaagtcgcccgattcctaacttgcattgatcctaataacgatccagaaaagtacacaatgtttctgctgatggttagcaccggtatcaggcgtgaagaactatgcgctttgaacgtatcagatgttaatttcaaaacgtccacactgtcaatcaataaagcatatgcaactggtctgaatggtaaggaatcaattaaaggcaccaagtcaaccgcgggtatgcgcacaataccattaaccccgaaagtgacaatacaacttaaaaagtggatagcattacttgatgcaagcaagattatcagcattagagatgatcggccactgttcccatctccacaacactttgaaaaacgtttaggcattaacaggcctaacaagtggctgaaagatattattgaagcaaaccaccttacacctcgcatcacattgcacggtctgcgtaagtcttttgtaacgaatatgattcgcagtggtgttgatgtttcaactgtgcagcggcttgcgggtcactctacgcccgatgtgacccttcgcatatatgctggcatgaatcagtcggatgctcgagaaggcatcgacaagttagcagaatatatggaacaggtaacattttaggtaacatttggagtaaggccaccgcacaaatgctgttatatcagcggttaaggctaatggagttggagactcctcacctccattatgacatttttccttacttctagttagtcctaaaatgctggtaaatcagcgttttggggctttttattttgggttgtttggaaaatgtgtccttgtcgtcacctagcagacaaaagcttaccttccgtaagtaaatatttgctacaatagtgccgtgagtctgaaaatgacaagtaggaggaaaatcatgaacgacaaagtaaaagcacttctcagcattttagaatctgctgggttttcgcacgacgatctagcaggtactgttgccgaactgaatgacgccgttaacgatggcaaatcaacgtccattcaattggtcagtcccggcgcagctgcgcgttacattaaacggattaatgacgaaactgtttttactgcgcgctttcgtcatagcgatgaaccagatttattgaacaatgaatcgaacgatgaacggattgagaatcctaatcaagattcatgcattgttgttagttacgatcctgccaaacaatagaaaggtgttaatctcttgagcaaaattttttctcgatctgttggtgttgtgacacttgtcgctggtgctgttggcgtcgttgccggtaccatgagcttggttactggtattttgctagtaagcaagcatcgtgactaaaaagggacaaacaagtccgatagatgagctgcaagtcaagaactgatacttgcaactcgtttatcgggctttttttactcatattcctgatctgaacagccattgtcaaaccaaagctgttcggcagcacatttaatggccaactgtttgtttgtcggcatcggtctgctggctttcaatgtgatccaaatttgccacactatcaaaggtcaacagtgccgattgatagtcaccgattaactgagcctgtgcgcgattggcaccattgaattggactggtaagcgcacaccaacgcgctggaggacatccccggaaattgggcctgtgtgctgattgacccaatacggtgtgtcagattttgccaatggcaccttcatatactgcacggtgcgactgtctgcatcagccaagactcggaaaaagccaagaacaaggtgcttgcgatcatgagcgctgagcaaccacgccacctgattctgcccattggactgtcgcggtaacaataggctaaagtcacctttcagtactagcggttgtaaggcgtggtaataggcaatttgagccttgatcgtagccaatgttcgcgcatcaagtttggtcagatccagttcataaccaagaatcccaaaggccgccacccgaaaccgcgtgaccagcggcgttgatcgaccaacctgttcattcggcacggctgtcacatgattgctcatgcagctcagtggataggccaaagccgtgcctgattgaatggcgaggcgttcgatcgcatcggaatcatcactagtccaaatttgtgggctgtagaacagaatgcccagatcaaagcggccaccaccgccggcacacccttcaatcaataaatgcgggaatgccgttagcagcttctgatagagcgtgtacacgccttgtacgtaacgatggaagaattcgccttgcggatgaccgatcttttcgagatacggtgaaaaggcctctgtaatgctgcgattaagatcccacttcacataatccaagttggtttcagtgatgaccttttgcatctgttcaaaaatattgttgacgacagctgggttgctgaagtctaacacatattgattacgcgtgatcgagatacgacccttttttggtcgaacgacccaattcggatgggcttggaagaattgagatcgcggtgaaaccatctcgggttcaaaccaaaggccaaactgcaggcccatcgcatgaatttcctgagcaaaatggccgagaccgtcgggaaatttatgcttattagtaaaccaatcacccaaggaactcaaatcattgtcgcgcgtcccaaaccaaccatcatccagcacaaagcagtccacaccgacctgcttgccgagtgccgctagcttgagcaacttcttctcattcaaatcaaagtaagtcgcttcccagctgtttaagacgactgggcgctgcttttgacgccattgcggatcaataatatggcgagcaacaaagcgttgattggcctgagctaagccggcaagaccaccagagctataactaaacacggtttctggcgtggtaaaactggtttttggatccaaccgccaactaaacgatgcgggatgaatgccagttagcaatcgagtctgatcccattcgttgacctcggtgctatccagaaagttgcccgaataaatcaagtttgccccataggtatcgcctgctgcaaacggctgtcccgctgcatgtaaggccacaaaaggattctgttcatgactggaggcaccacggagcgattcaactgaaaatgttccctgagttaacggttgcgtttgaatatgacgctccttcgcccaattaccagataaatgaacaacgtcataccgtccttgcggcaagttcaaaacgccactcagcatgcgttgaatcatcactggtgctgtcccttgattggttagtgtggcggaacgaacaattgccgcactgtcagcaaaaatcgtatattgcaacgttaacaataattgggccgttttatcttcaagatgaatcgtcagcacatcggtcaatgccggattgccgaaactcgtcggatggtgcaagtcccgcgttttcgtatgtgtcaattgatcatctttaaaaacaaagttcggataaattggcatatcatcttgagtcacactcaggctgccttggcgaaaatcaccagttccgtaaacgggatactcctgttgtgcatcacccaaggcaaattcctgatcgtccgaaaaattggccatccacgcaaacggacttgggccttgagacaaataggctaagtcgttcttagttaatgacaagcgcggaccaaaataaagatgcccgagctgaccattcggcagcaaagcgcaaatataactgatttgatcgttgtgaagatgaaaagcttgattatttataacatctatcaaagcgtagcctccttcaaatataacctcttacttccgttatagcataacaagcaagttggtgaaggacctgtgcgccactatcaatcgatcactatgaaggttacggttggcattcaccgcagcataccaagtggcactgagacatttactgtcactttggcctcggttatttagtcgatccgttcgtgctcaaaaaaatcggcacttggcggactgattgtccaacaagtgccgagcacattttctttttaaatgaaataaaaatattttttgctagttactgcgggtcccaaccagctatatcctggtcgctgaatgcataagtcagtggcttgccataagcagcttcataagcctgccgcttttgagcatagtcgcgttgcatcatttgaaaactgttgtctctgacggataagttgtgatccgggtagatcggatcaagtacatgcaggacataactgacctcgcgtaattgatcattttcacgcgccttcaaatcacgaatctcagtgaaacacgagataatgggcaccccggcctcagccgcataaaaatatgacccgcgcttgggcggacgcggcttgcgataattgaaccacatttcttgctctgggtaaattaacacccaatgatgtccagaaaaggccttcgttagcatttgcataaatggtccgttaagaaaacttggacgaccggatagcggaatcgtatcgtcataattcatgacaaatcccagcaaccccttcatggccaagttggtgtcttgactcacgatatacatccggtggcggccagctaaacggacagctttgcgaatcgccatattttcaaacggactaaagtggttgctcgtgatgacaccaccgcttttaatcgcccgaatcttttcaaccccaacaacttcaacatcgctggtgaccctcactgcataggcattcaccagcaatcggcaaatcaaagttttcactcggaatgtccagcgttgccgctgatgtaaataatgatcaataatagctgtttcttgtgcttccgagaaagtcgggtcgtgttcttccaccttaacgttgaatgccttagccgccaccgcgcgacgaatattttcgatcaccgcggctcggtctggtccaacaaacttgccggatttcatagcgccacctgttcaccatgcttgattgcgttcaagatcgtgttatcagtatggcaaactcgaacggcggtttttagcatcgccgccatgctgtcccgatccgattgttgatcagctgacgtaaatgccgccaactgctgcttcaaatccgtttcaaaaccagatgctggcgcataatgccaaaagtttgccgctaacttagcatcgcggtaatgccatggcttgccaaaaagattgtagtgaattaacttgccgcctgattcagcagcagtcgggacacctgtttgcatattccaagtttttggcaggtacttgattcgatgctgtgcgatcacattgatgtaatcttgatccgcagcaatcattgtaaaatgatacgtttttagcaaatgcagaaaccggtcggagaaatgttcctgccgcatctgggcgagattcaaaatcaataccccggaattgatgtattcacctggttgaacaccaaaatcacgctgaatgtattcaatggtttccgggtatgtcatcatcaccggatctgcaacaccagcgactaaattatcgcctaggtcagtcgtaaacaattctgccaaatcaccatcggcaaccgtatcggcatcaatataaattgctttatcatattgcgggaacatgtcagtaatgaatagccgaaaataaatcgtcaacgtcacataatcgccgcgcagtttatttgtgtcgccactaatctgctgcgtgacagcgtccatgtcgataaagttaatcgtaaaatgcggcgctgctaaagccgcaagccgcgtctgattcttttgaagtaaaccactgttaagaatgttgataacgaaatcagtttgcggatctttattcgttcgaatagatgtcaaagcaacagccagacacggtacgtaaccgtcatcgacagaaaagaaaatgggaaccgtagtttgttgaggcatttaagacacttctttcaattttggggccaactgacgataatcgtttaatagatcatcatattcatgaaggccaagttgttgatgaacagcactgatttgccatggcttgaccgtcacaatacgaaaccgcggccagaaacggaatgaggtggtgaaatgttggaagacagtatccgtttcgactttatgttgttcattatacttccgcggcaaaatctgctttgactttgcaatgatgttcagtgcactttggtctggcataaacagccaacgatggcggatcaggcgccgacagcgaaccagcaagccatcttgccgaatgctagcaagattcatcagcaaaaccccggaattaatgtaatcaaaccaggttaatttatgatggaaccaccatttgccataatgatccaatacaccagcaatatcgacgtctttcattggttcttgatacaggttgctaaacgatcgacggcacacaatatcagtatcaagatacaacactcgatctggcaactcaggaatcaaatcagcatacaaacgcaacatgcaataaggggtaaacatcgtggtcatgtttgcttgcggcggattagccataaataaatcagtgatgtcaatccgcgtcaagcggtgctgcggattctcctgccgcatcaagtcagccatgcgctcagccgtcaccgcagagaatggctggtaagcatggccattgacgtttagcttggcggttaacacataaatatgcaatggttgatcggtatgccgcatcaatgacaaggtagcaatcaaaacgccatccgtcatcttctcatcaccgcaaaacatgatgttcatcgtcatgagtccgcctcctctcgctgctgatagtgaatatacgttgccgtactcaaggcggcgcgagtagtcatcgccgttcgaacttgcgcctctaactgctgctgacgcgctttgagcggtaactgttcatctggccaaaaagggccgtcgacatacaagatccggcgtggcttttgccgccaccgccgggcttgataagtcattgtggttgcaaatactggtgcgttagttgtcatcggataatgaaaagcaccattttcaaacggccgaatgccagtatagtaaggccagacatgggcttcaggataaatcatgaccacatgtcgttgtttgataacgcgccgaatggcttgagcaaacgggcgcaattgatgtaacttgcttggcaccagcaaaccgccaccataaggcacgattcgtcctagaattggcacgcttagattagccggtgatgccaacgtaaaaacccggcgcgactgattcacgcgcatgggtgtgaaaacatccccaaaaggctgagtgtgattaccataaacaaaataaccgcgcccggcagcctggcgaaaggccttgcgattgcgaacatgtaagacgctgcggcaatacccttgggcaaaaagccaagaacccgcataaaccaaatttgctttgatccggaaccgccatgaaggttccccgcgataattatccgggatctcggtttcttgatcaggtgcagcaacaacatcgtctgtcaagtggcgatatgtcacgacttttgccattgtcggcccctctctctataaaccgccatcatgatgacggatgcgtgttgatctacgaaccatcaatagcataacgcgttgctaaagttagtcaaccctaaaataaataattttgagtgaacactcaaaattattttcacttttatatgagtcctcaagtatcttttccgttattgaagcgagtgctcactcaatcagattaaataccgtcttttgttttgtcttcgtgagctttatgatcagcgtgcaatcggcgcaaggtgaataacgtcgcaatccagataaccgcaaagatcaatgcggacagcattgcccgatcgaaaatcataatcacagcagtcagccctaaaaacgccaaaataagataattcgaataaggataaaatggcattggaaaatccgttccgcgcggatgttgtttcttatagcgcaagtgagcgaggacaatcatgccccaaacaaataaaaagctgattgtagcaacacttgaaaccagtgcgaaaacagactccggtaaaaaaaggttcaaaatgacagccacagcaatggctcctgttgaaatcataatggcccgcgctggcacttgtcgccgagacagtttagcagtccaacgtgcggacttgcttttaccagttaatgtcagtgagaagagtaatctgccagtgctgaaaatagatgaattgcaggcagatgctgccgctgtcaacaccacaaaattaataatgtcggcggcggctggaatcccgacattacgaaaaacctcgacaaaaggactattaacgggtgacacatcgcgccatgggtagatgcacataatgacaaacaatgcgccaatgtaaaacagtaaaatccgcatcggaatctcattgatcgcttctggaatcactttatgcggatctttggtttcactagcagtcaacccgaccatttcgatcccgacgaaactaaacaccaccatttgcagcgacattagaaaaccgctcattccttttggaaaaaagccaccgtcattaacgaggttgcttatgctggcatagccaacaggcgttttatagtgcacaaacagcataaagacgccgagcgcaattaacccaataatggccacgatcttaatcaaggcaaaccagaactccgcctcaccaaacagcccaacgctaaccagattcattagcagcaacactgccagtgcaatcaggcccggcagccattgaggaactcctggcaaccagaatcgaatgtagagaccgatcgctgtcacttcggccatggcgaccgccacccaacaaatccagtaggtccagccagtcacccaaccagcatcttttcccatatattggctaataaaatcaataaacgtatgtgaattcacatcggacatcagcagttcacccaatgcccgcataattagaaaacaaatcccacctgtgatgagataagctagtaagatggaaggcccagcggtgtggatggattgaccagatcctagaaaaaggcctgtcccaatcgttccaccaatcgcaatcagttgcacgtgtcggcttttcaagtgacgcgctagttcgggcttgtcatctttcttggcttgcatgctcatcctcctataaacgtgttaacccgaaaaaaatcaggacataacaggttctgtctttgcaaatgcagaaatatcccagctctttgaatcgtatcagaaaaaattatacaccattttcagaaaacgcccaactgatcaccctgtcacgatttgaatctgttctggtggcattttatcgaccaaaaagctttgtagatctgttggcgactggcgaaactgcagttttaaaaccgtcacttgaccggcttgcgccaatagcagcgtccccccagcatttgcctgtaaaacaacgccagaaagattctgatacaatcgaatgctaccaagcccgccaatcatcgcagcatcagcaagacccttctgccagcaggcaaaacagataaacataacgacaataaagaccccgctgacaagatcgtcaaaatgttgactttgctgcaaggtcaacaccagagaaaaggctgccaccgcaagatacaaaagaatacgccagacttttggttgcgcacgtatccgaacttgaatgatatcaaagatggtcacgccgactgaaataattgcaatcagcaggtaggccacgcttaataatgacatattaattctccttaagtttgataacccattctaaccgattccagtttaaaaaggcagtggtgaccggatcagcaaagtctattctaacgtcctaaatcctgtgacagcagccataccaccttgctatcacaagatgaaaagtgttttgaaatgacaaaaaaagctgacaagacaagcatttgtcagctctcctttttggttacttaaaaatcaatcaatcacgcaatattagcagctgcccaatccttcactttgtcaataaacgcggcaaaagcatcgcggtcatttagatctggaaattggcctaacaagatctgcttagcacgcttgacatccggactcggtttctgtaaaaccagcaggcttttctccgccttttggtcagcaaagaaatcttccggcaaattcaataacccttggaagtaggtcgacttcgccagccaagctgtcagccccgccgcttcttcagaacggaaaacctgactcggcacataaaataaacccagtcctcctggcttcaagacccgcatactttgctcgattaacaaatgatgcgcataagaatgtcccttggccgccgcggtctcaaattgcttggcgcgttcgtcaaccgggtagtaaccaactggcaaatcagaaacaacaacatcgatgtctttaaacaaaagattatctaaggcatcctgatgaaaaagatcaacatctaactgttgcaacgtactgctcatgccggcaactgccaataaggtttcgtcattatcaatgccgtagcctttgactgccacctgacgcgcattgtggagctgattcatcacagcaaataaaaggttccccgtcccgatggccagatcggcgacttgcatcttttttggcagatgttgcgcaaaaaccgtcaccataaatgtcgcaagactggccatggcatcaggcgtgacttgcttattgggttcaatgccatctaccttgattgccttaacaagcactaattgaatggcttgacgaatctcttccggctcataggtggcgagtttgatctgatcaaacaacgctgttagcttctttttagcttcatcgttgggaacaccgtcttcttgcatgacgttgcccgacgcaagatcctctcccgcctcaataaaagcagcaataaaagatgttttcaattgttgatgcaaaattgtcgtgctttcatccaaaacattgtacagcttctctagatgttcgtgggccaagatgcttccccctatcaatacggtttcaggcctaaaaaacgatgcgtgcaggtgctggtcatcgccgacactccgcttaccagtgtaccgattgagaaaagcttattcaagcgcgtgaatccctgattgagttgattcaagctgtcctttagttgcctttgtgctctcactagccgctggcggcgcagatcgagcgccggaggtatcagatttctgactagttgaagccgactgattaggctcactgatcgatttatcagacacttgtgttcgccagtggttgtatgcttccgtaaactggcgcttctcgacttgttcaagcactcgatagctctcctgccagtcacgaaaacgctgcatcgcacccaccgtcagcatcaacagtaaggaaaacagaataagtgtgttgaccaaaacactaccgcgcaacttcatcgatttgcaccccaccatcaattttctgcgaagtcgttaaatgcagacggtagctaaagccttgggccgtctgataaaaattgaccccagttagatgcagaaaaataggcatatgtcctcttttaacccccgtcgcacgaaccattcctcgaaaatgctcgctccgaaaaaagtcgatcgaataagacttgtctgcaccttgcaagctgactttggttaaagccacagaacgcaactttttatcctgcacaaaagcttgcaagtcgcgttcagcttgcaatgacgtaatcagcacatgatcttgacgcgtgcaccgcatgacatgtaataaaatcggcctccacaacaacatgaccgccgcaagtaagatcagactgatcaccacttcaattaaagtaaagcctttaaggcgtgaacgtgtatgtcgatcgacctttttttgcatgcgcctttacctcctgtgcattgacagttacctgccatacatctggtccgacttgaaccgttgtctctccacctggtgctgacaaatgaaccagcgccacccgggcagcgtaataggctgtcgctcgttgtctggattcgaccacaacgcgatcatatgcccgcagcaacaccattaaccaaccaatcgccagcaagagcacccctaaagctgcaaggtgttcgactaataaagaacctcttagagttttggcactttttggaataaaaatcgcccccattcaaactgcagggtcacatgccaataatagccgtcttgactgagaaaattcacgctgcggctacctttcaattttcccgatggcgctctctcagtttcggcaggaactccatcttcatactttaaagatgctggaaatggcagaacacgtttcgacctgtttataaaactaaatgtcacctgacgttccttaccattaaccgacatcgtgccggttttctgagtggcgtatgctttcatccccattgattcccattgttcccgcatagtttcgataaacttggtctcctgatgacggcgaatcacactttgcccaataggaacggctgccagtgttaaacccgctagcacaaccaagaccgccaccacttcaagcatcacaaagccacgcagccgtttcatggaactttaaatttcggcggattgtcaccgctcatcgttgccttgcctttttccaagtccttcgcctgcgcatcggtaatcacgccttctctgactaaatcaggaattgttttaagtgatttcttgtcagcatccggctcgttataggccatttcaatttgtgaattcacagttgccaccgtagcttttagattctgactttcaacacgtttcatttgcccttgaattgtcaaaaccaaagctaacgtcaataaaataatgaccccaagtgctgcaatcacttcaatcaatgtaaaagcccgtaatcgtttgcgtcgcatggtcatcccccgaaagattgatagagtggtaagagaatttgcaaataaatcagtaaaatttcgccaccaataagcaaaaacagcaatggctgcaccaagttcaccagtcgttctaaacgttgctgcaactgtaaaaatagttgttcaccaaaaagttccccagtttacaattcaagtgcaacaccctgacgactagaccataaaggccatggctcctatgctgtaattacggacaaaaatagtttgtgcgataattgacagatgaggaatattttatgaccaatacagctattcgctacacccccgaatttaagcaaaccttgattgatcttcatgaaaaaggacactcattcaaagaactacatgaagaatacggtccttccttagacactattcgcaaatgggttcaggcggccactgtcattgccattgatcatcaaggtactgctgtgaccaacgaacagttcaagcaacttcaaaaagaaaatcgccgtttgagggaagaactcgatattttaaaacgagcggcggtgttgctggcaaagcgttgattcatagcggccgaaaggccgctctttttatgattcaagatcaattgagccgggggcaccgcatcacagttattctccgagcgttacggatcccttcgagtacctactatgactggttaaagtggcatcctaagtcacgaaatcgccgccgaattaagcttaaagagctggttcaggttctttggcaacgtcgaaaattttacggatacgtgcggattgctaaacgcattcgtaaattacttaaatgccgcttaagtgaccgcacgatttggaaagtcatgcgtgaattggggattcaatcgacaatgtatcgtaaacgctctaaaaagcctaccacaaccactgacatgccacaaaaacctaatttaatgcgacacctagctgacttgtctgaggtcgtgaccaccgatatcacctatattcaactgatcaaccaaaaatgggtttaccttgcaacagcgtatgatccaaaagcgagaaaagtcttagcttggcaagtgggtcaacagatgacacaagacctcgcggtcgcaccgattcaagcgttaattcaccaaggttatacttttaagatggtgcatagcgatatgggtagtcaatataccagtcgtttatttgagacaacattgacagatgcgcacctgcgtcactcatattcgcgcaaaggcaaaccggctgataacgggcggatcgaagcctaccattcgctattgaaacgagaatgggtccggctggagcagatcaactatgaatcaattctagacgtcactgaatccattgctcgttacaacaccttctacaatcatgatcgcgagaccaacggtcgcggtgcttgcaaaagaaagtcagcagctgcataagtaacctttcaataggcgcacagccctggggaaagcaccagatgccagggcttgtttgtagtccctcttgcacgttaaacaagattaaacgctgataaaagatctgataatgcgtgaatttaagtgacaaccatacgcatatattagcttaactgcctgaattatagaatttttaagcagccactaattataaatgagccaatcatttgcaaaaaccgtacctaatttggtgcggtttttgcgtatgaaaggcgcaaacgcgatgttactgcaggttgataaaacaagtgttactagagtgaaggttgaaccaagtttgaagaccgcgcgctttacttgatactcacgctaacgtgcggtagaatgccttgacgtacgaaatctgctataatgtagtaagtggtaatgtgatattcacagaagccagggttccgtgactaaagtgaggtgcagcaatcatggaaatggaacggattaacgcaaatacgatccgggtcatgttaggcaacgatgatctagcgcagcgtgggatcacggttttggatctgttaggcaatcataaacagattgagagcttcttctatagtatcctcgatgaggtcgataaagatcatacgtttgctacaaatgaggccgtgacgtttcaggtcatgccgagtcagtccggactcgaattgctgatcagtaaaagtggtcaaaaaaacgatgatagcgcagccgatcagactgatgacgaaggtacggatacccaggtgcctgattatattcgtcagcaactgcaaggacttgatgccagtgatcaacaagatcatcaggcagttgatgaaggcggctatattgatgccgacaaagcaccacagactgagcttgttttgaaattgaaggactttgaagattttatcagtttagcagatacattgcggctcgaaggcggaaagagtgatctttatcgttataagaacgcttattatctggtactgaccttttatccaaatgagatttcgtctgacgaggcgcacgatcaaatggccgtcgcgatggaatttggcgatcggtcaccgttgtcatcagcggtgctgtctgagtatggcaaacgcttgatggaaaccagcgcattagaaacagctaggtattacttcaagtaaatgactaaaaagaccatcaacgaataaaagttgatggtcttttttgatgcgacgaattgtcaactcaagtgcaactttttacccatgaagacttctgatggccgatctcttttgcatatttggcttgtgtcatgttcagatcgtatatattcttcctgaggttttcggccaatgctcgtttgctgtccaaattattcatctcctaatgttttacccaaatacggccatcaatatcccattcaatattactgactggatacattttgtggttgtgactgctatacgctctgaacttaatctctcgtttcatttctccgcctcctataagatgcctccgtctaccagaagcattgtaggtaccttagcgtccaagtcttctttaacctcctcgtaggtgagattatctccgtcttccgtttttgcagagagaatacgatacagtgcttcttcacggcttaactcagtaaacttttcgggatcatcattatccccatacatttgacggaataaatcaagggcttccttagtgttgttagcaacaatcaaactatggaaaggttcttctgtttcgtagtatttcatttttcttcctccaatttcacagacacatcgctgatttcaagaacatatcaggtaccgcttcttttagctctttatctgtacagtagtgccattttccttggctaatttgtctatcaatatccctattgttagattctttttctaattcaacatagaaaccaaggtctctaagaaaaacgtattgtgcaaacccgccaacataattactcgcaggtaacctaaccaaaattgacagatcatcatcgactctgaatggcttttttaattccggctgtttcatagctttaccacctctcctgtttcctcaacgcgccagacacctagcacccatgcagtagccatcagatcctgcttgcggagatagccagccctatcaaagccgttggcaatatccccatctttaaatgccatccaccatctaacgctttcaggccgcatctccatacatagcgtatctgccaaggtggtattattgtgcttgcactctttgatccattcgcctaccgctttcggaatcaccggcagatcatctggcagagcggcgtcatattcagccatgaataaatttgcatcttggtgtccgatattgccaccgcttgcctgtgcatcagccagtgcgtcaacagcatctgccaacacgtcccgcttagtctcattgctcatcgtcagtcaccgctttagtttcatattttttcagtttcaaacgtttaatttcttcttgtgtaaacctgtattcttcaccatttaatagttgactagaaacgttccaaaatacatggtttgggtgatcccatctagcctgcaaaacgaacttgccatgagtattaccaccaacgttttcatatactaggtattttgtatcaactgctggaagcgtgatggtatatccgttagtgattgcttttaaaattctttttacaaatttgctatttttgtggttaaaaataaaagtggcaaaagcaatcgcttgttgatatgacttagcattaataagcgcatcaatattcttggcttcttctgggctgacgactacctttttaggttcctcaacgaatgccatcgtcagtcacctcactgttcgctgtactccctgcaattcattcaatgtctgcttctgttacaccaacgccaaagcattgatatgttcgaaagtcatctttatctttgatcactggctgcttgaaataggctatcttttcatcactagagacatacgctaatgccgctgggtttagcagatacccgttgtctagcttaatcatcatcgtcagtcacctcttctttctcgcagtcttgcaaaccgtaatgttcgatctctgattcggagaattgagcagaaaccccagtcttaggggctctgcgttccccaacggaccaagtaatcgtatcaggaaaaaatgctggtcggtatgcttgagcaaaaagctcatgcttctgcttgccgccaagcgtcttgtatactagatacttcttctcatttgccacggtgtagccgttgacgtaagcattcatcagcaggctttcctcgccgtcataattaccagtacttccagaaatataggttactggccacgtagcatcatgtgcacgttcaacgatttttgcttgtttcttggttaggactaccttttcaggttcctcaacgaatgtgacaacgtggccgccgtgctcattagccacttgttcagcctggtccttgctaggcgttataggacaatttgagatttttaatgcccagaaaccggaattatcaaaaaattcccagtattccccttcatcgttcttaaccgcgtacagtttttcttcgctcatttttcgtcctcctgtttgattggcactagcttgtagtccacatcttcgtacatgacgcctacgaccttgccagtttttttgctgatttctctggccattgttttacctcatttctttctgtggtataatgaggtcactcaatgtgaaacctcatttttggccgttaagtgttctagcgcttagcggtttttgttttgccaattatttcgttgattaaactttgaatcgagcatatggtttgctcccttttgtgcgataatcacgaagaggtgattagaatgactaagtttaagaaaatacgagattcgatcatcaataattggatcccaatagctagtttcattgtgtccgtcttcgttgctggcttcacaattgctaacatctggctcaatactgcccaaattcataaaattaatcaggaaaaaatggacagtgcccgtcaagcacaagccagtaatgtggcggcttggattactaaatcggttagtggagactcagcagaagtagaactttctaaccaaaatcaaacccccgttttcaacgtttttgtgcttgtcacgctcaacaacggctttaactcagatataaatcaagacctcaagttcatcgctgataacagtctttacagccattacgatgtgctaccgccaaatagatacataagcactgtgaaggcgccgacacccgcaatgggtggtaaaaggccgatagcgtttatctttttcaccgatgccaacaatcgccgttggattcgtgagccgtctgggaagctaagagagactgattacaataagattctggctaagtatcaaatcgttgcgcccttctccaactaccaactaacaccgcaatgagaatggcagcatatatgaacgataggactgtcaggaaaatgcccataaatgtcaagatgagatctcccaaaaataagatgctaaaattgacaattaacgaaattcccacggcaatccaggcaacaatgtttatgacaacaagaaacagcaatgtgatcaagaaccacgcatcgtgcctaaattcatcctgctcatctttcattcaatccactgcctccaatttccgctgtggcctaagcagtgaccaacgatcacgccgaagccatcagcaattagtaaatagccaatcattatttgtccttctctctaagtgaccttgaaatctctgggaaccatttgtctaagaagtcgagccatggtttcggatgaaacagatacccctttttgccaggcggtggatatgaaaccacggtatcttgcaagaacttgtggaagcgtgggacgttcaagatattgttaactacccacgtgttgttatgtccttcgacatagcttgttgcggttgtgagcgtccacatgcctcgtgctgctagcttgcgtttgagttcttggttctccttgatcatctttgccagttcttcttcatcgaccgctaaatactttttgcttgaaatctgatcatcttcaacaacctgcaacaacggcatggcatttcctcctttcctgtgatcgcatcctgacggataatgaaacccgaaaggaggtgaatcttcatggtgcaagtcccttattatgacaatccgggcggagctctagctgttacagtcgaacttccgcacgctgcgaacgtttacttggtggatcaagcaaacttcaacgctcaccaacgtggtgaccactttacatatttcggaggtcactatgatgagtccccagttacaattcgggtttctggagctggccgttggtatctgattgccgaaaatgggtcaggcgaacaataccgttacacctggtctaaatagttgcgttgttctgatactgagacttcacacgtgctacaactgattcaaagttggcaaatgtgaagcctttttgttcgagaagatcaaggatcattccggtcacttgatcttcaacatctttgctctgtactttaacgacatcggttaacttttcctttgtgtgttcgtccatttagatagcctcctgttgttggtcctcaaataatgaaatctcacgtgctttcatgagagttgctgttgatggtgtccaattctggataaagtcatcagccttatcgaagtctttcttacgtaactgtgtacgcgtcttcaccccgatgtagtcattcaatccgtggttaatatcgcggtaaaagagactgcgctgttttgcgttaaacttgcagtgatgcacgtccagataatttgcaacagctcgattgacctgtttgctgatgtagttatattcacctggtgccaacaaaacgttctcttccagatcggtgacacggccatcaagcttttctatctgtttaacagttcgagtagcaacttccatggttaaagcaagcttttcttctggtgtctgtggaagccggactttcggattaaagtagttttcttccagactatcgaacatatcccaagcttgatctgtgccaagcatttttgagtgacgtgcggcaccacggcgagtccagagatacagctggctggcatttttaccaacgaggttagaatttataacctcgttcttaaaagacttaagttctgcaccttcaaggtgatacatatgaactctctcaataaacttgtctttgttttgaaaaaaattctgtttgatgacgttaggtgttgttccatacagttctgcaagttgttcggtggtcagtacacgctggccgttttgttcaattggttgtggttcattcaatgtgcttccttctttcttttggcctccccttggcagataattgctttagggagatgcataattaatatggaaaatccttcatggaaaaaagttttgaagataattctgaaaatgcctgaaataaacggatacgatcacgaacgtgatttaagctcgatctatggttgcgattatcatcatcaggtttccgttcttcgctcaatgaacttagtaagtaaggaaacgaagttgaatggcttctgggaaatagatcttactgatttaggatttacctatttcgatcgttcgtgggacaaaacacttgaatttgttcgtagaagcatattggtaccaatagcagtatcgattacaactacccttttggcatggctgctgaaatggattattttccaaaaatagaaaacaaccagatcattgcgcaactagtaaatagcgatgtgaagatgcttaccacaatcgggatcgtataggtgtgatcaagctcatcaatgtgcttttgaatgtccttttcgttcataccgtcatccccttttgctgtgattgcttatatttgacgtattcaatagctcgcttccaacgatctttgtcgatttgattagcagttaatccctggccgtcagtcatcttcttaactagaattgccattacctgatcactgataccgagaaatttcgcgatttcgagctgcgacaaattcaaatgtaataagtagcctttccagtcattacgattagcagtccaattgagctgcacgtttaccatgtactcacctcctgtgtttaattaattaatcaagcagttgaaattaggtatcgaatgcggtactatttgtgcatagcaaatagccgaatatagttactcttaccggtcatctcgtcaaagtgtcaatcggtaagggcttgttcgtatattgctcaattacttgatgaacttataataatcgaattcggtacttttgtaaagctacttttaccaaattcggtatttataacgttctctcgaaagagggatgcttagaaaatgctgtttgaccgcataaaagaaacaggaaaaaaacttaacttgaacgtaaaagagattgccataaaggcaggaattggagaaaacgcaatctaccgttggaaaacctctcaaccttctgctgataagctacaggccgtagcagacgttcttcacgtttccgtagactatttattgggtaatacggataacccttcgcctaagtcatctgttaaaccacccgaccttgccgacgacaatctttttatgtatcaaggtaagcctattccagaagaggatatggaaactctccgttacattcttgacagttatcgtaagaaaaatggtaagaaccatgaatgaaatgcttgctaatgttctcaactatgcatatgaccacaacatcagctatagcatggtaccctttgacaactccgaaacaccaccaacttgcaacactgaattgaggttgattgttctaaactcaaactggtatcagccaaacgagatggccttccaagcagcacacgaatgctcgcatgttctaaacggggatcgtgggaaattcaaatattcaaacttttattccaaaagtagaactgagggcaatgctaataagcgagcactttcaattgtcattccgatgtactttaaagatatagaggctgatgaagcgaatctatttcagtttatgaatgatctagcaataccaagttggcttgaagacgatgcgtcatcttcaattaattcatactatcaacgcaatcttttaatttagccaaggactatgctacgtccaaaccctgatgacgttaaaagctggatttttttggagggattcattatgaagaaatctttgttggctgggctatctgtactgtctgtttttttgctttcgtcttgcggaaatagctctaattcctccgctaacgccaatagcaaaacgcaaaaatcagaggcttcaaagacgtcaaaaactactgctaagcgagtacgtggaagattaactaaggttggaacttattcagtcagaaatggtgtaaaagctactctggttaaaatatttcacccaagtcaaaaacttacttttaaagaagatcataagagcatagatgtcggttttgacgatataaaaataattgaaaatgatattcaagattcgtcaattaaaaaggatctagaggatgtctataaaacaagcatttctggcaacaaattttataccgttcaaattgacttcaatttaaccaacaaaactggtaatgatgcatacttggagggtctcagcaccctaactataggaaacagaagccttagtgacggtcaattttacgatcccactccgggtgtaacagtatcgaataacgctacttattcaaacagcattgtcgctgtcgttgacaaaaatgaaacaaacttttctaggcttggaattgctttcgaaaatattgacgagccaggccaatcaaatatgttaatgcagccaacatcttcacaatatcttaacttaaattagtcccttcccccatgcaagcggcgtccccgtgcaagccggagagtggggcttgtatcgcataccaagcaaaggatgtgagtcatcatgctaaaaaagatagttgccatcttactcattgttttgttggctggtgcaacaaccgcttgcgctagtgaccaagacgatgatcaaaatgtcgagcagtttaactgagtgttggctggatacaaaaaaagcccggccgctgtggtcgaggagcaattagattatgtggaggaaaagaaattgcaaaaagacccccagtttacaattcaagtgcaacaccctgacgactagaccataaaggccatggctatgagtcttttctatttgactaatttgttgcacttgaattgtaaatccgtcaggtaaaaaaagcccaaccaccaagcaaaacaggtcttgggggctgagccaataaaaagttgtatcgatggttaaacacaagacagacggtttaacttacttagccgataaaaataaaacgttaacggcttctggcgtcggaatatcacgttgaatttcggtcaagagtcccgttttggcatcgcgactatagagtgtgccattactactgttttggttgaccacgagaataaagtgttcagtgagatcgaaattgaaatcacgaggaaaatcgcctgccgtactgatttgttgcaattctgacagatttcggccatccggactgacggcaaaaacggtgatactattatgaccgcggttggatacataaaggaagcgttgatcactgctcaatcgaatcgcagcagcaccattgtgatcggtgtaatcttccggaatggtcggcaatgttgcaatgagtttgaattgaccagttgccgcatcataatttaggatgctaacctgacttgaaagctcacctagtaaataggcaatcgggttgttgtggttaaaagccaagtggcgagggccaaagccaggttcggtgtgaaaaataaccggatcgctgagtttgccggcatcgctgacagcataggttgttaaggtatcattacccagatcaacgaccgctagtcgctgaaagtcaggggtgacagcagcaaaatgaacatgggcactatcttgttccggtcgcggaccgttaccggtatgcttcacttcatccgttaaagccaaaccatgatcatttttaatgcgatagacattgattcggccttcgtggtaattgctggcataaaccagctgacgattcgcatcaatcgagatatgcgcgggggatgaacctgcctgcagtaccttgttaatcaagcgcggtggatcaacatttaggtcatacgccgcgacaccgccttgatcaccttctgcatctaccgcatataaaatattgtcatcagatacggctaagtaggtcggtgaacccaaatcagtaatgaatggggcaggggtcggcaaatgcgcttcgtcattatcaaatgtaccggcataaacgcctgcaccgccgtgacgcgtataaccgcctaacaagagtctttgcttcatgttcaagttgctcctttcgaatttgatttgagtatagcatgtttggctgatgcttatgctatgatataaagcgtgagtcaacgtttaatgaaaatagctggccaataaagctatcattaaaggaattttcagacctttaatcaaacgatttgccacagcccataactcagcgccatcatgggccttaacgagatcgcatttatgttggcagcgaagctcagataacaaacacttatgatattaaaaatgacaggcaaacggaggcacgaccatgcaattgacagcaacagtaacagctattggtaaggatgcattgagttccaaggatccgatgattattctctttggaccgcaagcaacagacgcactacgcgacgtcgcggtgatccagcagttcgctgacaagtcagctttggaaaaattggttatcaaggcgggcgaccaattaacaatcgatgatgagacgtttgagatgacttatgtcggtcaacttgctaacagtaacctgaaggcgattgggcacgttaccctgttgttccaagctgtaccagcagacaagccgatgcaaaacgcaatttatttaaaaccgacccatcgaccaacatttaaggttgggacgacactaacttacatcacgcaagccaattaagtgtgacaacgagttcttggatcagttatgcgccagtttctaaccgcttctgcttacggtcaacaaaaaaagaagatttcagacgatctatcagcctgaaatcttctttttttaccatgatgccttacgaacacctggaatttgacccttatgcgctagatcacggaaattcaaacgagacattttgaatttgcgcatgtacgcatgcggccgaccatcaagttcatcgcgactgtgcgcgcgaacgggtgaggcattccgcggtaaagcttgcaaggcagcgtaattatgctcagctttgtacttggcacgcaacggggcatatttagcaatcgttgcttcgatcttcttttccttggcaatctttgactttttagccatgtatgcaatcactccttatttgtggtttgtatttaacgttttttaacgacgtgtctgttcgaacagttcaacccacatagcatagcacagccttaagccgctcgcaacacttacaaaaaataagcgtttaatattgatcgccattgaaaatcgaatttttaacaatgacataatcgaccttggtcaaggactcgagatcgcggccaccggcgtaggagacagctgactgcaagtcttcttgcatttcctttaacgtgtcaccaatcttgcctttgacaggtaacaagatttttttgccttcaacgttgtggtgggtgcccttttgatactcggacgctgaaccgtaatattcctgatattccttgccgtcaatgttgacgtgtttgccaggtgtttcttcatggccagcaaaaagggaaccaatcatgcacatggtggcgccaaaacggattgacttggcgatgtcaccattattgcgaatgccgccatcagcaatgatgggtttacgggctgctttggcgcaccaacgaacagcagctaattgccagccgcccgtaccaaaaccggtttttaatttggtgatgcagaccttgccaggaccgatgccgactttggtagcatcggcaccagcattttcaagttcccggacagcttctggggtgccgacattaccggcaatcacaaaggcatttggcaaataatgtttgatatgttgaatcatgtcaatgaccacctgagcataaccgtgcgcaatatcaatggtgatatagtcaggagtcagctcattagcagccagtgcttcgataaaatcgaactcgtcatccttgacgccgacactgattgaagcgattaagccgcgttttttcatatcgcgaacaaaatccatccggcgttccggctggaagcgatgcataatatagaagtaatcgtgctctgccaaccagatcgccaaaggttcatcgatgatggtttgcatattagcgggaacgactggaatcttgaaagtatgcgggccaaatttcacgctggtatcaacctctttacgtgattgcaccacacacttgttaggaatcatttgaatgtcttcgtaatcaaaaatctgcatgccgttgttcatcggattcatcctttcgcaaaagccgaacattgttaagcattattggtgttattcaaaacaccaagtgctaagatacgcgaaagttttgtaaaagtcaatcaaaagtacatatattcttttttaatgttcgtgttttgcaaaatggaaagaaaagccggttgcccggcttagaaaaacgacagtggtaattgatgcggcaaacgaggatgtaacacgtcacagaaggctcagaaaaacttgttgcgccaaaattgaaaggcaagtactaccgcaatggcaacggaaatggcaatggtgataatccagctcaccttcatatcagccaaagggagatgaacattcatcccgtaaaacgagaagaccaaagtgggaatggttaacaaaattgaataagaagttaggaacttcatgacgccgttcatgttattgttaataattgacgagtaggtgtccgccgtttcgttaataatagaattgctaatttgtgccatttcgatggcttgttgattttcgatgatggtgtcttccagaaagtcttggtcgtcttcatccaaaccaagaggattgctgcgttttaattgttcgaggacgttgcggtcggtccgcaaactcatcataaaataaaccagtgaccgttgaatgcccatcaagccgtagagttcttcgttgcggaggctgcgttgcagtttattttcattggcttcgcgtgccttgtttagatcacgtaggtaggttaggtaactgattgaaatctggtaaaggaactgcagcacggaccgattttgtcggcgagggtcgaagttactgactttaccttctgcaaaaagactgaggagtggaatcggctcgccgttgatggtgatcaccgcagtattagtgatgatgatcgctagcggagccgtttcgtacaccacctttttacgtgcgtcccgtgtgacgatgggcatgtcgaaaataaacagatggctatcattatcttcgtcgtattcgtaacgggcaccttcatcgggatcaaggccgtacaaaaggaaagcttctgagagcttagctttgtcctgtagttgctgacgttctgcaggagtaggatcaactacattgatccagacccccggactgatgcgggattgctggttcagttgaccggttttgtcatcaaatcgataaattgcaagcatagcgggctccttggctttttcttttagtttacaacaagcaacagcaggatgcaggagggaaacacatgcgtaagcgtgaaacaaaaattcatttagcagcagcacaagcaccgctttttgcttgtccagtctgtggacaaccattacaggtgacagcgggatcgttggtttgtgtcaacggacatgtacgcgatttcagccacaaagggacgctgaacttcctgaatcagcaagtagccaccgaatacacgacgccgatgttagccgcacgacggcgaatgttgaacgctggtttgttcaccccatttttggcagctatggcagccaaacttccgaaacatcaacgactgttagatgtcggctgcggggaaggcacgccgactgcgtatttggccgaggcgggtcaacagactgccgtgggttttgatatctcatcaccggcgatcaatctagcaggcggcttagcggcaccagttctgtttgcggttgcggatctggcccacctgcctttcgttaacgatgcatttgataccgtgaccgacatcttttcgccaggtaattatcgtgaattcagacgtgtgctgcgtcctgatggtcagctattgaaaattattccgcgggcgggttatcttcgagaaatccgggaaggcttatactccgggacggctaaggctgtgtataacaatgagcctgtcttgaaaaggttcttagcagctttccctgaagcgagtcaggagacaatcacctacgattttccgttagcgccaactcaatttggtgatttaatggccatgaccccgttaacgtggcaggcgcccgccgatcaacgcgaccaaatgcttgctgcaccgccgattagtatccatattgatgttgatttgctcactgtgtcgcatcttgtcaagtaaaagggttgtaaacatcgatggctggtgttaatattcctttaagctatttatttttaacttttatcagggctagcttttgggtaattgataaaagtttgcgataaattacttcactaacgtatcgcttcgctgagtgcgctccgaagcaatgcgtttttttcttgcttatttttacaaattgacctgtccacaaggcctgttcgtgcaagttaaatgtgctaaacttaaaccacttgcgttgaagggaagataacatggcgaatcacattgttttatttgaaccgctgattccggcaaataccgggaacattgccagaacctgtgcagcaacgaatagctatttgcatctcatcaagccactgggatttgagacagatgataagcatctgcgtcgtgcaggtctggattattggcaacgcgtccggatcatctatcatgatagtctggatgacttcatggcaacctttaaggaaccccaacacctttaccttattactaagtttgctgatcagacatactcagaccgagattatgccgacattgatcaggatcattatttcctttttggcaaagagacgacgggactaccggaaggcttcatgcgcgatcatgccgatcagtgcttacgtattcccatgactgacaacgtccgcgcgttgaacttgtcaaattgcgcagcattggtcatttatgaagctctacgccagcagcattttgcaggacttgaaacatcacatacgtacgagcacgacaaattaaagtaacccaacaatagaagtgtgcgagctggctcgagtagaaactggcatgtgaatggctttgaccgttatggaaaaggacgcttacaagaaggtttctcggttggcaagcgcgtttaggaggctgtatttatggaaacaaaacgttaccctatcgcggttgaatcttttcactatgatttggttaagcaaggaacaccggttaagaacgacttgcaagttgccatgcgccagattgaatggtcagatcccgctaaacaagatgagttgaaaaaaggcaatctttttcagatgatgattccatttgacgttgtccctgacgatgccggttttgagatttctggcaaaattacccagatcgtgcaggttttggattattttggtgaggcaaatgaattgccgcaagccgaacttggcaaactaagccggccattggttgaaaccattgaaacgttgacttatcaagtgaccgcagttgccttggatcaaggggttaaccttcagtttggtgcaagtgatgaacaaccgggccaaacaaaataagacaaagttgagtcatgatgaaaggcggccgttatcagccgcttttttgatgagcgcgaatgcattctgacgacaggcgttgtcttttagctcaatgatcgctgaatcatcatggctttttatttgcgagttcagctcgtgtataataggcgggtatgaaaggagcatcacgatggcacagaaacgcagcggacgcaaaagcccgcgcagaaaacgacctaccaaacaacaacagcacacccttagttgggtcggtgcgttatttgtggtgttcgccagcttggcatttttccggttaggcattgtcggaaccgtgtttgctaatgttttccgattggttgttggtgatagctttctagttgtcagcgcaggtatgatcctgatggggatttggtttctcttcgcagatcgattgccgaaattggcacggcacgtgtgggttggcctcgtaattatcttaatttgtgccttggtactgttaagcgcaggcaccatgaccacattgaatgtgcacagtcattatttgttggcgacctggcgcttacttcaaaatgatttcggcttaatgacgacggcctctagtgttggcgggggcttgatcggggcgggtttgtatgcgttacttgcccctttactaagcagcatcggtgcaacgattcttgcatggctaggcatcgttgttggcacattagcttttctaggtgtgggtgcgaatcaggtttttaattggttgcagcggtgtgggcaagcttgtaaacatggcgtgatgcaggtacaagcagccgtggcggctatgaaaaaagaacgcgcgcaaaaagcggctgcccagcagaaaaaaaccgtttctgcgaagccacagacaactacgccggttaccgaaaacgaagcacccagtgaaacacctgatcaccaggatgatttcacgattaacgggccggcaccggttcacgaatcgacgcaaccggctcccttgccacgcacagaacctaagccgcagtcagctacgactgcgccacaacctgagcctagtgaagcggcatctggacttgatgcagacgatccttccacgaattatcagttgcctgatcttgacatgctgacaacgattccgccagttgatcaaagtgctgaatacaaggcgatcaaaacaaatcgggttaaactaaaagaaacctttgaaagttttggggttcatgttgcggttaaaagtgccacacttggaccatcgattacccaatacgagattcagccagcggtcggcgttaaggtttcaaagattgtcaatctttcggacgatctggccttagctttggcagcaaaggatatccgaatcgaagcaccgattcctggtaaatcattgattgggattgaagtgccaaatcaacacattgcaacggtcggcttcaaacaagtcatggcagaaacgccgaagtcgcctgatcgcccattagtcttaccattgggccgcgatgtgaacggcaaagtcgtgacttttgatttgacaaaaatgccgcacttgctgattgccggagccaccggttctggtaaatcagtcatgatcaacgtcattttaactagcattttaatgcgaacgaagccaagtgatgttcgcttaatgttgatagatcctaaacgggttgaattgtcggtatacaacggcgtgccgcatctattaacgccggttgtgacagaagctaaacgggcgccaagtgcgctgaacaagattttaacggctatggatgagcggtatcaacgttttgctgcggctggcgtgcggaatatgaccgaatttaatcaaaaggtggcggctgatccgacaagcggccaacaaaagatgccgtatattgtcgtgatcatagatgagttgagtgatttgatgatggtggcaggtaacgaaattgaaactgccatcgtccgcttggctcaaatggcacgagcggctggtattcacgtcatcattgcgacacaacggccgtctgtggatgtcatcactgggctaatgaaagcgaatattccctcgcggattgcttttgcaacgtctagtggcatcgattcacgaactattttagacagtaacggtgccgaaaaacttctgggtcgcggcgacatgctcttttcaccaattggggcatctaaaccgatgcgaattcaaggcgccttcataccatctgtggacgttgagcgagttgttaaggcaattactgaccaagtttcacctgcatatgtggagagcatgacgccaacggaaaatacggaggctgagaaacccggtgattcagaggatgagctatatgatgatgcgaaggcgtttgtcatttcacagcagagtgcctcgacgtcaatgctgcaaagacgcttccgaattggttacaatcgagcagcgcgcttgattgatgatcttgaagccaatcaaattgttgggccaagtgaaggcagcaaaccgcgcaaagtctttgtgacgccagaacaagtaacgaatggtacgccatcataaggagttttatgcgaaaagaaatgaaaccgggtgtttggttgattgtcttgccgacaacgcaatttaaaaccacccgcatccatgtgcaatttttagcaccgttgcaacgggcaacagtgactaaacgaacattattaacaagcctgttagaaacgaatagcgctgtctatccgacgcaagcaactttgtcagcacatctcgagtcgctctatggcgctaatttcagtattggcgtggcccgtgaaggcaagttgcatcgaattggcgtgacgatgagtaccgtggatgatcggtttaccgatacacctttattgcctcaagcagcggccttcttacgcaccatcttgtttgaacccaacatgcaggcgggtagttttgacgaagccacttttgcgcgggaaaaggagaatttggatcattatttagccagtctagatgatgatcgccaaactcaagcggcgctgggagtgcagcaactatattttggagccgatcaggatcaggctattccgagttttgggacgcgggaagatcttgcatcgctgacggcgtccagtttggctgcttactatcaagaaatgatgcagcatgatcaggtcgtcatcacggtgttaggagatgttgatcctaagcaagtggcagcattatttgctgattggccacttgatgctcggtcacaaaccgtaccagcagtggcgtttgatttgccgacgcatccagatgtgctgacccaaacaaccaaggtgaatgcgcaacaggccaagtttgacttggcttatcatgttgaaactgatttgatgggatccaaatatgcagcaacattggtggcagaggaattatttggcggctcgagcttgtcacttctattcactaatgtccgcgagaaggctagtttggcttattatgcgagctccatgttcgatgcttttcgcggcttgatgctggttcaaaccgggattgaaggaaaagatcgtcagcaagttgctgatcttattcgtgatcagttggccgcagtggtcaatggcgatttttctgacgccctattgaaggccgtgaaggacggcattttggatcatcagcgtgccgcctatgacagcccacggtttttgacaaaccaggcgttgtatcagttgttagtaccagatgcgccacagaattttgatgagtttgctcaacggattaaggccgttgatcgccaagcggttcaacaggctgccgcagatatgaaattgcaggccacctatttcttgaccggggaggatagcgaatgaagacacagtattttagtgatgtcgatgaaacggtgatcacgaccacgctatcgaacgggctgcgattgcaagttgtgcctcgccccgcgtatcacaaaagctatgcgatcatgacaaccgattatggttcgattgatacgcaatttgcaccagatggcaaacagatggtgacttatccggccggaattgcccactttcttgagcacaagctatttgaaaaggaagatcatgatgcctttgatctttttggtgaaactggggcatcagcaaatgcattcacgagtgcgaccaaaacgagttttttattctctacaacaacgcagctgacgaagaacttacagattttactggattttgtgcaaacgccatttttttctaaggcatcagttgctaaggagcaaggcattatcgggtcagaaattcaaatgtatcaggatgatccggggtggcgcggctatgccggtttgttagaaaacctttttccaaaacatccggcgcatgttgatgtggctggcacagtggcaagtattgcccaaatcacaccggaaatgttgtatacgattcatcgggttttctatcaaccaagcaacatgacgttgattgttgtgggaaatattgacgctgatgccattatggcttttgttgcggctaatcaagcagccaaacagtttccggcgccacaggcgattgtgcgtggcgttcacgcggatttgcagacggatgatatcgtgccatatcgccagttggagatgccaattagtcgcccaaagacgttggtcggcatcaaagggcaggttgcgattcctacgacggctgagggctggcggtaccaattaaccattcggctcttgctagaagttctgtttggcgattcttcccagttatatcaagattggtatgaccgaggattgattgatgactcatttgattttgattttacgaaccagcgcagctttagttatggcttggtcggtggtgataccgatgatccgcatgcattaagtgatgcgatcaaacatgtgttgctaaacgcagcgacgcagccggatttgacccgcgaccgggttgctctaattaagcgggcgtcactgggtaaatactacgctggccttaacggactgaatggtgtggccaatcagctaagtgcgttgagttttggccaggcgagtttgtttgatttccccgagattttgagcagcatcacgctagcggatttacaagctatgattgatcaggtttttcaggcgaaagcattgaccgttttagatatgattccggaggcagattgatgcgagcagctttgattgttggtgcgtcgggtgacattggccaagcggtggctaaaaagttggcccacgatggctggtcattgtacctgcactattttgaacacgaacaagtggttaccagccaaattgcgacttttcaagcggcgtatccgaatcaggattttatttcgttacagtatgatttaactgatgatcgtcatttggatgatttgacgggccagctttttagcctggacgcggtcatttttgcggcagggatgacgtattatcatttatttaaagatacaaccgtttctgaattaacaactttaatgggcgtgcatctattgacgccgatggctcttttaacgaagatcgagcacaaattagcacagtccggtcatggccgcgttgtctttatcgggtctgtctatggtggcgccggttcagctatggaagtggcctatagtactgtcaaaggcgcgcaaagtgcctttgcaaaagcctatgctcaggaagtggccagtcttggcatcacggtcaatgtggtcgcgccaggtgcagtgacaacaaaaatgaacactaaaatgtttgatcaagcgaccttgaccaaggttcgagaggaaattcctgctgcacgatttgcgaccccacaagatattagttactatgtgactatgctagttgcaaaagatgctgcttatctaacaggacaaactttatatgttacaggtggctggcgaatctaggaaacaaaggatttcttaaggcttgcagttggtttttcatgatatactgaaaatggtcaataaaaaatagcgggtgaataaaacttatggatgaaattgggcaaaaattacgggacgcccggattcaaaaaggctatacgattgatgatcttcaacagatcaccaagattcaaaaacgctacctgatcgcgatcgaagaaggtaattttgatgcgctgccaggcgacttttatgtgcgtgcctttattaaacaatatgctgacactgtcggccttgatggggatgcgttgctgacgcaattccagcaggacatcccggaacctcaaccccaagagtatgcagcacaatcagttgaaaataagactcgggcaacccgcgccgaagaagcgagtccggttaaccgtttgcggcgttatttaccgcaaattgcgattgctgcagttgttgtcgtggcagtcattgtgatctatgtcatcatgttggtttaccaatcaggacccaagcaaacgatcccgacagattcagaaagtgttgcggtctcatcgaagcgtagtacatccaagacttcgaaatcgtcgaaatcgtcgacatcttcgaaaacaagcaagacatcagcggcttctagttcttcgaagactgcggagaagtcgtccaagaagagtactaaaaagagttcgaaattggacatttctgtagcggatgccaatggtgctactcaggcagttactttaaagaatctgccgaagacgggtaacaagttaacgcttggtgcaaccggcgctactgcttggatttcagtgattgtgaacggctcaacgacgtggcaaggttcattgacatcaggtaattcgcaagaagtgacattgccagacaacgtcacgacattccaagtgcggtcaggcaatgcaactgcgaccaccatcaagctcaatggtcagagtgttgatatctcaaagggaaccagcatcgtacgaaccatcaccttcacggctgatgcaacagaaagcgagggttcgcaagaatgaatcttccgaataaattaacgctcatccgaatttttctgattcctgttttcacgatcctgctggcacttgattggccggctgggtatctgacacttgcaggaactaaggtcgccttgagctggtttatcgcgctgattatttttattgtggcctctttaaccgactttgctgacggtcaaattgcccgacgcaagcatttggtcactaatttcggtaaatttgccgatccactggcggacaaactgctggttatgactgccttcatctttctgacggccaatggtcagattccagcatggggaaccgcgattatcctgtggcgtgaattagccgtaaccggattacgtttattgctttcaaacgaaggtgaagttttagcagcggcttggccgggaaaaatcaaaacaaacgcgcaaatgtttgccattattttcttgatgctaaacaatgcatggtttaacaatattaatgtgccgtttgcactgatcctgttctatgtcgccgttttcttcacgatttactcaggtgtcgaatacttctacaaaaaccgtggtgtgttcaaggactcattcggttcaagtcatcaataataagttattcaaatacccaggcaggtgcttgggtatttttgtagagcgcgagcaggagcgattagaaacctacgtgtaagtggccagaacctaaatggccgtactttgccatttaggttcaaggtccttacacgtaggtttctgcgactgcgagcgcgtttgcgagcgcagcgtgaagtcgccactaacctaagctgggtggggagcctcaccagcaaatacggagacccctatgtgcaagcttttggaccagcaggcccggttgcgagcaaagcatgaatcagccaacaaaaaatgcacgctaaccttagtgaataagtatctaagcatcatacagctatttagttgcaactttttttaaaaatgtcaggtcaagtaccttaaaaaacgaattctattgttaggtgggaaaagtatgcaagcagagattattgctgtcgggacagagatcctgatgggacagattactaacacaaatggtgcctatatggctaagcaactgacagcactgggtattgatagctaccatcaacaggtggtgggagacaacggtccgcgacttgaggaggccattaagttggcggaaagtcgcagtaatttagttattttgattggcgggttaggaccgacaccagatgatctgaccaagcaaacattggcagcgcacttgaaccgcaaattggttgaagatcctgacgctatggctaaactacaggcgcgcgtcaagcaacagcagcggccaatgacgcctaataatcaattacaggccatgtatccggaaggcgccgatattttggtcaatcgggttggcttagcggttggcgcgtggatcgtcaatgggcagcacacctatgtcttattgccgggaccaccgaaggaattcgttccgatggttgatcatgaactgctgccgcggctagcaaaatggagcggccacgcggaagttatggtcagccgggtcttacgtttctttggcattggcgaatcgcaactagtgacagatctggacgacttgattgccaaccaaaccgatccgaccattgcaacttatatcaaggatcatgaggtgacggtgcgcgtcactgccagtggcgctaccgaaaaagacgctgatgcaaagttagaaccaatggtcggtgcaatcatggatcgtgatggtcaatatttttacggctacggtgacgacaatagtttggcaaaagagcttgtgaagacgcttgcggcaaatgatatgcaaattactgcagctgagagtttgactgccggcgcatttcaagcagcgttaggcgatgtgccgggggtatcgacttattttaagggcggttttgtcacttactcacttgcaacaaaggccgcttttttggcaattgatgctcgcgaattagcggcacacggagttgtcagcgcatttacagccaaggcgatggctgaacatgctcggcgtaaggcagctgcggatataagtgtcagctttaccggcgttgccggtccagacacgctggaaggacagcctgctggtacggtttggatcggtttagcgcggcgcggccaactgcctgaagcacatgtttaccattttcctggcggtcgcaatgatgttcggcagcgtgctgtgatgactggtatgatgcttgcattaagggcgctgcaggcctaacagaatcattctttaacacgttaatacgtcaggtttacgcaagaggaggcggcaggatggcaggagacgaacgccagaaagcattggatgttgcactgaaaaagattgaaaaaaattttggtaaaggcgcgattatgcgaatgggtgctaaggcagacacgcgcgtttccgttgtctctagcggctcacttgccgttgatgatgcacttggtgttgggggctttccgcgcggacgaattgtcgaaatttatggaccggaaagttccggcaaaacaaccgtcgcgctgcatgctgttgctgaagtgcagaagcaaggcggtactgccgcctatattgatgccgagaatgcgatggatcccaagtacgcaactgctttgggcgtcaatattgacgaattattgctctcccagccagacacaggcgaacaagggctggagattgctgatgaactagtcgcgtctggtgccattgatattgtggtgattgattcagttgctgctttggtgccgcgggctgagattgagggcgatatgggggatgcccatgttggcttgcaagcccgattaatgtcacaggcgttacgtaagttatccggttccatcaataagacaaaaacgattgctttattcattaatcagattcgtgagaaagtcgggatcatttttgggagtccggaaacgacaccaggtggtcgtgccttgaagttttatgcgactgttcggttagagatccggcggtcggaacagatcaagacaggcgcagatgtcgtcggcaatcgcactaaaatcaaagtggtcaagaataaggtggcaccgccttttcgaacagcaattgtggatatcatgtatggccaaggcatttcgcaaactggcgaacttgtcgacatggccgttgagagagatattgttgaaaaatcaggttcatggtacacgtatcaaggtgaacgcatcggccaaggtcgcgaaaacgctaagacatatcttgataaccacgctgatcttcagcagacgattaaacaacaggttcgcgtggcttatggtatggcagccgcacctggtcgggagacggcttcggtcagtgaagatcaacccgaaatacatcaacaggctgaagtatgaatcatgagtcaacttgctgttgtcggacgtgatgagtccgatggcgcaagttttttatctgagcggtcttaaggagatttgatatatgttggcgctacgatatttggagttgataggcagcttgcctaccagctcctttttctcgctgtgttgtttgcacggctgagccccatctggcctacgattgctccgccttggtactggaatctttaaatcctattcatttatatataagaaagaacgaataagtttcccctatttgagaaaactcattcgttctttttgtggctatgaagactatcccaatctcatgaagctgtttcactttctgagatgagtcatggagtagctatttgtcttttttaggttgtcgtagcttcaagtaacccagtacgccgatgatggtcgcgcccagtagtgccaggattgattgggtatgttcgccagtatcggggatgttgctggcatgatcggtcttggttggatcttttgtctggtcctttttaatcgtggtgtcaccttggaagccgcctgatttaggcgggttattgcttggcttttctttatcaggagtgggagccggtgtttgtttgaccagtttgtcgagtgcagtctttaagtcagttactgcctttgcaactgtttccccagaagtctctggatctttgttcacttctcgggcatacgtcaatgccttttttagatcagcaaaactggcaggtgtatagtctgtctcctttagttctgctgctttggtgatcaagttgacgagttcagccttgttcggctgcttgataagttgctgaagcgctttgctcaaggcatctgttgccttcgtcactgcatcttgatttgcatcgacatcgttcaaaacgttgcgggttggctgtaaaacctccgtcaattttgcaaaggagccaggggtataatcatttgcctttagtttctcggcggtgtttagcaaatcggccagttgttgtttatttccgcgcggcacaagagcatcgatggcggcttgtagttgagttgacaaggtttgagctgtatcagcagacgttgctgtatcagcaagcgccttttttgcttctgcaagagctgcggtcaacttgtcaaagctggcaggcgtgtattggtcaggatttaaggcttctgcaactcttacccactgtgctaagtcggattgcggctgtgtctgcgtgaggactaatgcaaaccaagcacgactaagtgattgaatggcctcctgaatctgtttctgtgaggcaccggcatcagtgctaacggtctttgcagcggttatttcggtttgcaagttggcataactttcgggcgtgtaacggtctgcctttagtgttgcagctgctgtgatcagtgctttcagttggtcttgattgacaccgcgatctgcttccagtttgcccaatgcggttttgagatcaatgtaggcagctgtaagatcagatggggacacagcgtcatctttgagcaactggctggctttttcactggctgcaaggacaggttgccaactggtggcggtgaatagcttcggatcgagggcatgcacagcatcaatcaatgccgctagctgctctttagcatgattatgctctgaattgtcttcaaaacgcagcacaattggcgctggggcttccggcaaagcctctggtccccactggttggtaagcattggatcagtcaaagcaaagcttagatcggctttcgttaactgtgtttttgctttaagtgtgatcgttgccagtttttcattgccagtgagccgcttttgttccccttcatttgcgaaaatgagatataggtcgcgactgctattcgaatgcgtgcggactttgctgaagttgaccatacctgcggttgcagcagtgggttcgacctgaattaaatcaacatttgggttggttaatggcaaccgggcgaataagctattaacgtttgtcagatccttgccaatcaaattgagcgtgatggtttcgccaggggcataagtggttttatcagactgcaaggctagggtgccgcttggaatcttctcatctggtttggatactggtgttttgccgagtttggtcatcacatagttgatatcaaatgcatcaatcacaccgttttggtttaaatcgccattttgaacgtaaccattgaagtcactgtcgatattagctgtcaaaccagcatagttcacgagcgacatctgatcatcaccagtaatcgcgccatcgttggtaatatcgcctaatacttgtttgttggtaccgtcacgcttaaatagcagaaattctttgcctgaaacaaagtcgcctagcgttgatgccttagggatggtgagccgaatgtgctgggctttttccttttggccaaaagaaattgttttttcttgagcatcaaatgtccaccctttgccttcaccagcttcatgccaatgaataccatcgagactggtttcaactttcaatgctgatagattaccattgccgccattttctcgcggtacgtaggtgagatgatctagatcatagacaccgtctaggtcagcggtaatcgtcatcggcgttgccgactgcttctcgccgctggtaaaccagttggtgtgggcttcggtggttaagtcttgatcaaaaagtttatcgaccgtttgtttgtcttgccatactgggacatccttaatggttgaatcgactttcaagttggtcattttcagtgctaagcgcaacggattttcatcagagctaaaggtttgtttatcactccatttcgacacggcatcctttgtgaccgttcgtacttggaacgagtgcttagtttgttctttaaccggtgacaaaacgaatgctggttttttgagactgcgataaaccacgccgtcagctttgacgtcgtaacttaatgcgtctgttacaggcgaccagttgatgccaaccgcggtgtctgttgtcgtcttttcatcttgtttgattgtgcttgggatcgccaattcgtcattcactggcagatcgtcggttgacggatcatctttagcatcgataccagagacagttaacttgatcccattggttgccgcgtttgttttggcaagtttgacttggaggaaggtttggtcaatagccttcttgtcggtcaacttttcgagatactgattggtgtggtactcgctattcacaaagtaaacattttcgccggcatcatagtctttctgattggtgactgcttttaaagcgacttgctgactgccaacagttgcaatgacactgctgggattgccactcgtgcgaatagcaaattcggttgttcgttcggatttcaaacctgtgtaattacctgacaggggtgccacattgacctcaagctgaccctcttgcaggttgcttgtcactttggtttccgcgtaggcaccctttagatattttcgagagataccgtcatcttcatagacggtaaagtcttgcttgccagccattgggaaaatttggaattgtcgcttggtttgatccatttccttaggcgtgttatgtgccggtgtagtcggaatgatagcacctttttttacgaaaacaggcagttttcacaagggagcttcaaaattgttcaaaacctgaccgccgcggtattccttaccagtgtaatagtcgatccatacctgatccttgtccggtaaatagatgccattgcggacatcattgccttgatcgtctgaagcggtattttggtaaattggtgcaaccaagaagttgtcaccccataagtattcgtacttaaccaagtccatgtaagcttcaggcatatttgggtagtcaaggaataaaccgcgaaccatcggcttgccatcaaaaacgctttgggcagaggcggtatagttatatggcatgagcatcgtcttttgcttggtataggctcggttgatatcagtcgtatgttgatcaaaagaaaatggggtttttggattactgccccagccatccatgttgagttgaattggcgtgaaggccttccattgaaagtcacgagcattgacaattgaatttccgccgccaaagatgccgtccatatcggaaccaacgtatggctggcccgacaaaccggtgccgatgtaggttggaatgtggaaacgaatgtattcccactggccaccagtttgatcgccagtccaaataccagcataacgctgtgtgccagcccaaccgtctaatgtgatgccaaaaggccgtaagtcatcgcctttgacttttttcattatgttgtcggctttttcaagcccatccagcccaaaagaataaccgtcaccgacccaagcaacatcggtcttcaaagctttaacaccattagcgacttcttttgaaaaatcgcgatcatccggcttaggtttatttgggtcaactggcgacagattttgctgtgtccataaaccgacttcgataccttccttaccggcataatccgcaaaatctttgaggtttttttaggttgccagccagcgtattagtttgaccataaccggcgccgtaaccgtcattaggaagaaaccatcccagtggcatatcgttttttttgtaacgatcaatcaccgcacgggcactgaattgatagttgttcagttcgccattcagtgattcctttgtgccgctttgaccagcgggtacttttcctggctggtattctttataaaatttgccgtcttcgaatctgattccgccactggtgccttcaggaacttcaacccaagtgtcacgattataagcgttcagatgggcctcatagaagccataccgtggcatcatcgctggcgcaccggttaaatcgtagtagtcttttagcaagttgtacggtttgtcatcgaagaaatagacggcatcgaaccgcttttcttgatgcgtcgttttaatttcaccattatttgcggcatcaaagtcataggtccctggcgtgaaggtgttgcggatgacgccataaccagccgttgaccaatagaacggatttggcgatgcaacgccgccgtctacccaattgttggtattcacaattttgatcttttcgccagttaacgtaaagttaccgttttgcgtaccgccgccgaagtattgatcgttgttatgcttaagcgtttgggtagtatcgtctgctgtgatactaagtggctgactttcggccataataacctttgcgccgcgattaacttgcaaggtagcggcagtcttgtttagattaatggcgagcgaaccagttttaatcgaccagccgtcactagtactagtcaaggcagcagacgcaaagtcttttaccgaagacgcattgattgatttggtaaaaatcttggcattcaacccttatcccgattgggccggtgccgcgaatttttctgaagggtcaacgtaaaagcggaactgattgtcggccaagataaagagacgcgccttcaggtcatttgaataggtcacttcaaaataatgatcttgctcctcaattttcaagtcaagtgcaacgatgataacgaattcttgatagtggtctctataacgcgcgaaccagcccagaaacctacacataaggaccttggacgcaatgaccaaagcccggccatcacgtccaaggccgcttatgctccggtttctaaccgggctggttcgcgctcaacaaaaaaagccaacgggcgagaatcaacccatcagcttatcatttttcttgcaatgactaaacgtgatccgattcattagcgccccgcgatgttcgcgacagtccagcggatgttgtccaactggcccaatgtcggatttctgaacaaatccggcatttcggcatccgccccttttgcaaccgcgcatctggcgttcaggccattgcggttgggattcatgacaaatgcaacctctaatcgttattggtttacacgttaacatgttcggccttcaacagcaactgcctctcacaaggctttaactcaattctcagccttgcgaatatcggcgaccagtgctgccgtgtcaaatttttgctttaaaaaagcatcgttggttgtcggcagatgtagctggaagtcactaaacttttgcagaaacaattcgccactgtcgagttcgaagccaagaatatggccacccatgtgatgatcagcgtcaagaaaatgcaagtggaaccccggtgacaccgcacccgcatagagatcaggcgaataatacccaatcaatgtacccttgatattctcagcgttgaattctttttgacctgaagctgtttcagtaagcgttggatacggtggctgttgcggcaacaccgcgcgtgtatgcatctgcgtaaaccgcccctcaacgcgtactgcagcaaaaagattggccgtttgaaggcgttccaaaaccgttttttgaaagcctgacaaatcaagtccttgtagtttgcctacagatttatcagcttgataatgcacgtttgcaaacggtacttcttcttctgacccgacttcgcgaacagcgccttgtgcattgacttgataaactttgctatcaatgatcacaagttcgccatctagccccgtcaaagtgccaataccagtattgccatgctgcagcagttcttcaatcttttgcgtaccagcaaacaatccgggtacaagcattgccaatgtgccatgttgatataaccgatcagtattcacagatggtctcctcctattacgcgatcgccaagcgcaatgctgacgaatgaacaaaagcttagtaaatttggtcaggaagcatcgccgcgccaagctccgcattatcagaataatcaactggaatatcaactaaaactgggcctggtgtagcaaacgcctcatccaaaacctgccctaattcacttggtttattgacccgcagtccctttgctccaaatgcttctgcatacttcacaaagtcaaccggaccaaagtcaacgccagctgcacgaccgtacttcatttcctcttgaaattttaccatatcataatggccatcattccaaataatatgcactaagtctgcatgcaggcgcactgctgtttctaattcctgtccggaaaagagaaaaccgccatcgccagaaactgagaccgcctttttccctgggcaaaccaacgttgcagcaatcgcccatggtaaggcgacaccgagcgtttgcatcccattggaaaacagcaaatgtcgtggttcataacttctgaagtgccgggccatccaaatataatgactcccaacgtcaacagcaacggtcatttcatccgtgacccgctcctgtaaggcagcaacaatgctgagcggatgaagcactttttgatcagcaattgccggtggtacatcgctatcctgcagttttgcctgaaggtcttctaaataacgcttgctgccaggtgcaacttggtagccacgtaacaatggcactaggatatctaacgtttgcgaaatatcaccaatgagttcagtttccggctggaagttatgatcaatctcagctggaacatcatcaatgacaatgatgcgcgccttgccatccgcattccagttacgtggttcatattcaacgggatcgtacccaatagcaatgaccaaatcactatgttgtaacaacatgtcacctggttgattgcggaacaggccaacccggccgaagaagttgtcaatctgacggtgagaaatgatgccagcaccttggaaagtttccacaacaggtagttccgttactgaaagtaattcgcgaatctctgctgttacatcacttgacgatgcccgcattcctaacaacaacactggcaatgacgcttccttgatggcgtgcgccagatacgtcatatcactgggactagccggtccaagttttggtgcgaccagtggttttatcggttccgagttgactggcgaatctgtgacatcttgcgggatagaaacaaaacttgcgccttgcttgccagattcagccgcttgataagcgttcgcgattatttcactcacgttatcggggtcctgaacttcagctgcatatttggtgatcggggcaaaaagatcggcgttacgcatgctttgatgagagcttcgcagcaaatcagcgcgtttgacctgaccggataaagccaaaaccggatcaccttcagccgttgcggttaccaagccggttgccaagtttgatgctcccggtcctgaagttgtcaggacaacccctggtttgccggtcaaacggccgatgccagcggccataaacgccgcattttgttcatgtcgcgcaacgattagctgcggactcttttctgatttaggatgctccagactttcaaaaacccgatcaattttggctccaggaatcccaaaaacatagtcaatgccgtgattcgttaaactttcgacgatcaaatccgcgccatagcgcttctcttctgccattttgccacttcctcctgattgatgtgtttcatattacgcttattgtgtttcgattcaaccctatttttattgaaaaacagtaattaaacagcaagttactgttacattatttccatatatctgtttcattccattgacaatgcggcgtacttttcttacgaatggtttgctaacgccatcatgccacaaaagttgatcacgacccaatagtttgcctagtcttcactaagccgcaacacatttagttaaaaaaaacaccgcctctaaaagacgatgttcattaaatacactgcataagctggataaacagatcattgcatcttacgactgattttgccaataccagtctgcggatcagtcagtttaattgtaaaaccaaatttagtgaaaatatgccgcagctttgtcaaattaaccttgtcaaacgaactaatcgtaccgtcgacttgggcaatgtcagctttcattgccaaattaatgaaagctttcaaagcaagctgggccaagcccatattttcaaaatcgtagaaagcgagcctgctctccgacccaagggtctccaagacagtgatgtgcatgccgttatcccaacgattggtttcaaacaaaagttgtgactgataatccgctttggaatggccatatttatcaacattttcaaaaggcgtataaacgtaaattgaatttgttttttgcttttgctcatcgaatttaaaatcagtaaacacaatatattggcttacctttttttgggctgcgtcctgcggttgattcatgctagacagcacggttagccgtggatctgcctcgatcgctgcaagtcgcttgttatacgcttgctgatactctgtttgcacagtcatcttgaaacctccagactattactcgttttcattataacatttttcaaaccgatgcctatctaaaagagaaaaaccgggatgaattcacccggctttcataaaatagctatagtaatttctcatttttcaaactgattggggagtaatcggtagtatcgctcattgcgcggttgatcaggtgtcaacccacgagggagcggcacttcgaactgaaaatcaaagccaagacgctgtaacaagttgatggaagcgatattttctggaaagacacctgcccagacggcttgaataccgttatgaaattgatcatcgatcaccagttgcaagccttcggtcatgaaaccacgatgccaaaaatggggatgcaggatatagccgatttcccgcgtcatatcatccccggtcaacggcgataaatcacgcggatagacgccaatgttgccgacaacatgctgccgatacaccaatgccaaatcctgcttttcacgggcaaatcgtcgaatgtgttctaaggcggctgcttgtgactttaagggggtcatgccggctggtaatgtggcttgttttaaatgtgcataggcgaaataatcctcaacgtcagtcaattcaaatggccggacagcgactcgcgatcctttcagcatcagcagctcctttcagactaacggtctcatgaattggaaagatttttctactttgtgagatcgtcgcagcttttttttggtttcttcgccatattttaaagtgacgaaactatttttcttttcatattatcgagtattcgcaaccagataacaagctctagctcctttcatgatgcgtccatcacaagcttccaacgctttgtttattgaaataatcggtaaaataaagttgttatctggtaactgtccgttatcgccgactatattgaatgcagtttaagctagtgaccaacacttggactgggattttttataagaaaggaggacgcaccgaccagaaatgaaacgcacatatgtcaagttgatgaaacgacttaaaacaatcgaatccgaaaactagcgaccttattcatgcttatattttcgccagatgtggtgatcttcattaaaatgactgcactggtgtgtcggttcatcacgatcaacctgagcaattcagcctgcagatagtcactgacaactatctgctacataaaagttggataaaaacatccaccgataccgcttcgacgacggtattagcggtctgtggagggtttatcatgaaaagaatcgctttgtttgcactaatggtgctagtcatcagtccatttctcattgcagcagggcaaaagactacggcaacaacaccagcatttgctgttacacctgtgctgcctagtaatcaaaaacaggcagacgcaggctattttgacttgcaggtcgatcctggccaacaagaaaatttgcaacttcgcatcagcaacctatctgatcaggtgcaaacttatacaattgccgtgaaccctgcttatactaccgacagcggtgccatcgcctttgatcgcgctatgccgcctttgaaccaagatgcacgccgtttgaatacgctcattagcgggccggaaaaagtcagtgtaccagcgaaaacagaaaaattggtcacttatatattaaaagcaccgagccagcattttattggcgttatttctggcggtttctatgtgtctcctgaaaatgactccagcaccaacaagtcggcaagcggcgttagcttcacaaatcgctttgctatcgggatcaccactattttgcgccaagatttcaagacgcctaatccgccactactggcaatgacaaaagcaggcattggtacgattaaccactatgccgccgtccaagcaaccatcagcaatccttctggcaatcagttcggtgacatcacgagtgactatgccttaagcaaaacaggaacaaaaaaggccttgataaccggtcattttgtggggcaagccgtcgctccgcactcctttttcacccaaagcatcctgctcaatgaccgcaaactcatggctggtgactattccctcaaatggacagctaaatcaggcgacttttcttggacaaagacacttgcctttcactatagcggtcatttaccaaaaaacaccctacaacctgttgtcaacaaaccaaagacaaaagcacctgacaatccacaactgccttggatcattagcggtatcgccattgcgcttctcctcatcttgaccggtacatggggctggagcacttggcatcggcggcataaccagtagaaaaacgtgctgcctgcgcgcgattggcttatgataaagggagagcgtgaactgatgcggttagaaaccggaacataagtgggctgggacgcgatgactgcactttggtcattgtggccaaggtccttatgaggaggtttctgcgccagtgatcgcgtttaaaaagagcgtgaattggcgcggttagaaaccggcatataagtggcctcaaatgcaatgatgcgccatggtcattgtgctcgaggtccttgtgagacggtttaggcgtcagtgagcacgtttaaaggaggacttcccatgtcaaacaatcgcatgctcggaaacgagtttcaaacagcatatgaaagtgctggcggaacggatattttaaaatttttagcgaatgtcaagcaggcattccagtgcattacggatttaactgcacgaatcactggtatgccagattcggttaaaagtgagtctgtctctcagttattagttcaacaattggatcagacaaccttcgccgaaagtgccgtgcgtcaatgggaagacgatttgcatcgctttgctgcttatctcacaccactagaaccacctatcgcaattcttgatagttgggatacattaaatgactttttggaagcgaatcaagcattattgagctcattgcaaaacgtgcctctattgacccaagaaactcaagaagtcaaaacaacatcgcagttgttcgtctatccagcagaacccctattccaagtcgttcaggccgacactggcgaaagcgactcaattgatttggccggtttggcagatgctgatcctgaaggtgtcgctgaaattgcgcagaatcacggtgttacaccttttgcagcgtttaatgcccagccttgattttaggctgtcaatcctgtatgcttgacaggttaaattatgaaaaagtgaggtgctaaaacatgcggaataacatcatcttaggcaacaatgaaaccggcgaacggatctatttgacttccaagaacaagcggaatacacctgatcgtttgcaactcaagaagtattcaccgaagctgcgcaagcgcgtggttttcaccgaagttaagtaattattcaatgacttcatcagtctatatcgcctcctatcagtgtttatcattggtgggacgcgatatttttttgcctttttatgactgctgatgagccaccactggcacaacattattgttaacatgagcaagttattaggctggccattcttcaacatgctaaagttacttatagtaagtgcgtgacgctgtcctcaaacaagaaaggttgattcctatgacatttgttttgccagatttaccttttgactatgcagctcttgaaccttacattgacgcaacaacgatgcaccttcaccatgacaagcatcatcagacatacattgataaacttaatgccagtttagatggtgtccctcaggcggccggcaaatctattgagcaactattgacagggcttgatgcgctgccagaaagcgtgcgcgtttccgtccggaacaatggcggcggacactataatcactcattgttttggacgatgctgagtcctgaaagcaccatcaaaccggacggccaattattagcagatcttgaaagtaccttcgattcatttgacaacttcaaagccgaattcagtcaagcagctttatctgtttttggatcaggttgggcctggcttgtcaaagacaatgcgaccttaaaaattgtgacgacagcaaatcaagattcaccaatcacgtatcatcagtacccgctgctaggcttggatgtctgggagcacgcgtattacttgcattatcaaaatcgccgaccagaatatgtggacgccttcttcaaggtcatcaactggcagacggttgaaaatcgcctgatgcatcctgatacaaatgcctgacaatatttggtcactaactttactaaaagccgaagtgcaaacacattttgcacttcggctttttttcatgtcttcgcctgaatctactgcacgtcatactaggtcagattgttggctcaatttggggtgcttctgtcagcagttggttaaacaaagccggcaccggcaattcagccgtaatctgcttttccgaaaaaggatccataaaattcaaccgcgtcgcctgcaaggcttgatacggtattcgcgcatctggctgaccataaaggtgatcgccaattaatggatgacctaaacttgcaaaatgaacgcgaatttgatgtgtccgaccggtcagcaactggacatcaaccaaagtattggttttttcttttaaaacccggtattttgtcaccgccgtctggccatcagctgccacaattcggtgaatgccatccgccgctaatttcagaggtgcatcaatttcaccttttggggatggcaatttaccgctgacaaccgccaagtaatgcttcgtcagtgtgcgttgatgtgcttgatcaaaacggccttgtgcgtatggatgttttgcagccagcaccagtccgacagtatcgcgatcaagtcgagtcatgatggctggttgtggtgcgtcaattttttgctcaaccaaatagcccgcaatacgattcaataaactcgaattcggtgtgtggggtccgggaacgcttgtcaatccagctggttttgagacaattagccaattaacatcttcataaatgacttctaaaggcgcaaactctggcgtcagcgttttgctagtcggaatttcaaagcggataatctggccagcttcaaccggaccattgtcagatgcttgcccatcaacccagatcaaatgatccactagcatttttttgaacaagcgatgactgacgccttgctctgctagccagcgtttgaccgttgtcgaccgtgtcacctttgtcgtaaatgaatatcgcatacctttttcctttcaccatccctcttccgcacttaaaaccgaacgaatcggaatccagatttgcatttaaacgggttttgggactatggttagactatggttaatgtacaagaataaggaggaacaggcaaatatgcaagtggaaaaagacgtgatctacgataacgcctataatttagccgccgatctctatgtacctgatgaagccaatggcggtgccatcgtgtatgcacacggcggtggctggtttcgcggcgataaggaaaatgaaagcgatttaggtaaatattttgctgatgccggctatctatttgcgattccgagctttcgcttagcccctaaatatttatatccaacagcacaaaacgatttcgatcatttcatcaattggttacttgcttccccttatgattttgatcgtgagcgtttgggacttttgggggcaagttcaggcggcaccatggttctgcaaaacagtttagcttccggctatccgctcgttgcatggtcccctgttgttgattttgccaactgggttcaaaaaaatcaaatggtaaaggcttctgtggatgggaaaaaagaacttggtcttaccgagatccacgaaattcatgattcattttacaagttttttgtgcagacttaccttggcggcttagacccgcgtttgttgaccgcggtcaatcccaccaaccatttaaccgatcaattaggtccggcattgttgttcaattcagctgatgaattgatgccactgccaagtgccttgcactttttacaacaagctgccatgtttggtcgcgatatcggactgcatgttgtgcccggaaccggtcatgcccgcgactacacaagttttgccttgccagaaaccaagcgcttttttgatcatcacttgtttacgacggttgaagacaaaacgttgaacaaagcgacagactgagcttaacaacaaattcggccagtaaaatagcgttgcgatcaaccttcattccgaatggtgatcgcaacgctatttttatgcgtcaattttaaaaaacatcaaccgtcaccgggtgcaaaggtcggttcacggttatcttaagtaaagaacttcatgcgtgatgcagaatcaatggcgatgcgacaccgggcgcgacccattcaaggccaccactaactggcaccaaataaatggcatcagcgccgacatctgtcgggatcaagacaaaaccattgccttctggcgttaccttatagccggtttttgttgttacgccagcctgaacaacggtcagctggtctgccgtaattgtcagcgtcacgtgctcattctgccatgtgccgagataaaccggtgcagtgttgctgacatcctcagcactgaccgaaggcgttgcttgagtcgtacttgctgtcgaagctgtctcggtatgcacagtcgcaaccgtgctcgaacggctgatctcttcagaaggttgtgttgttgccgctgaggaatttgttacagcgactgtcgaagaggcggtcgcgttctcttttttaggttttactgttgcagctggttgctttttaggcgttgtgacagtgactgtttttgtatcagtcccggcatttgcctgatgctgataaagtgcagcaccggaaaccccactgaaggtcaaaatcgctgttgccaacaaaaaccactttttcatgtcattcactcccaaccagacatactgtcgtcgacaggtccgtttttcttattatctctagcctatcatgctgcctaatcaaatgttacaaaacgatgtcaacacaagcaaatcttaataattgcggcattctcactgtcatctttttgtaacatttaaaaagcggtggttccctcttgccgaagcaaacatatgttcgtataatcgatttgaggtgatcatcatgacttatgaagaaaaaatcggcaccgaaagattcgatgccatggtggcggattttttcgcaaatcgttactttgatcgcggcatgcgtaaatggcaaggctactatctttctgatcatacagccgctttaaagaagcaatctaaaagcgaagcgctggtttatcccccgctgccccttcaggatcaagcggtcattcgcgcaatcttgctacaagcctatgcagaaggccaaacagtaacagcccagcttaacctgcaaacacctagtggtcagatgctgccaccgattcgcggcaaggttggcggtttaactgacagtgacgtggttaatattgcggatcaaaatatggcaatcggatcaattcggcacatcgaactcatcccgtttgctgcatcaacgcatcaaaaaaatacgccagactaaggtagtcggccgtgccgccggggctcaaatttcgtgcaatcatttcggcgtttaaagcgcgcaacccattaggtagccgggacgccgggacatgtaacaacgctttggccgcatcctgaacaaaccgtaacccagctggccccccacggtgcaacacattagcatcttcaacttgtgccatcagatgaaccatcagctgtagatagcgcagatcgccgcgtgtcgtggtttgccgtaagtaaggcaggatcaccgtccggatcgtcgggtagccggctaacgcctcaccacgcacgccagtcacaccatgcttcatatacaacgcctcgccatgactcaactgttttttttcactgagttcgcgaaaatcgccgctcacgccttgtgcaatttgcgccactgccggaaaaagcggggcaaaatcatgcatgactaactgcttaagactttgcttttgcaacaaccatcccaaagcacccagtaaaaacccaaaagaaaaattagccccgcgatgcgtattcacacctactgtagctatcatcatcgctttttcagcctttaccccgatcgtccgcaattgctggtacaactgtggtaccgttgccgccgttaatccagcatgcagatactgaccaaaataaggggccagcgcatgaatgctggcctcaaaggtggtgacgttcatatcgcgatgagcgccattggactccggatcaactaagcccggcttcggcgcaagcaaaacctctgcccgcagactcgtgaccgctgcttgggcgattgtttgttcattcaatgttctttgccttcataactttcagaatatattgcaatgagtggcccaaatgttcacgcgtgatcagtttgatttgatcatcatcgcggtttaacatcccccgataaatcagccaatgttcctgaatcgcaagattacgccgatcatccccgttaatactgatgtcacgaaaatagatcaagtaattttgtaattggttgacaatcattttcaggcgcaacatatggctggcatcgtaaataaagttattaaactcggtaaatttggccatgacttcaggcacccggccagcatcattcaaccgatccgtttcttccagaagcgcacgcatctgtttaaattgagccggcgtcattagccgcattgccttacgtgttgctaaaacatctaattccttgcgaatatcaaaaatctcgtaggcatcgttgatcgaaatgcccttcacaatgacaccgataccggttttacgttcgaccagatcttcttcatctaatcgttcaagcgcataccgaatcggtgtccgactgatattgagattttcggacaaattcttttcgttaatacgctcgccgctgggtatttcccctaacaaaatcgtcttgcgaagcgcttcgtacaccgcctctttaatcggccgattctccgaaagatccagattccttttgactgctggcaccacttgattcatcggtcgttccccctcgcttcgtggcctattatagcaaaaaagccgttaacgggggtgttaacggcttaagggaaatgaagctaggaacaactggcaactagtgtagcaggctcacgcaacgacggtcaacatcagatcaatcatgcgtcggctcaaaacttagcgacaccttctgctccggcacatcataaaacggatcttcgcgccggccaagaaaatctttagcttgatctgggaacaaagcatagcttaagacatcctcttcgtcgtgcgcatattgtgcaatcgcttgacggaaatcaggcatttgcggcttgattaaatccgcgggacgttgtgtgacaaccggtgcatcaccaatgatctttttcaccatttcgggtgcaattgccactggcggccgaccataaaggccgcgcacgtaatccttaatttcatttggaatcaacttataacgctcaccgctcatgacattcatcaaactttgtgtgcccaccatctgcgacagcggtgtaaccaacggcggatagcctaagtcagctcggacacgcggtacttccttcaaaacatcgccataaagcgcttcttgtccttgatcttttagttgcgccaacaggttagacaacatcccgcctggcacctgatagatcaaggatttaggctcaacatctttcacgcgcggattcagttgaccggactcgcggaatcgatcgcgaatcggcgcaaagtaagtggcgatgtcactgaccgtgcttaaatcaacatcagtcggatagccaagatcttgcaacgcaaccagcatggattctgttgctggctgactggtgccgccagcaaatggcgaaaccgcggtatcaatgatatcagcaccggcgcgaactgcttccagataggtcatctcagccataccagcggtggcgtgcgtatgcacttccagtggcacgctgatttcctgtttaatgccggtaaccagatcaaacgccttctgtggggttaaaatgcctgccatgtctttgattgcaatcgaatccgcacccatgtcagccatgtctttggctaacttgatgaagtagtcgatcgtatggaaatcactggttgtgtaacaaatagcaagttgggcatgcccgcctgcttgcttcgtcgcttcaagcgccgttcgcaagttgcgtgtatcattcaacgcatcgaaaatacgaatgatatcaatcccgttttcaactgactttgtgacaaagtcagtgaccacatcgtcggcatagttcttgtaacctaacaaattttgcccgcgcaagagcatttgcaatttggtgtgcttgaccgccttacgaatcttgcgcaaccgttcccacggatcttcattcagataacggagacaggcatcaaaagttgccccgccccacatttccaaagatgcatagccggcagcatccatcttatcgagaatcggcaaaatatcactgatcggcatccgcgtggcaatcaggctttgttgcccgtcacgcaaaacggtttccatgaattggactttctgtttaggcatggggtgtcctccttttaaaacgcattcactgacccagaaacctgtgtgtaagaacctcaagtgcaatggccaaagcccggccatcacatttgtgtccgcttatgttccggtttctggacgcgccagttcacgctctttttcaaacgcgctcgccagaccagaaatctgcacataaggaccacaagtgcaatggccaaagcccggccatcacacttgagcccacttatgctccggtttctaagcggtctggctcgcgctctcttttacgattgtttccaccacttgttgtacctctggcaaaccgtgccgccgtgatcgcgcacaggccttggcgtcgccgccgcaaaccagacaggcacgtggtggcaaggcaagatccgtgcgagaaacttgatacagttccccatcgcgtaacgtgataacatcaagatccagcaggtcacagaaccgttgctgattttcaaacgcgaccatgagccgcttgagtgacaaaggtgacagcgtggtcaaaaaataagcttccggtccagttggcaataagtcaatgtccgaagatcgaacggcctcgccaagttgctgtgccaaggtctgcatgaccgccgaaaaaacggcttcaattcgagtaccggttttaaccggtccaggaatgcgcaaagtcacgtgcaagagcgtattggttggtgcagccaccaacaacgctcgctctttaaccacgcgagcatctttggcagccagcatttgaccaagatcaacttgcggaccatttaaaatggttaatttaaacattgcgaaccacatcgatcaaggtgccatcgcgatattcgatcaaagcgaccactttatcgccatattcgatggcttccggggtaccagtaatttgataggccatctttttcagatcttcaattgaaaacagcggcactttcagatttttaaacatttcaatcaaatcagtccgtgctggattaatagcgacgccgacttcggtcacgacaacgtcaacactggcacccggtgtcacaacagtattgacattttcaacaatcgttgggatccgaccgcgaaccagtggcgcaatcaccatgctcattttgcaggcagcacttgtgtcactatggccaccagaagcgccacggataatgccgtcagaacccgtgatcacgttaacgttaaagttagtatcaatttccagtgccgataaaatcgcaatatctaactgattgataactgcacctttgcttaacggtgacgcgtacatattagcatcaatctcgtaatgatctgcgttctcgcctaatgaaaccgcagagggatggtcaaagtcctgcacatcgataatcttttcgacaaggccttccttcaacaattcaaccattgaattggtaatgccacccaaagcaaaactagctttgatgtcttggtccaacatcgcttgccgcagaaaacgcgcaacagccagcgaagagccgccagtaccggtctggaatgagaacccatttttgaagtaggccgatttggtaatgacctctgccgcatactccgcaatttttaattccttcgggttcttcgtgaaacgggtcgcacctttggcaatcccagttggatcgccaatcgcatcaacttgcacgacatagtcaacgtcggtttgcggaatgctgattggcgtattcggatatggcattaaactgtcagtaatggcaacaacttgatccgcatatttcgcgtcaatcatggcataacctaacgagccacaggtcgccttaccttttgtgccgttaatgttgccgtactcatcactgctaggggcaccaagaaaggcaacgtcaatatgaatatcgccacgagcaatggctcgggcccggccgccatgtgagcgaatcacaactggattcttcatgataccgcttgaaattgctgctcccactttgtcgcgcaagccggaactggtgatgttggtcaccacaccgtttttgatgtgctcaatcaatggttcatgtacattggcaatcgaacttggcgcaattgacaggttcttgatccccattttggcaatctcagctaggaccatgttcatcacatagtccccttcacgaaaatgatggtgaaaagaaatggtcatgccgtccttcagtccagttgccacaatggcatcgtgaattgacgccacgagtttgctgtgatccggcttaaccgggttgatgtggcgggcatgttcatcataaggcttaatgttggcaaactcgccgccataaacaccgtattgatccgcatatggttctgggatctcacggttgagtgtattcttgaccatcagtctacctccattcctgatgcctttgcgagcgcgatggtatactgtgcccgttcgacaactggcttatcaaccatctgcccgttcacagaaacaacccccgcgcccttagcttcggcttctttcaagccagcaacaatctcacgtgctttttgaacttccgccaaagcaggggcaaaaaccccattaatgactggaatttgccgtggattgatgacggacttgccatcaaagccaagctgtttgattaaggcggtttcgtggcgcaaaccttcttcgttatccacttgtgtatagaccgtatcaatcgccgcgatgccagcttctcgcgcagcatgcaggatatagttacgggcaaaagacaattcagcgccatccgtcgagcggtgggtatgttgactcgtcagataatcttctgcacccaacgcaatcccaatcatacgtgatgaagcttgtgcgatttcgcgagcattcaaaaccccttcagccgactcaattgcagccatcatgtgcgtggtgccattttgaatgccgtacttctcttcaactgctgtgatgacagcatcaacatcaataatgtcttgagcagtttcggtctttggcaggcgcaccacattaatgccgccgagaaccatcgcttcaatatcttgatccccgcctgcatctaacgcattcacccgcacaactgtttccacgctactgtaatcaaaggtcttcagggctgaataaaccagcattcgtgccgtgtctttttccttcaaagaaacagcatcttcaaggtcaaacatgatcgcatcagcaccataaatcggagcatcacgtaacatgcccggattggcaccaggcacaaacatcatggttcttcttaatttatccatgcgttgatctcctcccagtcaaacgtcttattgtcagacgcacgataaacagcggcgatcgtccgcgccttgatggtacaatccaaggcgcctttgtcattcgcgtcaacggcaacattttcgatccctaacttggccaaggtggcctcaatgactgatcgaatttgatgaccaaactgtttttctacactgctttgcagttgaatggcgaccccactggtagccggtgacaaggtgatttgaatatcacttgattccagcgtaccagcagtcgcaggatgcttaatttccatgtgtcgatcgctcctttatttcttgataaacttctggataaaccaattgctgcacggttttccaatcttgttgtgccattgccgcgcgaacacgggtagcactaacaacatcgccgtcaatcatgagccgcggcacgacgatcagttcaatcgccgaaccaaatgttgccgctagttcccgattgtaaatggccgttaccggcgacagcggttcctcaccgacatagcgacgagtaatccccaatacgggtgcaattgcttgtttaaaaagcgcagcatccagccgagcttggacagcagccacatcggcatctgcccgttctttgagaaaataactcggaaaagtagtatttgagaccatatagtcattggttggcaacaccacgacgtttggccagcgagcggcaacttttctaactagcgtcaaccgctcatcagctgcgaacaaagaccgttccgctgacaggacgaaaacataaacaactgggttggctttggccgccgtctcaatcagataggcatggccacgcgtaatcggattggcattcatgacaatcgctgccgctggtttttctggccgccgctgcttttctaacgaagcaacataatcggtcaagttgggatatccccgctcaagtaacacaacagcatcggttgctgccagctgcttgaagcccaatgacaggaaaaatttaacggtggtcggtttggtatagacaaagctatgggtcacaccatcatcgtcaagccgatccagtaatgcctgaattacctgtgccaacaagttttcatgctgggttgccggtgtaactgccacttccttgatgatgttaccggaaagcgaaccagttgccagtaacgtttctccttcaaaaataccaactgtatagtcaacctgacgatccgaagctaacccggcagtcgtcagcaaggcttgccatgctgctgcttcttgcggattcaatgccagccagattcgttttaaagttgccatgttacttcgccgcttttttagctggggcaaatttcagtaataacttcgccacgatataaataatgaataaaacgatgaaaacgccgcccataccgatcagcatcaattcacccgcttgttcaacggcaactgggtcaattttcatggaagtacctccctttttaacgtgctcaccagcgcagtaacgtgcgtgggtctaaacgcgatctccagcccagaaacctgcacataaggacctcaagccaaactggccaagacccagccagtttggcttgaggccacttatgctccggtttctaaccgggctggctcacgctcttatgcgccaaagaatgatagtaacagtccgccggcaatgacagagccgatttgaccggaaacattagcgccaacggcatacatcaaaacaaagttctgtggatcttcatcggttgccattgtttgaatcactcggctcgacattgggaaagcggaaatgccggccgctccgatcattgggttaatcttatctttacggaaaagattcaataatttggcgaacaatacacccccgacagagtccatgatgaaggcgaataatccaaaagcaatgatcatcaacgtttgaatgttcaagaattgatcagcttgcaatttaacggaaatcgttagcccaagcagaatcgacacaatattgaccaattcgttttgcgcggtgttagacagccgatcgagcaccccacattctcgcagcaggttaccaaacatcaggaacccaactaacggtaaggaaatcggggcaataaacccggcaataatcgtgataatgattggaaacagaatttttgtcgtctttgaaacgccttctgccttataagtcatccgaatccggcgttcatgctttgtggtcactgccttgatggccattggctggatgatcggcaccaatgccatatacgaatacgcagcgactgtgatggcccctaacagatttggcgcaagttggttcgaaacgaaaatcgaagtcgggccgtctgcggcaccgatgatgccaattgaagccgcttctttgatattgaaaccgaagaagacagcaacaaaaacggtggcaaagatcccgaactgtgctgctgcaccgaacagtagcataaatgggttttgtaataacggtccaaagtcgatcatggcgccgatcccgatgaaaattagcagtgggaacagttccgtattgataccggctttgaataaaacatcaagcaccccttctgctttggtgccgccaacaacttgggtcaagacgcctgttcctggaaagttgaccagaatggcgcccaagcccatgggaactaaaagggttggttcatattcttttttgattcccagatacatcaggagcgcgccgatcagcatcatggcgatttgacctaatgtgatcgtggtgattccgtgaatgagcgcttccatgccatccctcctccttaaataatgctgatgagattgtcgccggaattgacattctggttaagtgttgcaaacacctggccgatggtacctgccttaggagccacaatttcgttttccatcttcatggcttccagaatcatcagcggctgattttccgtgactgcatcaccgtctttaaccaaaatcttggtgaccgtgcctggcatcggtgcagtgacaacttcaccttccccagtcggcgcaaccggagctgcaggtgctggcgcagctggtgcggccggtgccggtgtcggcgttgccgctggcgtagctggtgcggccggcgcaggctgggcggctggcgcaccgccaatttcttccatttcgaccaaataggttttcccatcaatcttgatcttgaattttctcaacatcttcttcattccacctttttcttgattgacttgaccacataattggcatggccatcaccagccgcaatggcgctggcgatcaagccgacgcgttttgcttcaggattctcgacatacagatgcttcagcactaactgcgcatcaggagctgtatcggctgtgactgctgcggcaatcagactgacggtcagttctgatgccggatcaacagctaaatagtttgggacatcaatccaatcatcatcaaccggcgcggccggtgctgacatttggggtggcacttgttcttttgtagacggtgtttgctttcgtcgccacagccaattaaacatctggacacctcctcgcaatattttcttgttgataagttatatagtacggggaaaagccaatcatgattggcttttcggtgtatttttcagttaggacgttatttttgcggcaggtagaatggcacgtgaccgaataacatcaccgtgacaacgaagatagcgaacacacctaacgcatatttaccagcttcgcgctgccatttacccatgtccaaaccggtcaaccggagtaacagatagatgaaggcaactaatggtgacagtaagtggaacgcctgacccatcaaggaagccagcgccatctgcatgttggtaaacccatatgctcgaccggctgtagccagaaccggcatcactccgaagtagaagccgtcgttactcaggaagaaggtccctggtgctgaaatcaaagcaatgacaaggccccagaagccagccaatgaatcaggaataatggaagtgaaactcttggccagcgcttcggccatcccagtaccttggaacagacccatgaagacaccagcagcgaaaacaagaataacaacttggacagcatcgccaccgttggcaccgatccgcttgctttggtcgcccagtttcggatagttgaccattaaagcgatacaggttccaactaagaacaacaacaatggtggcattgcaatggctttaatgaaggaacttgcaaccaaccaagcaatcaagacgattgtcaaaataccattgaaaaggaataagttcgggcgccgaatttcagaaacttctgggtcgacaacggaagtcatttcatcgatttcagcatccgttaactctcggacacccaaccgtttccgttctgctcggcccatgcgcggtgcaacgtagaaaacaacatacgctaaggcaagaatcatacctggcaacagataggtcagaatatcagcgtcaactttcaacacggccattgctcgggcagttgggccgccccaaggcagtaagttcatgatggtgttctgcaaaataatcaaaacacctaagttcatcatgttcatgttgagctttttatagattggaataaatgcggaacagcagatcaaagttgtcgttgtaccgtccccgttcagtgacacggccatcgcaacaatcgcggttgccatcaagactttcatcggatcgcccttcgcgattttgatcatccgggcagtgattggatcaaacaaaccagcgtctaacataattgagaagtacagaattgcgaataagagcatgatccccgtgttggcagttgttgtgagtcccttcaacacgaaatcgccgatcgtacctttattagccaccccggccaccatcgcaataatcgcaaacagcagggggatcataaccaaggaagtaaatggtgaaagtttcttagtcatgatgacatacataaagaccacgatcatggcgtaagcaatgacggtgagtaacatagtcccaacctcttttcataagtttttgtctctaccgtcatagtacgtgattatcgtcacgaaatcgcctctttagcccgtttagaacactaaaagaacaatcactgatcttccgataagaaaaatgtcaaggaaaagagaaaacgcctccattggcttaaaattagctttttaagtcaatggaggcgtccatcagttatgaatcatctttggaaaaagataatgctggcgtgatgttcatatattcacatactactaatacagacgcttaattctgtatcagtctaccagtcttggaaacgttcttcttcgagcttttttaacaactcctggtaatttttccgcgatggtgcatggctcaaggtcgtctgttgcagctcattaaatcgctctgctaagtaatatgcagtcagatagagcgtcagttttcgcttgacgatcgtctctggatctttgtcgtcaggcacttggtgcgattcaacaacaaggttcgcgaactgtttcggatttaaccgtaaatcatcgggttcatcggctttcatcgtgatacctcctttttaagtatgcctaatactaacataaaaaaacgaccgtaatctgtcattgaaaaacattttacggtcttcgaaagtatgaagttagatgatgtaaaaatcttgctggcagctcagaaacaagccacacacgactgctcgtgggataaaagaggatcccgtttttggctgcatcacgggcggcaatgcgataaataactggatgagtgtcatgacgggcaccgacttgctgagcagtggcgacatcttcagacagatgcacaaaatcccgattcatcggcagtaagccttccttagcaatcacagtggccgcctgatgtgaggtgccatgatacagccaccgcggtggttcagttgctggtgtgagcggcatgactggcacactgtgaccgtaaaccgcccgaatcgttgttccttccaatgcaaatcgctttttagtgctttgtgccataatagcttgtaagacttggcgatcaagatgcatttgataatgcgcattgaagcgtcgcaccaatgttttccaatctgtccgaccatactgatctaacaccaagcccaatttttctggatggtggcgcaagagcatgcttaacgtcttgctaatcttgactaatcgcttatccatcattgtcagttcccttttacaccctttaatcttaataggagagaaaacgatgaaactgcatttttcaaaggcccaattgagcgaccttgatacgatcatgactatcgaaacagcaggatttacgccacaagaagccgccactagaaccagcatggcagcgcgcattgccaactatccggacaccttcattgttgcccgcgctggtggcacgattgttggttacgtagtcgggccagcaactgatcaaccaacgattacagatgatcttttcagtactagtcagcccaatcggcccgatgatccgtacatcgctgtcttaagcctcgctgtatccccgcgccatcgtcatcaaaatgtcggctctcaattacttgagcaactaacccagatcgcacgtacacaaaaccgccaagcgatcaccttaacctgtctacaacggttgatccctttttacgaacatcaaggctttcaaaatgaaggtcgtgctgcctctactcatgctggcgaagtctggtacaacatggttaaaaagatgctctactgacagccttcctcagcttattcgggattcagatgtttgcgcaacaccggggcggtttcgttgaccagaaaaagcgggccatctgcctgcgccggaaaactcgtagccaaaccgcctagatcaaacggttcaaaaccaatcgtccagattaacgacgccaccacttttttcgcctgttcatcgtcaccagcgtacggtaccgcaatccgatcaactggttgttcaggttgtgccagcctagcgagaacggtcatcccaatcgtattaaacgctttgaccactttacttgattgaaaatgctcggcgacgatctgagacgtcgtttttttatgacgttcaatctcagcaatccacgcatcgcgatcaggaaaataattggtggcatcaatgatgatcggatcttgagccaatggttccggtaaagccttaatagccaaaaaaggcactgccaagacgacaatttcttgtgcttcggcttgttcaactgtgccagcttctgctcctagaacgcgcgctaaatcctctagcgcatcgactgaaccccgatgtgcgatgacaacttcattgcctgcttgcacgaaaagttgcgtcagaacctgtccgacattgcctgatccgatcataccaattttcatccgatatcactccaccctgttattattttcattatatcgcgacacctcttttcagggcaaataagccttgtttttttatgtatcggcttttccggtttggctttgactggatgtcaaacgatgctcatgctggtgacgctgagccaatcacttaagatcagttaacaaatagttttcaggcttcaactattttgctttacatactagtcaacgctctttatactactagtaggcaatacatattagttgggaggtacatgtgatggcaacagataccaatagccaaatgctcaaggggattcttcaaggctgcctgttaattctgctttcccgagaagagctttacggctatgccatcagtgaggcgcttaacgattttggctttgttgatattcccaaaggcacgatttacccactcctgatgacaatggagaaaaaagggttgttaatcagtcatctgcgtccctcacctgacggccccagccgcaagtactacgccgtcacagcagagggtatggctgcgcgtcaaacttttcaacagcagtggtcacaactgaaagaccatgtcgatcagctcatcaacgaggaggacaagccatgaaacaacggaaacaggaaacacagcgattaattgatgaaaatgaccaattacgaaaacagcttaatgtggaaagtcgccattattatgaagacttaatcgtctatatgcgcgctcatacgctgtttcgcgatgaccatattgttgaagaaaacttaatggccattcttcaagacttgattgatgcacaacagaatggcatggatgctgaaacgtactttgggaaagatcccgcgcaaacggggacagagatgctgaaagcaattcccataaatattgttgactttgtttggtttaatttgaagttaatgatgatgttaatccttctcacgctgctgcctagcctgacaacttccgaggtaaagcttgatggtggtaatcttctatttgtgagcatcatcattttgatagcgacatggagccttctctggatagtcggcagtaacgcattcatcacaccatcacgcactcaaaaagtaggctttttcattggtggcggtgccatttttgctggcacagtgggattgcttttcttttttaaaacaagttggcaactcacaatttcaccgcaaatttcgttcattctaattgtcagtggcttgattgttggtgcgttgctaccgttcttctctcgccccactggaatcaagttgttcctttacttttattcgatgggttatttactacttggtctgctcgtccatttaccattcacccgcaaaattatgacggcaaaaattcatttaggggcttaccagtggttactctgggttggtctggcaatttttgcaattttgataggactagtttcttggtggttcattcgccgagagcgtaggcatgatccaaatagataagatgccgtgattaatttcgtgacgaggcaagttgcctcgttttttaatgtaaaatagccttaatcccaatcaacccaaaggagtgacccccacttggatctcaatgacacccttcgtcaccaactgcaccatcgttccatccgccagttcaagccgcagcatttaagcagcgccactattcgaacattgctggatgtggcgcaacatacagcgacctcaatgtacttgcagttgttttcggttattcacattatcaatcctgaaattcgtgcacaaattgctaaaatcagcacgcagacctatctgaatggcaatggtgagctgttcattttcatcgcagacctcaatcgcgttgcgaaactgacagcagctgctggtcaatcactggatcgtcttggccgaatggataagtttctgcaggcgagtgccgatgctacacttgccttacaaaatatggttgtcgcttccgagagtcttggcctcggaacagtaacccttggcagtattcaaaatgatgcgcaggccatgattgagctgttgcatctacctaaatacacctttccactacttggtctggcgattggttttcccgacgatgatccagacgaaaagccacggatgccacagcaattggttgctttcaccgaccactatgatgaacctgtcccttcaccaacagccatgactgactttgaccgcactgttagccactactacgccactcgccgcggcgatccgcgcgaagaaagctataccgatcttgcgattggcgctgccagcaccacaccggcaaaacgcggtgatctcttcaaagtcttaaaacaccaaggctttttcccggaaagttgatctgaaacttatcccactgccgataaaatcctgccgcacaggctgatacataattctcagccaaacaaaaataaaggaacactttttcctgcaaaatcggaaaattgttcctttttgacttctcgtggcatatttagtgcgactttaaagaacgtagtgccaaggcggagcaatcgtaggccagatggggctcagccgtgcaaacaaccgtgaaattgttgttggcggtttaccgcctacaacaaggccagactttgaaatcgcgcgggttttgcgcgagttcaaagctgtgcccacggcgttccagcccaatcgccgcgtagccaactcggacttacggtgttctgacgcctaaaatagaatcagattgcgctacagtttcttccactcaagctcttttgctaccaagacgcataagtgataagatgttataacgattatttagtaaccgttaaaggggatgacgtcgtggctgagaacgaacaagcaaaagagcagacacatttgacaggcatcatgaaggagctctccggtgccgaaagccgtctttcaaaagagatggctaagacaaagtctgaagagaagaacatcagtgacaacttcttcaatgatttttccttgaacttcaccgactacgctgaaacgattgaaactgcggcctcaatccagcaacagcaacgcgtgcttgatgagcgaaccaatgcgtggaagcaaagcgcgcagcaactcgcgactgttaagcggttgatgggcaatccgtattttgcgcggattgatttccaagaaggccgggaaaagccggagacgatttatatcggcttaggttccttcaccaatgaagctggtaagtttctcatctacgactggcgcgcgccgatcagctcaatttactatgatggcggtttgggcaaggttacctatcaaacgcctgatggcccgcaacaggtcacggtttctttgaagcgtcaatttgtcattaaaaacggcaaaattcagacgatgttcgataccaccgaaaccatcggcgatcagatgctgctggaagtgttaggcgaaaagtcagacacccaaatgaagacgattgtgaccacgatccagcgcgaacagaaccagattatccgcgacaccaaagcggacttattgtttgtgcaaggcgcagctggctccgggaaaaccagtgccgtgttgcagcgggtcgcttatctgctttatcggtaccggggcaacctgagtagtagtcaggtgattatgttcagtcctaaccaacttttctctgactacatcagcaatgttttgccagaacttggcgaacagaacatggtgcaattcacttattaccaatatgtcacgcgacggttaccacacattgatgtccaaaaccttttctctcagttcgagcaacaactaaccccagttcaaaagaaaattgcacgtgtcaaaggcagcttagacttttttgagacagccaagaaatatgcgacaagtcttgaaaaatcaggcttgcgcttccgtgacattcgcttccgtggtgaggtattcttttcacgccggcggattcatgaaatcttttatagctacaacgaaaattatcacatgggcaatcgcctgaccgccaccaaggaacggctgatcaaaatgctcaatcggaaaattgaatccgaaatgaaatcgcagtgggtgcaagaagccgttgaaaatctaagcggtgaagagattcgctccatgcagcaagacggcccgaaagagtttaagaatagtgatgacgaatatcggttcttcgcccgccaactggtgatgcgtggcttcaacgaaattcaacaagatattgtccgtaatcgcttccttaatattcgcggacagtatgttagtttcttgcgtgaagtaccagctatttatgacctcgaagccgagggcattagtgctgatgactggcaggcagaagtcgatcattttattaccttatttaaggaacgccaactaccaatggcagacgcaacgccatatctgcacttgtatgatttgatcactggtcgccatggtgaacgcgagatgcggtatgtcttcattgatgaaattcaagattacacaccatatcagctcgcctacctcaaggacagcttcccgcgggcgaagtttacgttgctaggcgatctcaatcaggctattttcacaaaagacgattcgcggacgctgattaacgaaaccagcaagctgtttgatccagaaaaaacccgcgtcgtgcagttaacccaaagttatcggtctaccaaacaggtcaccgactttacgaaagcgattctcacatctggtcaaaaaatcgtggcgttcaatcgccaaggaccattgccaaagttggtcgttcgtccagatgaagccgggttgatggcggccttgcaggatcaattgaaaattaacaatgaagcgaagcagacaactgcggtcattgcgaaaacgctggaagccgcagaagccatttatgaacaaatgaaggcggctggcatcaaagtaactttgatcaagtctgaaaatcaacgactcgcggccggcgtcatcgttgttccaagctttttggctaaggggctcgaattcgatgccgttgtgctttggcaaatcaatgcggccaattaccatgaagaggatgaacgtgagttgttatacacggtggcgtcccgggccatgcatcgactaaccatgctggctagtcctgatgtgacgccgttgttagacaaagtaccggctgacttgtacgagcgggggtaaacagatggtcaaaatgcatgacaccttagctgtttctagttatcgtgtttttccaggtatgatgaatgcgcatcagacattgtttggcggtcagatctttacttggatcgatgacgtcagctcaattgccgcacaacgactcggccgccgtggtttagcgactggctcattggacatggtgcatctggcagcaccggttaaaatgggtgatgcactggtcattaagtgcatggtcagcggcgtgggtcaccgttcactggaagttttcattcagttaattggtgaacatctagccactggcgaacgcttccaagtcggcaccgcctttgcaacctttgtagcccgccacaaagaagacggcccactgccgccggtcgaagcagaatccgagtttgaaaagcgcttgctagccggttacgatgaacgacgcgccgactatcggaaaatcaatgctagcttcggcgaggtgccgttggattgaaagcttggattttgaaaagtttaaaaaagatcgtcagtccagagaccagaacagtttgactagacgcgccattaaaatgcatgataaatgagtctgtaaaaaggctaccgttttccagtcgctagcctctatgaaccaacaacgccgtcaacagcggctcggaatttacaaatagccatcccaaggcggttaaactttagggatggctatttttgttacttgttttcgggcacgcttggcaaacccgttttcgcgcggtaaagtaaaccataaatcaactcccgcacagtgctgcacatatgcggattcattttgaaagaaggacgattattttggcaaaacgatatgtcggttcatgtaccacggtgcttgttggcaagaaagcttcaattgatggctccacgatcattgcccgaaacgaagacggtgagtcaccattgcatccgcagaaattcgtgtacgtgaaacctgaagatcagccgcgtcactatcaatccgtgctcagcaagttcgcgattgatttgccggccgatcccttgggctacacggccaccccggaagcagaagacggccacggtatctgggcggcagcagggattaatagcgaaaatattgccatgacctcaaccgaaacgattacaaccaatagccgtgtccttggtgttgatccgctggtggcagcggggattggcgaagaagacatgccaacgatcgttctaccgtacattcatagcgcgcgggacggggttcaacgcttgggcagtttgcttgaacaatatggcacatacgaaagcaacgggatcgcttttgctgacaaagatgaggtttggtactttgaaagtattggcggccatcattgggcagccatccgaattcccgacgatgcctatgtggtggcgccgaaccgtttcaatatcaccgatttcgattttgctagcgatgacacgatgagtagtgccgatctgcgcgatctgattgaaacctatcacctcaatccagatgcggaagggtacaacttgcgccacattttcggctccgccacgatcaaggatacccgttacaacaacccacgtgcctggtacggtcagaagtacttcaaccctgaattcgatacgacaccgatcgatcaggatctgccattcatttgccggactagcaaaaaaatcagcatcgaagacgtgaagtttgtggaaagttcccactatgaaaatacgccatacgatgtttacggcacgacaggcaccccagcacagaagaagctttatcggccaatcggcatcaaccgtaatcaggaactgcacattttgcagattcgcaacaatgtgccagctgcagttgccggcattcactggttggcatttggcccgaacacctttaatgccgttgtaccgttttacgctaatgtcaatgacacaccagcagcataccgcgaaaccggcgacaagttcgatgtgacgaaaatgtactggctaagcaacctgttagcaacgtttggtgactacgacttttcgttatttaaagatcaggaagatgtttttgaacaaaaaacagtcgccgcttgccggcacttgcagctcacaactgatgaagctgtcaaagatgccaaggatattgccgatcatctgacagctgccaatgagcagatggcaacgatcgccatggccaacagcaatgagttgttaggtcaaatggtggcggcagcagcgccaaaaatgaagttacagttcaccttgcacgactaggtgatgactggcaccaattgaaggcaaacaaaaagcgcttgatgaagagcgctctttgtttgcctatttttgactacgatggcgataccgattaaattgggtggtcgcgcgaattaagaagagtggcatcaacactatcaataagatgccaacaaagacgataatgccggccgtggtgcgaaaccgtgcgaggacaagcagccagataccaaagccagtgccactgacacaaaaaatgaccagtaacacataccatgcccagtaccaaaacggcgatggactgcggcggaatgttggcacgaggaaaagggccagcaaaatcgataaaataaattttccaatttggttaagcattcagcgtgcctccttggatgttaggcaaatgcgtacttcctcaatgttaaagttcctgataaggcttttcggcattacgcttggccgtccgaatatgacgcaactcgcggatgtaagccccatatttgatgatagcacgcacgattaagccgaagccaagcgagaaaatgcttagtccgacgatgatcgccaccccacaaaccggtgaggccgtcgcggattcgaacaacaaccagccgccaccgcctgcaatcgcgctagtaaggatgagcgtgatgatcagtctgagtgaattggatcgtaaggcacggtcttgtttaaaagtgggcgctaaaagtggggcaattacgccatctaaaatcggttcaatgaaaaaggaaaggagaaactcgcctactagttcaagcattgctggcacctccgtcagtgttcgagctggcatcgcgtcgttttgataggttgattgtgaagatttttttctttgttgtcaagaaaaggattggccgaacaactggggctttctatgctaaaatgagaacattaaacgcaaggaaacggtaagttatgcaatccgaaatgaattactataaatttgatcgtgcagaatggtcgcaattccattcccagaacttcaccaatgtcactgatgaagagttggcgcagttgcgatcattgaatgatgaaatcagtcttgatgatgtcaaaatgatctactcaccattgcgacacctgattcacatccgctatgaggattatcaaggcgatatgttcaccttgagccgctttttagggatgcaacgaaatccgcacacaccattcatcattggtattgctggatcggtggcagttggtaaaagcaccaccgcgcgcttgctacaactgttgctgagccgggcttatccggaaaaacgcgtgcaacagatgacgacagacggttttttatatcctaatgctgagttagaacgccggggtattctcgatcgtaaaggcttccctgaaagctatgatatggaacttttaatccatttcatgaacaacgtcaaaaatgcgagcggcgctttgcgtgcaccaaagtatagccaccagatttacgacattgtcccaggcgaatatgagctgatcgatcgaccagatatcctgattgtcgaaggaatcaacgtgctccagctgccaagcaagcagccaatctacgtcagcgactactttgatttctcgatttacgttgatgccaatcccgacctcattgaacaatggtatctggagcgtttcggcatcctgctcgacacggccttcacggatccgaacaactattactatcaatacgcgattggcgaccgagccgatgccttcgcaatggcgcggcaagtttggcgcgatgtgaacctcaagaacctgaatgagtacatcctgccaaccaaaaatcgtgctgatattattttgcacaaaacaacgggacatgaaattgaccaagtttcgctgcgaaaatggtaagatatggctgataagtcagttgaaaaacagctggctagcagtgtcggacacgccaggtttttctgaagcttatcgctggcaacgcttagatgagaggcttctcacccatgattgaccgacatgtgaaaactctgtaaaattagtgcattcaaacaagggagtgtggcggactgtggcaaatgaccagaacaaggattacgacaagatcatcgtcctcgattatggcagtcagtataatcaattgatcacccggcgaatccgggaatttgggatttactctgaattaaagcctcatacgatcacggcagcggaagtcaagaagattgcgcctaaaggcattatcttctcaggcggccctaacagtgtgtatgacgaaggcgcgttaggtgttgatgaggatcttttcaagctcggcattccgattctgggtgtctgttatggcatgcagctgatggcacaacggctcggtggggatgttgaaccggctgataaccgtgaatacggcaaagcggacattgaagtcaccgatgacagcgccaagcttttccgcgatttgccaaaagatcaaaccgtctggatgagccacggcgacctcgtgacccgcgtaccagaaggcttccggcgaactgcaaccagcatcaactgcccaatcagtgccatggatgacgatgatcgtaaattctacggtatccaattccatgctgaagttcaaaatacgcaatatggccatgaaatcctccaccattttgccttcgacatctgcaaggctgaagccaactggagcatggacgacttcatcaccaaacaaattgacaagatccgggcagaagtcggcgacaagcgcgttctcctcggcctttccggcggggttgattcatccgttgtcggcgtgctcctgcacaaagccatcggcacccagctgaccagtatttttgttgatcacggcttactgcgtaaaggcgaagccgatcaagtcatggaaagcctcaaaggcaagttcggcctgaacatcatcaaggtcaacgccaaagatcgcttcctcggcgacctcaaaggggttactgatcctgaaaagaaacgtaaaatcatcggtcgcgacttcatcgaagttttcaatgaagaagcagccaagctcaacggcatcgatttcttagcccaaggcacgctctacaccgatgtggttgaatccggtaccgacaccgcccagaccattaagtctcaccacaacgttggcggcctgccagaagacctcaagttcaagctaatcgaaccgctgaacaagctctttaaagatgaagtccgcgaactcggcgaaaaactcggcatgccccacgccctcgtctggcgtcaaccattccctggcccaggcctcggcatccgcgtcatcggcgaagtcaccgaagataaactcgaaatcgtgcgcgattccgattatatcctccgtgaagaaatcgctaagcatggcttggacaaggacatttggcaatactttaccgtcttgccaggcttccgatccgtcggtgtcatgggcgatggccgaacctacgattacaccatcggcatccgcgccatcacctcaattgacggcatgaccgccgacttcgcccggatcaactgggatgtcctacaggagatctcaagccggattgtgaatgaagttaagaacgttaatcgggtggtttatgatattacttccaagccgccggcaacgattgagtgggaatgaccggtagcaaaaattaaaaaagctaagcttgggtaaaacacgtttaaaccgtggttcccaagcttttttgtttgccatttttgttttttaatatcgtgcaagtgttccttatttgtgggagattatatgggatattttcaaaatcaaaaaatcccatatagaaattaaagaaacttatcaatactattaaaaacatttagactagcggcttttgttgaacgggtgtagtctgctgtcatttgaagattcttatgtcctagatagtgcatgacatcaatttgtggtttgttggcagcaatcgcttgtgttgcaaaataatgcctgagcaaatgtgggtacacttcaactccggacctattgcttactctccgcatcaatcgattgagatgggtggggtgcaacgggttaccatcattgttaagccacagccaatgtttctcagcttgaatatggttcctctgccttagattatcagccgtaatcattgcgtacttcaaataatcaacggttttgccaaatgcccatatggttctgtatgatgatttggtcttgagtgggccgccattaagttcatttgtgttgcgttgcatgtcaatcgatatttgcgcgacatcggcatcgttgatttgatcgtgggatattttgatggactcatttcgaagacccatcacttctccgcggcgaagtccgagcgttgcagtgatgatcaaggccatttcgtacttatccagagttatctttgctgcatttagccacagttcaaatgaatgtggttctaagtccttatttcgaggggatttcccattgatctgcatacctcgaagccgatttttgtcgatgacatcctcaaattcagcagcattcatgatgctcttcatgacagcatcaatagtatgaacagttgttaacgctagacctgattgtgataactcatcgagaaaacgctgatattttgctcttgagacatcttgtagaggagttttaccaaatgccggcttaagatactttgaatagaagtttccgttcgctcttgctgttgattcacgccagatacccattttcatttttcgttttgccatttgctggtaatattgatcaacggtcattctgttagccaaagatcccgatacttcaccgctgacaagttttgcctcaaattgtttgatttcaatatcagcatcttgccaatgaatgaaaccagattttgagaactcttttctttctcccatagcatcatcataggttcgtctgactccaaacttttttcccttcttggtttggtattcatacaccccgggatggcgtttgtatggtgtccattttggcatgataatacctccaatttgtctattaagttgattgatttgtacataacttcaaacgtatgttcgttttacctttaaaataaaaccccaaaattgggggggtgaatccaattcatctttgctataattagatgaattatgtttacttgtaacatggcctttatggtctagtcgtcagggtgttgcacttgaattgtaaactggggaccattattcttattcatccttgatcaggacgcttgctccttcttctttcgtttgaaaacaatgacgagtagaagcgccacaatcatgatcaggaccgcgacaacagcaatgagtgcatacaattgccagctattatcctttttaatcgagacatctttttgattcagatttttggccactttatcggtaatcgtgaattgctttgtcagcgtccagtgatcatggtaatgctgtttgccatcagctgttttacgagtcatcccgccatctgcctgctgattgccatacacctcaagatgagcaacatacgtacctggcttaagcgtcttgccttctaacgcaattggaaaatcgaaggtcgtgtccggcgccatttgcaagccctctttagccacttgatagacagatttatccgaacctttagccgtaattttggcatcaaccgccactttgttgacgaacgtcgcggcatcgttttccatggatgccaagatcacattgcggtaattgatctgactcggcttaacatcattcaatttcacatgagccgctacctgatcagtgctttgttgcatcaataagccaatcacgtaggagaagcgattgttgatggcaacccctttacctgcatcttttgcagcttgatcgcctggctgatgttccttcaaggtaatgccgcctgccatcacgccatggagtggtttgcttggcatggtcacatcaagatttaaaaccgtgctgcctttagcggggatcttgacctgagctggcgttttgacataatccttcatgttaaaggcaaggcttttcgctggcttgatggcattttgaccgtattcaaccacgccgttaatattcgtcgttgcactggcaatgccaacatccacagccacctctttttctgtatcatttcgcaagtcaacatgcagggcctgcttagcaccttgatccattttgatgtcaaaatagctaacacctttattgacctgattgtccggcatctgggccttggccgcaaagttcaattctgaggcaaaaacatgggctgcaggggtcatcaacatggcaacaaacgctgctatacagaaaattgtttttttcacaaaggatctccttgtcttttaagatgtgatcggtcatgtctattcaagttggaactagatgctagaaaatgtatgtgcgctaacggaaaccaattgcgtccaacattttcggagaatcatgagcttacttgttatctggtgtatccgttaaagtccaggtgaatgttgtcgcatacttttcagcgtatttcgtcgtggcgcccgggacggtcaattcaacgctgcgtgccgcatcatcggcatctttgccccagttcaataggtgcgtgccagtacctgacccagttttagcgttcatcaccgtttgctctgcgcccggcaccaaggtcatctcggctgtaccatcagggtgtgctgcggtggaggcggtgaccacatgcccattcttaagccgaatttgtgcaccagttaattctttcccgctaacggacgtgagttggtcattttgcttcacaactaatttccaaccggcttcggtgccgcgattatcggtgacctgaacaaagttgggtcccactttttccgtacctgcagcatcttgatatttttgtgctgctgcaaagtaagtcttggtttcagaagtgatttcttgcttgccaaaattgaagctggaagcaaaatcaatcgacaatgggccttgtgtccctggttgaacaaccttcttcggatcctccgcatcaattgtgtggccgttttagttggatcaagcggatcgactggttttgtcactttttctgttggcttaaattcgattgaaccgttcgtgctgtacacaccaccattagtttgggcagcgagtacggtcgtggcattgacggccatggtacccatggctgcagcggctgctaataaaacaaattttttcatcataacactccattttttagttttcatcgtgcatctttgtcaggtgccagcaatctttgttgtcagtgatgacgctatgcgaagctaatgatctttgttggtttgctgctttggtgctaagttcccccgaatcactgttccacgttgatctttagctttttggtgacggtgttgtgttggttggcgttgattctaacgtccaggtcaattcggtgacatattccttggccatcttcggcgaagttccaggcaccgccaactcaattgacttggccatcgtctgttcatccccgaatcgataaatccaagtgcccatgccctgatctttagcagccgcaagcggtgcgacctcagcactgcctggcacaagcgtgatttccttttgaccagtcggcgcatactgctgatcaattgttgatgtcacatttccattcaagtacttcaactgagcaccggttaattccttagtgtcatcatctttaactgaaaattgtttttcttgcttcactttcaatgtccaaccttcaaacgtcccgcgcttgtcggtcacctgaacaaagttaggacgatccacggtcttgccgtcatcctgtgagaaaacttgcggcttcgcatagtacttagcatcgtctgcgctaatcattgcttcgccaaaagtaaaactggaagcatagtccaaggatagtggtccggtggtaccattggttgccgtgccagttgggttggtcggattagtcggcttacctggcttggtgtcgcctggatcaagcggattctttgctggtgtccgggtgacatcggttttaaacatcacctgaccgtctgatacaacttcagtcgttgccccaactattgagactggcatgctgctgagacgaatcagggttaaccctgccagtgatgccactagataactttttttcattttttaattttcctcttccttgtcttttccatttcgtttgagaatcaaaagcaatgtgataatgagtatcgtcaacaagccggccatgctgcaaagccaagcttgcgttgtaccaagccgtggcatgaagccaaattgatctgcattcgttgtttgcgcatcagacctgtctttcgcgtcatcagtttgccctgtccctgcttttttagcctgactgtcagtactagcggatgacggtgattcgtaaaagccaacttcagcgcctgaggtatagccatccctgcttcggctgcatcaacctgtgaaaacgggttgcaggcgaagcccaataagaggacagtcagtaaaatcatttttttcatttcattctgtcctccttaattagccgacacatcttgtagcgaccattctactttccccgagaaagtgcccagtttttgtttctcaactggaatcgtcaacttaaacccacgggcactgctgtcaatcgtttgattccactcactgctaacatcgcgttgatcgacatcagctgtttcttcaactaagatgctctggtcagacagaacctgttcctgccctgtttgactgatataactcatgttgccagtcacatcgatctcaccatttttgaatggttgaatcactttcatcgatagccgagactgttttttggcaatctttcgactgtcctcaattaacaatttcccacgaatctgcggtcgcacaacctgagtctcaccgctaatgagcaaggtgccaaaatcaaagtcaggcacttccaccagttttaatgcgcccgactgtttgtctttctcatctggcttcggttgatccggcggcttcacatctggagacgttgctttaaatggtgagccattgcgggtaaacctcaaggctgtgctcttttgaatgcgattcgccgccgatttgtctaacttggttggcgtacgttcaactttcttgccattcagttgccaatcggaatcatctgattgggtttctaacaactgattatcggcataaatgtcataaccttttgtctcggcactgaacggggcaaaaatcagattcgcggactttcctgccgttaaaccagtgggacttttagtaccgtgatcaccagacccgaacgataactcgtcggcattgtcaatcttgatcgtgccatctcctgagtggaagaaatcaccgcgaaggttttttaagtccgccttggcgccgggtccaagattgatgcttgatgctttcgtaaatggcgtggctttggttgtttggagcaacaactgcccattcttttggacatctaccactaaatcgtcatggtgatacatgagggcaccgtcatttttgtccgtcaggtaagcatccagaacggcatcttcaccaattgtgatgcgattgttgtgatgagcgagcccatcggtgtaaaccagagcattactgctcacaactttcagacgagcgcgcttcttcaattccaagttcagcgatccggctgatgcccagaatgtgccgagcaacggattgtccgccatttcaatcgtggtatccgaatcttcttcaaaaaggtaattcgtcgcttcagcaaattcctgaactaacgcgccttttttcatcgtataaaatgtattcttacctttgaaaacgatctggttgcttggcttgcggatatggaatggttgggcgccgcgatcagaatagtaatcaacattttcaacgatgatcttgctgttttcagtgtgattgtcggctggtgcgatcccatagtagttattggctgattcagcgacattacgatcaccgattttcaagttcttaaaggtgatgctaatgttactggcgttaaagtagatgccgcgatgccagctttcgccactgttgtacatgtacgtatacttgtgatcaccatcgatcgtgactgagtttttcacgggaatcgcttcgcggccaatattgatgtcggccgttaatcgcacataaggaatccctttctcaatcgcttcttttaactcggcggttgttttcaccgggcatggatgatcttgatcaaacactggcgctgcaccagatcgcaaccgactatcttcaattgatctttttgatctggccgcagttggcggttctggtttggccgccgatactgcgacactagcagatgtagcagcttcctttgaagaacttgccgacgattctttggcttgcgtcggtttttcgacactggcagatgctttggcacttgatgcggtcgcctgtgtcgttttctgctgactggtactaggctgagatgtcttacttgaatcaaggatactttcaccgccagacactaaactgtcagtcgctgaggttgaagactcgcttggcatgagcgatttagcaagttgcgtgctcgcacttgagacaagcggctgtaacaacatcaacccagacaaaagccaaaaaaagctgcttcattcgtatcactcccccttctcaatgttattgattatataagcgagttctatattctgtcattttttctttttatttgaatcatgaaaaaataaaaaatgatttgtgtaaatcctcacacaatcactttttggccacttctcaaatgaccatcaataaccactaaggacatcgtgtcttgacagatggtctgatatctcaaaaatgaaatcagcgttttttaataatcgcagcgtcaacggattgttcgccattaggctcaaagcacgcatgttgcgcaatctatggtaagctaacgtcatcaccatcacggaggctataacatgcaaagttttgagaagtaccatccaatcatgtccgtgcattacaccatggactggttgacgacatttaaaatcaaggatattttccagttacgcgccgatcggcaaattgccgcagaatcaggccgtgaattcgatcaaaaaatcaccgacacggcccgctacatcaatcgttccatgcgcctcgtcatgagtaacaacgccttgttatacgggatcaaggatcgtgccaatggtgattttcttggcagtttctgtatttggaacttcagtgaaaagaaaaccgctgcccaagtacgcttcgaaaccttggccgagcgtcaaggtgaaggcgttatgagtgaagtcctcaaacggatgcttggctttgccttctttgaattaggtctcaaacgggtttatgtcatcttgccagccaccaacgaacgagcagcgaaattgttagccgccaacgtcttcacaaaggtcggtgattatcaccacgaccgcactttaccggatggcaccaaagttccactggcgcgctttgaattgacggctgatgctgttgccgataatgacgcctttcatttttaatcaacgcaccataacgcgctcgccattgcagaaacctacaggtgatgtccttgaagctaattgaccaagcctgggtcatttggcttcaagtcccctatgttccgacttccaaacacgcctgctcgcgctcaaaaaaagatctttgtacagaacgccacacgcgtccgtacaaagatctttttcgttgttttaatgctcatttgctcaacatacttggctgccgactgacacccagtcttggcacgcgcctatcgttagaccattggcgccggaaacaaggtcatcatcacgagcaaataccccgccaacgccggaatcgcaattaaggttcccatcaagcggctaaaaccatgtgacgcaccaagtagtcgcaagccttcaacaatcgcatccatgatgaagaaagccccggcaatggccgcgaacaaagcaccagtcatgacactcaatcgaaacatgaccacactagccacaattgccatgacggctaccaaaatctccatcttcatcaatcgtttatactctgcaggattatccaagaaattaaacatcgctggcacgcgctccttttggtctgacaagtcttcaatgtcgagaacataccacgcctgccaggaccattagcctcagagccaagaattttgaaaagaccttaagcactttaacgaaaacgcaacccttgtcttttcacaagagacgtggtaccttttacttactaaatgtaagtaataggagcattgaccatggctaatcaactcactggattgcatcatttaaccgccatcacctcaagttcaccaaggatttttcattttatgagcggtattttgggcctgcatcttatcaagaagactgtcaatcaggacgatgtgcgaacctatcacctgtatttcaccgatgatatgggcactgctgggacagacatcacctttttcgactttccggggattcaaaaagctcagcatggtaataatgagatcgcgcgtaccagcttccgcgttccgtctgatgccgcgccgacctattggaccgatcgctttgatacgtatcgggtgcatcacgatgcgattgacgacttattcggcgcgaagatcctccgcttccatgattttgacggtcaacagtatcaactcatcagtgacgagcataaccatggtgttccagcaggcacgccttggcgccattcaaccgttgacccgcaatttgcgatcggtggccttggcccagagtacatcaccaccgaccactacgacgaactggtcggtgtcatgaccgatctgcttggcttcaagcaaatcgccaaagacggtcaatataccttgcttgaactcaatgacggcggccacggtgcgcaagtcattatcgactatcaacggttgattccagccgcttatcaaggcttcggcggcgttcatcaccttgctttccgcaccgatgatcgcgacagcctccagcattggatcgaaaaaatcggtgctgctggtttgaactcgtcaggcttcgttgatcgtttctacttcgcctccgaatacttccgaccaattccagacattctgtttgaaattgcgacagatggtccaggcttcctactagatgaaacctacgaagaagccggtgttcacctcgaattaccaccattcttggaagatcagcgcgaagcaatcgaacggaatttggtaccatttaacacggaaccgcagacagcggggaaggcataattaacaccttctcctctatgacatgacctcgtccatataataaggcaggctcaaaatgagctggtctatttttaaggcttaatatacccatacccagccgcctcagcttgtgccagtttaacaaccccgaccggcaccactggtacgccagccggtaattttgtttcgtccaagtgacgttgctgtagggaattgtggcaggcaaaaaagtgaacctgaggatgcgcagcgatgaaggcggctaccttttggtcaaaaaagacggtgatgccatcaccattccccagcacttcgatgtctgcatctggctccgccgccagatagttgtcgagattggacgccaagtgtggccagcgttcagttgtatctaaatggaaaattgtttttagtgtcatcttgtctcacctcagcttgaggataccacgagtcgcccatcaaaaagaagctgaaacagattgccgccctgcgcgtttggttacagcgcagtggcagtgtctgtttcagcttcttttaaaagacagccgttagttgtgtgttacagcgatgccagaatcacgaagttcagaatgaacccgattgtgacaattgccaaaactgggtggatttccttaaccttgccggtgctcagcttgatcaggcaatagaaaatgaagcctgccgcgatcccgtatgagatgttgtagacaaagcccatgacgatggatgccatgaaggccggaacggcttgggaaagatcttcccattcgatttccttgaaggtgctcatcatcatgatcccgaccaagatcaaggcaggtgccaaagcttgggtcggtacaatggcgatgaatggcgcaaagactgagctgagcaggaacatgccggcaacgacaaccgaagtcagcccagttcggccgccagcaccgatgccggcagcactttcaacataggtcgtgacgttactggtaccgaagatggagccaacacctgtcgcaattgaatctgcaaacagggcgcgatccattttagacgagaagcctgaaccttgttccagagcacgttcgtcagcatccgagaaaatcccggtgcgccggcctgtaccgatgaaggttcccaatgtgtcgaaaatgtcggagaaactgaaagcaaaaatggtcatgattgacagggcaattttgtctgggctggtaaataacgatcccatccccttagcggaaaaagcggcgccaaaggttgtctgcaatgatgcaaaagtgctgctaaaggaatttgcagcgctcagatgcaagttggtcacgcccattggaatcccaatgatggtcgtcagcagaatcccgatcagaattgcgccgggaacttttttgacgttcagaataaccatgatgatcaaaccaatcagggccagcaaagcgcctgcttgggtgaagttaaccagtgccggcacaatgccaccgttggaaacaaccgattcaaccccatgtttgagcgtcagtgcgcccgccttcaacggttggccgttgatggtgttaatgctggaagcttcagaagtaaattgtaagaagccggcgttcttgatcccaatgtaagccacgaagaccccgatcccaccgccaatcgcatgctggatggtttctggaatcgcgacaatgattaatttccgaattttggtgacagtgattaaaatgttgatcacgccacaaatgaagaccagcgccaaggcttcttgccaactgaatcccagcgcgaaaacaaccgtataagtgaagaaagcattgagtcccatgcctggtgccaacgcgtacggcacattagcgaaaagacccatgaccagcgttccgaccgcactggcaatgatcgttgccaagaaaacggcctgtgccggcatccccgtctgtgataggacttggggattaacgaataaaatatatgacattgcaaaaaatgtggttagacctgccatgacctcggtcattggcgtggtcttattgtctttcaaatgaaaaaagttttccatgacacgctcccctaaactgtgaatatgaaaagtgtacccgagactgacggcagttgcaatagaaaatacgtttatttttcttttttttatgattaatgttcgtgttttccctaattttaaacacgctcgtcaggcttttcggaaagcgttatgatgagactacaacattcatttacagaaagaaggtcatttttatgtgccccagtttacaattcaagtgcaacaccctgacgactagaccataaaggccatcatggcctttatggtctagtcgtcagggtgttgcacttgaattgtaaactggggagcgcatttaagatgatgtttgcttcaaacgcctcttggcctattgtctgcagacctgtccccaaggttaagttgctaattgagttatagacaaacgcatatttgccaatcgcggtgacactatccggcacagccaaaccattttgaatcttattgtagccaaaagcactgtcgccaattgtctgtaacccgtcatttaaagttagtgccgggattttgttgccgacaaacgctgcatttttaattgtcttcaaatttggtggcaacacaattgcattgttaatcgtattataggcaaaagcactgtcaccaattgactcaagcgctgttgcccgactgaaatcaacattttgcaacggtccaaactcagtaaaagctagatcaccaattgtctgtagattaggaccaaatgctacttggatgaggtgtccaccgtaaaaagcttgatccccaatttgttcaagtgagtctggtaaattaatcgccgtcgcactggaaaatgcgaatgcctgaaagcccaatgttgtcagccgactattgtctgcgattgcaaccgttcctagttttgacccataaaaagccgatccatcaattacgctgatgttcgccggtattgtcagcgtcggaatttgattgccaggattatcctgaccattaatgttaggcagatccttcatgttttggataaattgaaaagcgccgcctgtaatcgtctgaacatcaggaccaaacatcagattatccgtgaagagatggaagaaggcttggttgctaatcgttgctgcatcgacggtcacattcgtaatgcgtgcatagccaaaagcagtttcagcaagcgttgttgccttgccgcccagcgtcagcgatgtagccttagtaccgtaaaaggcattcttaccgatcatcgctgatcctgccacattaatcgtgtcattaatggtttcgtaggcaaacgccgcttcgccaatattagcaacttcatcatccaacgtcagcgactcggccttaagcccataaaaagcattttgaccgattgttgccggacctgcgacactgaccgcaccagtaatcgtggcataggcaaaagacgactcaccaatgttccttgcaccgttcaatgtaatcgcactcgcattgacaccggcaaaagcctctttaccaataacagccgcattatcgacggtgatcccaccagtgaatttactataggtaaaggctgaagcaccaattgtcgtgaccgtagaggcaacatgtaagctagtcaaattactcaagttaaagaatgcaacatcctgaatcgcagtcaccgtataagcttgaccattatacgagacagttggcccaatattaatgtcggtaagcgttgcaccagagtcatgacccgtaacggttgccgttttggttgtctcatcaaaactgtaagttaaaccgtcaaccgttgcgtcagctgtcgcggtattggctgttactgtaggttgagcagcagctgtcgcaacctgttgggcttgactactggccgactgctgtgcactggaagcttggctgctcgcagctgaagatgctgctgtttcactagcagtggcagcctgtgcagcagcttggtctgcagccgcggctgattgagccgccccagaccccgaggccacctgtgccgaggttgctgaggctacctgtgacgcatcagttgtctgttcagggacagccgcctgactcgtaagtgtttgcgctgctgatgaactggatgtttgactgctagccgcgctcgccgcagatgaagccttgacagcctcgccggagttagtagcattcacagcattgcttgatgttgtcgcttgatcactagtaaccacactttgagatgtcgctggctccgctgcctgtgacgttgccgttacttgtgtctgtggtgagcttgtatccgccttaacttcatgacctggttgaaaaaaggccggtataaacagtaaagcagcaccagcaataagccaccgcttttttgctttatacatccgaaaacggacatgaaccgtctgttccgcctgtcgagccaattgaatccgtttagaatctagtttcaagatcatgatcctcctacagccatgttaatagcgattcccgtcacgacgcttaacgaaccatctcagatacgatgattcacttggaaacagtaagcgtgtagaatctgtttttcattatataactgattttattaaaaaaacggaaaaatttgtatccaattttcagaaaataattttataaatattgcgatagaaccagtctaaaaccggcattaacttaagtgcttgtttttaaatgtatcgccgatcctctgttgtttctgcaaatcagctgcatcttcgatcacaataaaaaaacacgatgttggtcaaccatccatcgtgtcttttgacacgtatctttttagagcagaccctacttaccaattttggcgcagctgcttcttttaatcgtgccggactcatcagcaacttgcttaagttgagcttctgaccacacttatcttcaaagcttttcatcattctatcagtatatttttaattaagattcgtttgtttgcattctaaacaaatggcaagcattttgttgtaatcgtaacaacaaggctttgcagattgttttcattttctagttgacttcatacagaacatcgcgtatgttaaaaattatcacataagatgagatttacatgagaggagttttgtcgatgaagttagatttggaactacgccctggggcaaatcgttttgtaagtgagtcaggtgccttggcatacttagatacgatcttagcggattttaatcaaccagttgtgattaccggcgaaaaaagttttgctgctttcaccaaggtttatcccggcgaactgagcctgccagtctaccattacgacggctccgccagtgatgaaaatggccacgaacttgcacaggagatcggtcatgctgatgccgtggtaggaatcggtgctggtcgcttgatcgataccgccaaagttgcggccgaagccttcggtgctgagctcatcagcatccccactttggcctctaactgtgcaccattcacaccccttgctgcgatttatgatccgcaaggtcatacctttagttacgttgaatattttaaaaaatctgcctatattactttggtagactataacctcttattgtccaccccacatgatttctttgttgctgggattggcgataccttggccaaatggtatgagatggacggcattacccgtgataaagtggatcagttaaaggcatacggccagttgagtcgtgccgcggccaaaacgattcaaaagattctctttaaagatgctgaacaggccttggccgatttggatgccggccgcgacaccccggcttttgaagcggttgccgataccattatcggcttggctggtgaagtgggtggcttcggcggcattgatggtcgcgctgccggtgctcacgccactcacaatggcctgtcctacttaccagaaacccatgccatcttgcacggttcaaaagtggcttacggcattctggtgcaattggctgaaaccggcgatgataccgaaattcgcaacttgattccattctatgaaaagatcggtttgccattgaaccttgaagatttgcatgtcaccgatcaagtcgatgaaaagattaagcaagtggccgaatttgccgctaaaccagatgaaaccttcatcttggttgatccaactttaactcctgccaaagtagcagatgcgatgaaaaaagtggaacaagtcaccagtgatccagcagcttaaagtccgaaatcggacaatctaatgaatactgtttcacaaaaattttaaaaaaccttgcagccctcttaaaatggttgcaaggttttttcgtttttgtatgaaagcaccctattcaaacaatgaccgcgcaaagtcctacctgttcatcgcgttgtcgattcactttgcaaataccctaacgccgccgcgccaacagccttggcagcaatcagaatcgcatcttcgtccatcataaagtcgggactgtggtgaggatgattagagccgtctggcagctgacagccaatgtagaagaaactgcttggtaccttttgggcaaaatacgcaaaatcttcggatgggtcttgaactccagtgtccttaatggccttaatctccggaatatttgctgctttgatcgcggccatcgcattttcggttaaggtcgcatcattcatcaaaaccggataattgtcatcatagtccagctttgttttaaccccaaacatgatttctagtccttggttcatggtgacgatctgttgtcgaatcgttttgcgcgttgtttccttcatcatccggacatcgcctttcaatacaacgtcttgcttaatcgcattgaaagaaccagcgccgtcaaatgagccgatggtgacgcttgccgtgtcaaaaggatcaactcgccgcgacacaatcgtttgcagtgccgtcaccaaatagctgccagccacgatagcatcgttgctcaggtgcggcatagaagcgtgtccacctttgccgataatcgtatcggtaaagttagcccgcccggtttgggttgcgcctgtatggtagccaatcaaccctgtcggcatcgatgacatgacatgaacgcctaacacattatcaacgccttcgagaacccctgctgctaccatccccttggcaccacctggagatacttcctcagcgggctggtgaatgattcgaatggtaccggccaatttggctttgatcttgatcaattctttagccaacaccagcaaataagccgtatgcgcatcatggccacacgcatgcatcaccccaggattctgagacttgaacgacaggtcgttatcctcttgaatcgccaaggcatcaaaatccgcccgcaacgctaacgtcggtcccggttgaccgccttgaatatcaacgtacatgccatagccctccccacacggcgtcacggggacgttcatggctgcataatattgtttgatataagcagccgtttgtttctcatgaaacgaaatttccggatgagcatggaggtgccgccgaatcgcaagcatttccgattcatcggcagccagtgtctgcatcaattgttctgttaaagtcatggtctttttcctctctgtgattttgtctgaactttcggcaactttgcaattaggcgaacaagttgcggtcgaacggccttaaaaataacctccgcgaccacaaaaccgactgccagtgccatcgcaatcaaaatgacgttatagatttgctgcgcagcactcgcggcttttcccatggtgaaactgcgcgcacccaggtaagcaatgccgcccggcaccagtgatacaagacttggtatgtaaatcgtattaaccggcacccggtgacgaatagcaaaataattccccagcaatccgatgattaccgtggccgtgaagttcggtaatataaggctgtgatcctgcaggctgatgagccagtatgcacaccacgaaacaccgcctgtgatcccagctggcagcaaggcgcgtttggggatgttggtgatgacgccaaacccgatgctcgacaagacgctaatcagaaattcaattaataagcgcatgctagcgccctccccaaacattattcagtacaatcgcaataacgaccccagaaccaatcgcgccagctacaaaaatggcgtctacagtgcgaacaatgccgctgatgatttgccgcgaaagaatttcccgaatcgcattggtgatggccaccccaggaaccaacggcatgagggcactaataataatattgccggaactatcgccccacccgatgctcaccagtaattccgctaaaatggccaccacaaaggcaccagtcgcttctttgaaataaggcgtcgtcgtgcggcgaccgacatactcagccgcaagataaccaaaaataccaacaaaaaaggctaaagccaaatcaccatttgtcgctttaaaaagcagcattggcgcgaccgaaacccaaccggcgcccagaatccgcgcccaccatgggaaattaatgacttggtgatcaattcgcgcaacttcttgcttaagggcttcaaatgttatccgatgagcgacgaattcacgcgacagttgattcaactcatcgaccttttgcaagttgaatccgcctaatgttgatttgattaagcgcgtacgactttcgttctccaaactgacaaaaactgccgtaatcgtggcataacacgcaacgcttgcccctgccgcatgcccgatatattccacggttgtctcaatccgtgatgtctcggcgccggcattcagtaaaatctctcccaccttgccgcagacttctaaaatttcctctgttcctggttgactcatcgcgtttgctcctcaagatcgcgtttccgcgttttgcattttattaattgtcggcttttttgatagcggtggcaagtgatgacattgggcaatagccagcaaatttttctgaaaaggtttttcatttattaacccattaaacaaatgaaaacacaagcgcgttatggcgtgttaaaaccaatgaaagaaataaataacaaaacataaccaatgcctaaaaatgcgattatcagcagtagcgccaacgccagtttcactgctaatgaaaaatcttttctgcgcaaaatgacgactatcccaagtcctaataagatgagcaccagaaataaaaagaaaaaagtagtgctctagatgtccaaaagcctaacatggttaccactcctctaatttcatcttgctacttagccgtttcccactttttaaatcgataattcgccgacagtgacaaggcaaaaaagcgtcatgtccagtagactttttcagcttatcaaaggttgcttcaaagcacaaaactgttgcttctcatgatcacgcgcccccgtccaaggctacttacacgtcggtctctccccgggctggcttggcatcaaaaaaaccgaatcgccagctagtttggcaattcggtttccaatttattgggccactttactaatgcgtccctgctcaatgtacactgacaaaatcgccacatcagcaggattgacgccgctgatacgactcgcctgcgcaatggtttctggctggattttaaccaacttctgacgtgcttcagttgccaaaccattgatggccgcgtagttaatacgtagcggaatctttttgccttctaggcgtttcagtttggcgacactggcttcttcctttgcaatatagccagcatacttaatttgaatctcaacctgctcaatgacacgatgatccaaagtcggattatctggcaagaattgcgccatcgtctgatagtcgatttccggccgcttcaggaagtcgctggccaagacgccatccttaagtggcgcataatgatgggcctctagccatggattcacgtctttaggcttcaaccgggtcgtattcagccggttaagttcagtttcaatggcctgacgctttgccaaaaattcagcatagcgctcatcgctaattaaaccaagctcatggcccattggcgtcagccgcagatcggcattgtcatggcgtaacaaaagtcgatattcagcacggctggtcaacaggcgataaggttcattcgtgcccttagtcaccaaatcatcgatcatcacaccaatataggcatcggaacgcttgagcgtgaacggccctttgccttgggcacgcaacgccgcattgatgccagccataatgccttggccagctgcttcttcatagccgctggtaccattcatctggccggcagtgaaaagattatcaacgactttggtttctaacgtggccttcagttgccatggctcgatcacatcgtactcaattgcatacccggcacgcatgagttcggcatgttccaacccagccacactatgcagcattttcagttgaatttcttctggcatagaagtcgaaaaatcaccgacatagtattcggaggtatcgcgaccttctggctctaagaacagttgatgccgcggcttatcagcaaaacgaacgatcttatcctcaattgatgggcaatagcgcgggccaacccctttgatcacaccggaaaacattggcgcccgatccaaattatcgcgaataatttgatgggtcgttgcattagtgtaagtcatccagcaactaagctgatccttcaaataaactgaatccggcgtcgtgaagctaaaatgattcggagtcttatcgccaggctgttcctcggttttatcaaagtcgatggtgttgccattgactcgcggcggggtcccggttttaaatcgccgcaatttgaagccgagctgttcaagattttctgacagcttgatacttggcaggctgttattagggccagaactgtacatcaactcaccgatgataatcttgccgcgagaactggtgcctgcggtcaaaacaacactcttggcccgatacattgcgccagttgccgccacgataccgacagcttggccattttcgacgagcacctcagtagcgaggccttgacgcagatccagatttggcgtgttttcaatcacgtgtttcatgctgcggtgataggctgccttatcagcctgggcccgtaatgcacgaacggctgggcccttgccggtgttaagcatccgcatctgaatatatgttcgatcaatattcttgcccatttcaccaccgagtgcatcaatttcacgcactacgattcccttggctgggccgcccagacttggattacacggcataaacgccagcatttccaagctgatcgtcaatagtaacgtcttttggcccatccgcgcggctgccaaagcggcctcacaaccagcgtgaccagcaccaacaacgatgacatcataggtaccggcttcaaattttttgacatcaggcattcgatttcctccatgaataagtttctaattggcactgagctttacttgcccaagcagaattgactaaacaattgggtgattagttcatctggcgcactttcaccagtaatttcaccaagtttatcccacgccgcagtcatgtcgatttgcacgagatcaattggcataccagcatggattccggcgatcacagcgtccaagctcttgttggcttggcgtaatagcccgatctgccgagcgttggaaaccatcactgttgtttggctattttcgatgccgccgaagaacaacttcgcaatccgttcgtctaaggcatccatgcctgcgctagtcgggatagcggtcttgatgatttcatccggcgaaaccaacttcaacaaggcagtggtatctagctgtgcaggtaagtcctgtttattcaaaacgataatccgttttttattagctgttgcttgaatgagctgtttgtcttcatccgtcaatggttcactttgatccaacactagcaaaatcaaatcggcttgtgtgatggcttgacgtgagcgttcaacgccgattttctcgactttgtcagtcgtgtcatgaataccggctgtgtcgaccagttttagcgggacaccacgcacgttgacatactcctctagcacatcacgagtcgtaccagctacatcggtcacaatcgctttatcctcatgcaacatgtgatttaacagcgaacttttcccaacgttgggacggccaacaattgcggtggctaaaccttcgcgcaagaccttgccttgactggcggtactcagcaaattgctgatagctttttgaacggtttgcgccttttcaagcagcattttggtggtcatttcatcagtatcatactcaggatagtcaatgttgacttccacctgtgccaacacttcgaggatttcctgacgaaggcgtttgatcaatgtatgcagattaccgtctagctgattgactgccacctgcatcgcccgatcggttttggctcgaatcagatccatgaccgactcagcttctgtgagatcaatgcggccgttcaggaatgcccgtttggtgaactcacctggctcagccatccgtgcgccttcgcctaagagcaactgcaaaatgcggttagtggcaacaataccgccatgacaattaatctcgacaacatcttcacgggtaaaggtcttaggtgccaacatgacactaaccatgacctcatcaatcaattcgccgctttcagggtcgacaatatggccataatgaatcgtatggcttttaacctgcgagaggtcttttcccttgaaaacttgattagctgtcgctacggctgtctcaccgctgagccgaacgatgctgatagcaccttcgccaggcggggtggagatggcagcgatggtgtcgtacgcagtgatggatgcagacatttgaaagactcctttttgagatgattcggtaagaaaaatgagttgatgggattggacatggcaggcgactgaggcggatgagtgatgtggcggcctctgaaacacgcaatggagttgtagagcctgcatgtagggatttgtgtggtaaaggccaatcccttcatggcctctgaaacgcgcaatcaggcgcatctcggctatgcgaaggacagtccaaccagatggcccaaagcccagactttctggttagggggctaggcggttccgaaacgcgcaatcaggcgcagaaacctgcacatatggacatcagacctaaatggcaaaaccagccatttaggtctgatgccacttatgctccggtttctaaccgcgcctgattgcgctctacaaaaaaagcgcaaaatccagtctttcccccctatcagggaaagactggataaagcactttgactacttcatcgttattaaactgtgactatcatacttaagcaacggtcacttgtcaaaagttagttacggtcttttgggtgtgactacgacatatcgccgaggatcgacgccttctgaatgggtctcaacgtacgtattgtccacaagtgtcgtatgaatcgttttgcgttcaaatgatggcatcgggtcgagatagacggctttgccagttgctaaaacctcgcgagcggtgcgttctgctaaacgtgtgacggtcgcctgccgttgttcgcgataatcgccgacatcaagcatgattgtccatttacttttggcataatgattgaactcagtttgggctaagtattgaattgcattgatgattttgccatgcttaccgatcaacaggccttcttcatctgttttcaactgaaatgtgaccgtgttaccttgccgttcacttgtgacttgagtgtcgatccccataccagtggtgatgtcttccagataactctgcaccatggccaatgcggtttgattatctcgctttttggtggtgatatcgttgaaagcactggcaattttcttgcctgcaccatcagttaaagccgttgcaagttttttccctgcccgcggtttggcaggcggatcatcgcttggcgtcggatcagcgtctatcggcggttccaagggttttaaattaacaatcgctggcttacgcatcaagcccagaaatccgttcttattttctcgaacgacttcaacgctaacggcatcacgcggcaagccaagctgcttgagaccagtttcgatggctttttgaatcgtactgccttgaaaggttggcatcttgcttcctcccgttgttatttacgccgtttggttgcttttttgtacgctcgcttgagtgcccgttctttttctttttcagcctgcgcttttgcttcacgttcgcggcgaatcttgaatgggttctggatcagcaactgctgaatcattgaaaaggcattggtaactacccagtaaatggccagcgcacttggcaaggtaattgagaaaacgaaaatcatgacaggcgagacgatcatcatgagccagctgctagaattacgcgttggttgtgccatcatggataagacactagtacccaacgtgaataaagttgccagaatctgcataatccacaacggatctggttgtgacaggttcatccaaaggaaagtaccagtttgcagtgatgatgtgcgcaaaattgcttgataaagcgcaatcaggaatggcatctggatcacaatcggcaaacagcccatcactgggttaaccccagctgaagcataaagtttctgtgtttcatcacgcagtcgtgtctgggtttccgtatcctttgaactgtacttcttttttagttcatttagctgcggcgcaatttcctgctgtttggacatgctcttgattgacatgtaactcagcgggaaaatcaaaattcggatgatcaaggtgaaggcaataatcccgacaccagggttgccaccgaacaaattcgccagccagataacaaattgaccggctgtgtagacaacatagcgatcccagaaccccgtactattttgcgtaacgggtccggttccgcaggccgtcaaaatgaagaccaggcttagcatgctcaaaatgacgagcacacgtttgatttgacgatttttcacaaatgatccctctcttttttaaacgcggtcgctaggcgcagaaatctgcacagaaggacctcaaatttaaatggctaaagcccagccatttagatttgagtccgcttatgctccggtttctaaacgcgcctgctcacgctctggtcagatgacctcgatgtcttcgttcaggatgccagccaatcgcatgacatgaatcaaatttttcttggtgccagccatgtcgagctggttagcagatttacgtgcaataaccaaaaaatcggtttgcgcgtcaatattaggttttaactccagtaaactttgccgaatatagcgcttaatctggttacgcatgaccgcagtgtggccaactttcttccccactgagataccaacacgaaaatgcggttggtcgcgtttcatgtgatagatcacaaaattgcggttggcaaccgaatcgccatggtcaaacacattctgaaattcagcttcttttttgatccgatatgacttgcgcaatgatgctccctcacaatctggttctaagtatacaagatgactcggtgttttcctatatgtatcagcggtttgtcgacggtttctaatctgcacattgagattaagctgttgagcagaaaatgaacggcaacgaccaacgattgggccattgccgttcattggggtcatgctgctgccgccgaaacgcgtgaaccagcccagaaacctgcacgtaaggacctaagtcgcaatgaccaaagaccggtcatcacgacttaggccgcttcgctccggttcctaactgcgtttgtttgcgctctaaaaaaaaccactgacgcggtcagtggcttaggcagataatactttacgtcctttagcgcgacggcgtgctaaaactttgcggccgttctttgtgctcatccgcttcatgaaaccatgaacacgttcacggtgacgtttctttggttggaaagtccgtttggttgtcattgacgacacctcctatgaaaaacgatttatcttattaagatgacttgcattatcagacatcatccgagtttacacgaggaagcaactatcgtcaaggttttttccattgaaagcaggatctcatgatgatgacacgacatccacagatagttatgaacctgtggataacttgtgtctcgaatttttaggtttcggtcatttccacaaaccaatcacaggaaattcgcagataaacaggggtgtgaagaaagttatccacaagctttcaaagccctgttcatatcttgtgaaacacttactgctacaaggtttttgttccacagtgccaatgtgcataactgcgaatttattgtcatcacgctttcgttgtccccgaccctggggatagtccgttcgcaccctgttcatttctcaattttttgtttgtggaaaactgtgctttctgtggaaaacttacgccagcaatgctaaacttatttttacagagcgctcgcatgcccggttagaaaccggaacataagtggcctcgagtctaaatggctgctctttggccatttagactcgaggtccttatgtggaggtttctgggcatgcgagcgcgtttcagcagagcgtgaattggcgcgttcaataatcggcgtgtattggccttgcctgtgatgaccgggctttggtcaatgcagtcaaggtccttacacgcaggtttcggtgccaatgagcgcgtttttatataggaatgtccgtcatcactcgtcagcatagctataagctggtttgctaccggacataattggaggaggggcatgaatgcccaatttagaggaactttgggcttacctgaatgataaattccgtgaagaattgaccccggtcggttacagcacatggatacagacagcaaaacccgtcaaattaaccaaagataaactcgaaattgaagtcccagcttctttacacaaagcttattgggaaaagaatctcgtgaccaaggtagtcgaaggcgtttacgaattcgcgcaacttgaagttgatcccgtcatcatgaccaaggatgagttgcagccagctccggctacagatcaacgtcctgcggttgaagaagacgatcaaaatctgacttttaaggcaaaaacccatttaaatccgaaatatacgtttgaccgcttcgtgattggtaagggcaaccaaatggcccacgcggctgctttggcggttgctgaagcccctgggacaacatacaaccctctgtttatttatggtggcgtcggtcttggcaaaacccacttaatgcaagcgattggtaatttggtgctaggtaataacccagcagccaacataaaatacgtcaccagtgagaattttgctaatgacttcattaactcgattcaaaccaaacaacaggaacaatttcggcaagaataccgaaatgtggacctgctgttggtagatgatattcagttttttggtgacaaagaggccacacaggaagaattttttcataccttcaatacgctgtatgaaaatatgaagcaaattgttttgaccagtgatcgcctgcctaacgaaatccccaaacttcaagaacggttggtttcgcggtttaataagggcttgtctgtcgatgtcacaccgccagatctggaaacacgaatcgctattttgcggaataaagccgatgctgaagatctcagcattccagatgacaccttgtcttacattgctggtcaaattgaaagtaacgtacgtgatctcgaaggtgcgttagtacgcgttcaagccttttcaaccatgaaaaacgaagatatcacgaccagcttagccgcggatgccttgaaagccttgaaacttgatgaccgcagcggacaattgaccattccgcaaatcctgaatgctgtcgcgaaatattttcagctgacggttcaggatcttaaaggaaagaaacgcgtcaaacagattgtcattccgcgccaaatcgcgatgtatctagcgcgcgaaatgaccgataacagtttaccgaaaataggtcaggaaatcggcggcaaggatcatacaaccgtcatccatgcccacgaaaaaattatggcttcaatgacaactgatgagaatttaaaagctcaagtgatcgaattgcggaatatcttgaaaaaccgcgggtaatgcacatgtggataaccttcaaaaacaaaccattttatccgtcgcacttatccacaagtgcataactttctcagttgttgtttctcaaagttttccacagtttgaacacgccctattactattacttcaaaagctttatattatatatataaaagacgttcaggaggctcttatgaaatttacgatcacccgatccacattcttaaaaaccttgaatgatgtttctcgggccatttcaaccaaaacaaccattccgattctgactggattgaaaattgtgctcaacgatagcggcttaatcctcactggtagtgatgccgatatttcaatcgaatcacggatcaacgcaacggatgaaaataatgatctccaaatcggaagcactggtgaaatcgtcttgccagcccgtttctttagcgaaatcgttaaacgtttgccagaaagcacaatgacgctggaagttaaagacaatttccaaaccgtcatcacgtctggggcatctgaatttactattaatggtttggattccaataactatccgcggttgccagaaattacagccgatgcagcgttgagtgtttcagctgatgtgttacgtcagttgattaaccaaacagttattgccgtttctaatcaggaaagtcgaccaatcttgacaggggttcatctgacaattaccggcgatcagttggtagctgttgcgactgattcccaccgccttgcgcaacgtagcctgactttaccaacagcaagtgcctcggattatgacatcattattccagggaaaagtctgacagaacttagccgcatgttaagcgatgacgttgaaaaaatcgaaattcgcattgcggaaaatcaagtgctgttcgtgtttgggcaaacggccttttattcacgcttacttgaaggcaactaccctgacacaagccgacttattccaacatccagcaatacgcaagcggaatttgacgcaccagcattgctggcctccattcaacgtgccagcttgctgagtcacgaaagtagcaacaatgtggttcggcttgtccttaatatcgctgatcaaaaagcgactatctacggtaattcgccagatgtcgggaatgttgaagaagtacttagtttcaacaaacttagcggcgaggatctagaaatctcgttcaaccctgactatatgaaggatgccttgcaaggatttggccaaacggcaattgaagttgacttcaccgcaccattgcgaccattcactttggttccaacagaagacaaggaacggtttatccaactcatcacgccagttcgaacgttctaactaaacatgacttgaaaacgcctttaccgaaaagattcggtgaggcgtttttttgacgaacttatgcttcatgaaatgaactgataaggtgcgcatcaaaatgcaaagcagccacatgatccgttagccaacatcagcttttttgatggcagtgagtcgttttatgggtcttttttcgtcccactttaatcaaaggtgatgataacagactttgattgttggtttgttcacaaatggatcagtcattttttctgtaaacctaggtcaaacagatgactttcataaagtttcacgatcaatcgaatatttctatttagaattcctaatgacaaataatcgaaagttgcgttgagagcggtcaaaatcgatagaaatcaaaatttagccgattttggcctttctgggtctttttagtctagggggacgcacaacgttcagattgcctcagagccgctttaatgccgttttagaattgtgctttaagtagtataagggtataattaatttgtgttcattgacgacaaatcgcggtttaacgcggtttgtctagcacttttcggaatggagggcgacagcaatgacaacaatcgaaatcacgaccccttttttgaccttgggccagtttctgaaagaggcgggattgatcgatagtggcggtgcggccaagtggtatctgggtgaaaactcagtgacagtcaatggcgcagctgaggagcgacgtgggcgcaagctgtatccagatgatcaagtcagcgtggccggccaaacatacgtgatcgtgagcgcatgaaactggatcacttggtgctgaaaaattttcgcaattatgctgctgttgatacaacattttcaccagaaatcaatgttttgattggggcaaacgctcaaggcaagacgaatctgcttgaatcaatctatgttttggcattggctcgcagtcatcgaaccaacaatgataaggaactgattcgctttggtagcgagtttgcacgggtttccgggcaagtttcgcgacaaagcggttcccatcagttggagttgattatcagtcatcaaggcaagcgtgcccggattgatcgcatcgaacaaccgaagctttcccagtatttagggcattttaatgtcatcttgtttgcacctgaggatttagccatcgtcaagggcagtccggctgggcgtcgtcgcttcatcgacatggagtttggccagatgagtcccaagtacctttataatctgagccaatataaaacgtttttgaagcagcgcaatgcgtatttgaagcagcttaagtatcatcaggccaaggatctggtttatctggatgtgttgactgactcgcttgcagctttcggggcagagctaattacggcgcgcgctaagttgttggagacgatgtcggattatgctgcaacgattcagcaagatatcaccaaggggcgggagtcattacatttttcttatcaaacacaggttgaccccagttttcgcggtgacagtgagcaggtttacactgctttgggcgagatgtttgccaagcagcaagcgcgcgaaatcgaacaaggaaccagtttagtcggtccccagcgagatgatgtgttgttcatcgtcaatgataaggatgttgccaattttggcagtcaagggcaacaacgcaccacagcattggctgttaagctggcagagattgaccttatgaaggatcaaaccggcgaatatccagtgctattactggacgatgtgttgtcagaattagatgcggctcgccaaacccatttacttaaggccattcaaaccaaagtccaaacctttttaaccaccacaagtttggaaggcattcaaaaagaaatcatcgcaacccctgcagtctttaaagttgatgaggggacattagcaagagcgtaaaccagcccggttagaaaccggagtgtaagcgggcctgaacgtgatgaccgtattttggccattgcgttcaggttccttacacgcaggtttctgggctggtgaacgcgtttaaagcagagcgtgaacaggcacgtttagaaaccggaacataagtgggcttgaacgtgatgaccggtttttggccattgcgttcaaggtccttatgtgcaggtttctgtgccagtgaacgcattttaacaaggaggataaccagtgacggacaagaaagaaacggccgaagagaagaaggatgaactggcggctgagtatgatgccagccagattcaagtactttcaggacttgaagcggttcggaagcgtccagggatgtatattggctcgacaagcagccaaggcttgcatcatttggtctgggaaatcattgataacgggatagatgaagcgctggctggattcgcaacacggattgaagttgaagttaacccagataatagtgtgacggtaacagatgacggtcgcgggattccagtcgatatccagtctaaaaccggacggccagcacttgaaacggtttataccgttttacatgccggtggtaaattcggcggcggtggctacaaagtttccggtggcctacatggtgtcggggcatcagtcgtgaatgcgttgtcgactgatttggacgtcacggttactcgtggtggcaaacgttactacattgactttattcgcggcaaggtgaacacgccgatgaaagtgattggcacggcaccggagcacgaacatagcaccaaggttcattttctgcctgatccggacatttttaccgagattagaacattcgatgataagatcctgaccaccagaattcgcgaactggctttcttgaacaaaggtctcaagttgacctttaccgacaagcgcgcggcaacgcacgagaagctggtgttccattacgaaggcggcctcaagtcttacgttgactttttaactgagaaaaaagaaaacctgttacaagaaccgatttatgtggaaggacaagacaagggcatcacggtggaagtcgcgttgcaatacaccaacgactatcacagcaccttgttgacgtttgccaacaacatccatacgtatgaaggcggcacgcatgagaccgggtttaaaacggcgctgacacgggtcattaatgattacgctcgccggtctggtgcgctaaaagacagcgatgatccgttaagcggggatgatgttcgtgagggcttgacggcggttgtttccgtgaagcatccagatccgcagtttgaagggcaaactaaaaccaaattagggaactcggatgcccgaacggtggttgaccgtaccttctctgaccacttcaataagtttctcatggaacacccagctgatggcaagctaatcattgacaaagccatgctggccagcaaggcacgtttggcggctaagcgggcgcgtgaagtgacccggaaaaagagcgggttggaaatttcgaacctgcctggtaaattggccgacaacaccagtaaggacccagagatctctgaattatttatcgtcgaaggggattccgctggtggttctgccaaatcagggcgtagtcgcctgacgcaggccattttgccaattcgtgggaaaattctgaatgtcgaaaaggcttcaatggaacgcatcttggccaatgaagaaattcgaaccttattcaccgcgatgggtaccggttttgggcaggactttgatatcaataaggctcgatatcacaaactgatcattatgaccgatgccgatgttgatggtgcccacattcggactttgttgctgacgttgatttatcgctacatgcggccagtgcttgacgctggctacgtctacatcgcacagccgccgttgtatcggttacgccaaggcaaaatgacgcaatatatcgattccgatgaagaattgcaagacattctaggccagttgccgccgagtccaaagccagagattcagcgttacaaagggcttggggaaatggacgccaaccagctatgggagacgaccatggatccggataatcggcgcttactgcgggtatcgccaaaggatgccgaagctgcagatggcgtttttgaaatgttgatgggtgatcatgttgaaccgcggcgtaaatttattgaagataacgctgtgtttgttgatccgaacaacattgatgcttgattgaccagtttaactaagtcagcttttgcatgagaatttttgagaggagacttttcgcttaatggatgatcgccaagaaagccgaattaccaatgtgaacctcggcgaaacaatgcgtaaatcattccttgaatacgcgatgagtgtcattgtggcgcgggccttgcctgatgtgcgcgatggcctcaagccggttcaacggcggattctgtacggtatgaatgaactcggcgtgacgccggataaaccgtacaagaagagtgcgcgtattgttggggatgtcatggggaaataccatccgcatggtgatagctcgatttatgaagggctcgtacgaatggcacaggacttcagctatcgttacatgctggtcgatggccacgggaactttgggtctgtcgatggtgacggtgccgctgcgatgcggtataccgaagctcgcatgagcaaaatagcagtcgagatgctgcgtgacatcaacaaagatacgattgattttcaggataactatgatggcacggaaaaagagccggttgttttaccggcacgttttccaaatctgttggtcaatggggcgactgggattgcggtcggtatgacgaccaatattccgccgcataatctgtcagagactatctcggcgctgcacgtgttgatggataatccagatgccacgacagctgacctaatgcaggcactgccaggacctgattttccaaccggcggcgttgtgatgggtaagtcaggcattcgccatgcttatgaaactggccgcggcacgattgttttgcgcgggaaagttgatgttcagacggagaagtctggccgtgaacggatcgtgattaccgagattccatatatggttaacaaagccaaaatggttgaacggatcgcagatttggttcatgaaaagaaaatcgatgggatcgtgaccttgcgggatgaatctgaccgtgacgggatgcggatcgtcattgatgtgcgccgtgatgccagtgcatcagttattttgaataacttgtacaagctcacgccactacaaaccggcttttcattcaacatggtggcaatcgttaatggtgcgccaaaagtgttgagcttgaaacagatcctgcaatattatctggatcatcaagaaaacgtcattcgtcggcggacgcaatttgacctgcgtaaggccaaggctcgtgagcatatcctcgaaggattacggattgcgcttgatcatattgatgaaatcatcacgattatccgtagttctgaaactggcgacaaggcaaaagtcatcttgatggacaagtttaagttgtccgacaagcagagccaagcaatcttggatatgcggctggttcggttgaccggtttggaacgcgagaaggttgaaagcgaatataaggatgttgaagcagcgattgctgattatactgatattcttgctagaccagaacgtgttcatcagatcatctacaacgaattgctggatattcagaagaagttcggcgataagcgccgtactgaattactggtcggtgaagtgctcagtcttgaagatgaagatctgatcgagcaagaagacgtggtcatcacgttgagtcataacggctacgtcaagcgattggcaaccagtgaattcaaggcacaaaatcgcgggggtcgcggtattcaggggatgaacgtccatgatgacgatttcgttgaacgcctgatttcgacttccacgcatgatgtcctgctcttcttcaccaacaaaggtaaagtttatcgcagcaagggttacgaaattcctgagtacggtcgaaccgcaaaagggattccaattatcaacttgcttggtgtcggtgccggtgaaaagattcaaacggttatcaacgtgcatgaaggcgaaaatgatgatcgttatctcttcttcgtcacgcaaaaaggcgttgttaagcgcacaccggtgaaggaattcgccaatattcgcagcaacggactgattgcgttgaatctcaaggatgaagacgaactgaataatgtcatcctaacgtccggacaagacaatatcctgatcgggacgcatctgggttacagtgtgaccttcaaggaacaagacgttcgctcaatgggacgttcagcgactggggttcgaggtattcgcttacgtgaacacgattacgtagtgggttccgacattctcaaacccgattccgaagtctttgtcatttcagaaaaaggttacggtaaacggacggcagcgaaagaatatccgattaaaggtcgtggcggtaaagggatcaagacagccaacatcaccgccaagaatggttcgttggcaggggtcactaccgttgatggtaccgaagatattcttgttatgactgattctggtgtcatgattcgcttcaatattcaaagtgtttcgcaaactggccgagcaacgttaggggttcgtttaattcgagttgacgacgatgccaaggttgcaacgatggccaaggttgaaccggaaagcgacgatccagacgatggcagcaagccagatcagccaactagcccgacagacggttctgctgcaccaacctcgcagcagccagctgatggttcgtatgctggcgatgccgatcagcaagtgagccaattgcttgatcgcgctgaagctgatcaaccagagcaacatgatactggcgaccagcctgaataatctaataatgctagcatcaattgagctgattcacgctcaataaaaataccggtcgaaatggcaatttgccacttcgaccggtatttgtttgcgtacagataacctcaaatcgtgaaggttgattggttgcccatgcgcgccttaagttcatggatgatcttaacgccgctgctggtaccgatgcgagtcgcaccagctttaatcattgccaaaaaggtatcaacatctctgataccgccagccgctttgacttgcacttgatcgccgactgtttctttcatcaaagccacattttcgacagtggcaccggctgggccaaagcccgttgaagtcttaataaaatccggaccgacgtccttagcaatagttgccattttgataatttccggcttggtgaggtaggcggtttcaaaaatgactttgcacggtacattgaccgcatgacagacagcaacgatttgacgcatttcattttcaagatagctgtattgctgttccttaagcgccgtgattttgatcacgtagtcaatttcgttagcaccgttttgtaaggcgtctttggtttcaaaaactttggctgcgatgcttgtttggcctaagggaaaagcaattgcggcgccgacatcaatgtcggtacctgctagttgtttcgcacaaaaagccgattggacttggttaatcgccaccattttaaaatgatattgtttggcctcgttgcaaagctggcgcaaatctgcgtgagttgcatctgcatgtaagtttgtgtgatcaatcatgcgactgaattgatctaaagtataagctgtcatgatttttcctccaaagttgaattcgtttacatttagcataccactttttgcgtaatgtatatctgacagcgataaatagtacggtgttgtgcaagcaaccatgcagaagaaaggccattgcggtcaaggtccttatgtgcaggttgctgcaccagtgaacgcgtttagaggaggagaagcgaatgttgaatagtgtgagtctaacagggcggttgaccaaggagcctgaagttttccgaacggctaacgagcttgatatcgtccgatttacgttggcggtgaatcgcgttttcaagaataaaacgggacagcgcgagactgattttattgagtgtgtcatttttggcaaacgcgccttaacttttgcgggatcaactaccaaagggtcattgttgggtatttcagggcggctgagtaataatcattttgaaaataagcaaggtgagcaagtgtggcggaccgctgtcgtcgttgataattttgcttggttggagtcgcgagccacgacggaaagccgccgagcagggaccttgcaggcgacaggaacagacgacgtcatgccagtagaggaaggcaccccgccacaggtcgcaaccgacgatctgccattttaaaggtggtattcgccgcggatctatgctacaattttaactcgtgagtatcaggctattctatagccttagtactctccttgctccggcaaatgaccggggcctaaagtccataaggaggtgaatcgtcatggctgaaaccaaatatgaagtcacttatatcatccgtccagatttggacgatgctgcaaagactgaattggttgaacgttttgacaatattttgaaggaaaatggtgccaacatcattgattccaaggattggcaaaagcgtaagctcgcatatgagatcaacaagtacaacgaaggtctctatcatatcgtgaacttgtccgcagaagatgacaaagcgatcaatgaatttgatcgtcttggcaagatcaacaacgatattctgcgtcacatgatcgtgaagcgagaagactaatcgtaacttttttgaaaggggcgctacggcatgcttaacagtgttgcattgacaggtcgattaaccagagacgttgatttgcgttacacgcaaagtggcacggctgtcggttctttcacgctggccgttgaccgccagttccgcagtgcaaacggcgaacgtgaaactgacttcatcaattgtgtgatctggcgtaagtctgcagagaactttgcaaacttcaccaaaaagggatccatggttggagttgaaggccatatccaaacgcgtacgtatgataacgcgcaaggacaaaaggtctacgtgaccgaagtcgtcgttgaaaactttgcgttgctggaatcccgggcaacgactcaacagcggccgtccgaaccggcaaatccagctggccaaggtaatcagaactatggcggcgggcagcagtttggcaataaccaaccgcagaatccgccaaagaatccgccaagttttggttcacaaggcgccccgaacaatgcatcatcatcgaatccgggtcaaaatccggcagcaagtcagaaccagggaggcaactccgcggctaaccctgctaatcccgatccgtttgctaataatggcaagccgatcgacatttccgatgatgatttgccattctaaggtgtgacgcaaagtcgcactaaccgcggtaatcccttcaggcgaagggttatctaagtggaatctttgataagggaggaattctcatggcacaacaacgccgtggtggccgtcgtcgtcgtaaagtcgacttcatcgccgcaaaccacatcgaatatatcgattataaagacacgaacttgttggatcggttcatctcagaacgtggcaagattttgccgcgtcgggtaaccggcaccagcgctaagaaccaacgtaagctgacgatcgcaatcaagcgagctcggattatgggtcttctgccatttgtttcagaagattaattggtattcaaaaggacgttcctgcttaactggcgggagcgtcttttttttgtgagcgtgaattggcgcgggtagtaaccggagcgtaagcggcctaagtcgtgatgaccggtcttgggtcattgcgacttaggtctttacgtgcaggatactgcgccaattcgcgcgttatgatgaattttgacgcctttaattgttattttcgatcctgtcacaaagaagagaagtgtatgagaccaatcggtaaaacagcaagcccttttctcgaaataaattgaatactggctaaaaacattttctatcatgaagcagaccaatgtatgacgattgcggtatttatcacaagcttattgttatataaaataacgagatagttctacaatagcggtgatcaggaatacaggggaaaatgacattattggttaatagaggtgatcaaaatggggctcacgttagccacgattccgctggctgtgacgaatctgtcacgcatgcagtttgcggtaaccgcgatcacgcattttctatttgtaacaacgaccattggcatgttgttgacgacgatgatttttgaatttatgtacgcgtatggccgtggcgatactgaaaagtatggccggctgaccctagattgcaataataaagttaccacctagaaagaggcttgctcactgcttgctataaatttactacaagggtcgaagatatggtggcctagttcaacagccactaggtaggctttattttgtcgtggagaaaaaacagtggtgttatcatttttcacagcatgacaaaagaaataatttccaatactaatactgggaagtaagtttcttaggaaagacacttgcttatagctcaattgatttgctatccaagtcaattgctcggttgcctttctagatagtggctgtttaattaggccaccatatcttcaaccttcgtagtaaatttatagcgaatttgataggttactccttctgattctgccaaaacaaaaattggtatagcaaaaacccgcatcagggccaacacattgctcaggacgattgcctcatcgatctttacggccaacgattcagcggttcgagtgttcaccaaatcaagccccagtgaacccttcataaaggcaaaccggcgctctatggcacctcgtcgattctcggcgtcagtatcttttcggcgttgttcagtgttaacgtgtttcggatgacgccccaatttgggaccacagatgcggatacctaagtctttgcatagcttcaggttctctcgattacgatataatgtgtccgctagtacttcatcaggataatgtccgtgcaagtcaaagtagtggtccaaggtctccttaaagtctttgccttcagagaaggcattaaagtcgaagcattcgatatcgattacgccttcgcttagagaacaatcaatcttcgcgccgaattctactttggcatttgctttgccacgctgaatcgggcggatgtatggctgttggagactgacaatacgattttcgacgcgatgcgtcttatgggtatacatgtaccactgttggtcaaacaagatccgaatgactcccaggcggattgcctgcttttctggcaaagttgccccaaggtctaagaactcgttgatgtagcgcagatcgcgacgaacgtattgcaattgtgctttgacctgcttatgaaagccgccgcgttgttgctttggatggcgcgaaaacgccgtccaacagtgtttggcttcacgtttatacatgcgtgggttcggcacacccaattggtgtgccatatcgattgccatcgcttcatgattgagccgagcctgattgagcaacacagtatcttgcggatacttgattttaacgggtaccgctgttgcatcagtgatgactgtgtctaccttgaacgggaccaacgcttcaatcttagcccggacagtgtcgttgatgatattggtaatcagctcagaaatgtcggcaatccgcttgcgaaagtgagccaagctggagtagctgaatggcgccactgctttgtactcagacaaaccaatgaagtattgaagcgccggtgtatcccgaatcgccgcaactacaccacgatctgttagccccattcgttgttgaatcaaaccagcaccataaagcatgcgaaaaggcttcgcagcgcggccaagattcttggtaaactccaattggtatgcgtcatcgagcgccttccatggcataacctccgccaattgaacccattcgttatctgggctaagaggtgtgcttagaccagcgccaaaagattcaaatgatagttgaagcgggctgtgacgatatgccatgagataacctccaaggatattctggaaaaatgcacgagaaatgtgcgaaatcggtaattttctatggatttattataacgcaataacgagcttatgggttgaaatgcttgaacgttatagtttttaaacggccactagatagtccaactcttttttttgcataaatatcaacgatatcttgatcgttgtttcccataattcccacagttttgaatgtggtggaaacgcgctttaataacgacaacgtttccaaaggcataggtccagcgatcagatcaccccccaaaacaactaagtctggagacagtttctttacctgttttaaaacctctttcaaagcaggataatttccgtgaatatcatataatgctgctattttcattaatatgattacctttcctaacaaagattaaaagcagggtctcgtattcctaactttcaaaatccgggtgcgatactaacaacagctatcaacaggatcaacagtcagtcattggttcgatagcttaagttatcattctaaaatataagcgcaattgatttaaaactgatgatcacttgcgactagtatttgaaaaatcaacttcgtttggtcaaacatactctgaatatctggttcagttattggagatgccatctggcaaagtgcaagcggcatgccaatgaatgaaattgttggccatccgtcttggtacaagggttggccctctccaaaataggcattttttcgtggcttcaggatttgatatcttccactaacattggtaccacttaaactcttcaaaaccaaatccctgttttctttagtcgaagcatatacatacaaaggatcatataattcagtcgcaataagcttgttttccttttggctatcaacataatcaaggccccctaagtgttcaacggttaggcctaaagccttcttcatttcaagatgctgactagtttcatacatgcttaaatcacgcagaaatcgcgaagtggcttgccttccttcaattccgctttgtggaatttgaaaatgaccactcacaaatccaaacacaagtgtatttttaaatttaaggttgtcatgtttaatggcatgtaagacagtgagcaatgcaattgccccattttcttctatatcgtttggcccatccgtatgtgtatttataaggatttgtttgccccgattttcccccggaacaagaacagcaaatgatttcgttattacatttgtctcatattgtcccgttagtgttagtcttagaacctgtctagtatctgctgaatctggtagaattgtggaaaaccgacatggcctttatggtctagtcgtcagggtgttgcacttgaattgtaaactggggataatgatcttgcttgcttacgttcacgatattgagcatgcttttggctgctctagttgttgttgcttgaacaggttgtttggctgccgcgacatcaaaggcactggcagcatatactgccgctgcggttagtgataggattgcgctgctgtataacaaagagcgtggcacacgatacttacgggtgctggtgcttgagccattatgcattgaaaaaccctcctaaaactttttcatagaccgacacccgccataggcctagtggttggtaccagtcaaaggaattgtaaccgcattcaatgcactatctcaaccataaatgagcgattatttgcaagtgatttatagtttcatagattatttttcatgaagtataaatatattgctactgagatgattaaattaaaaacttatgacggcatatcaataactggcgttgttcttcgaatactcaagtaatgagcagcagttgaatgacagcaggtattttttttgaaataattcatatgtatctcattacattcacgttcttacttatccgcattcccgcctctgctttgctataatcacaactgaacacaatcgttataaagaaagtatgatttcatggctgacgaatttcttgcgcatcctttgatcacgattacgaacgttatttggagtttttcgccgacaacccaccagttgcaggtgcttttgattcatcgtgccggggcaccgtttgccggtttctgggcattgccggaaaccactttgcgtgaacgggaaagtgcagacacagcggcgattcgattgattcgcgataagatcggaattcacgttaatcgtggatcgacagagcaacttgcgacatttaccgatccgacgcggacccccggggagcgcgcactggcgttgacttacatgacttacttgccaacgatgccgaagttgcaaccgggttacggtgctaccgatgcacgctggtttgcttttagtgctgctgatgaagcaggttatcaactgcaaaatgggcgaacgatttttccgctaggcacatcgacatctgagctagcgtttgatcatgcccggattttgacggtggccattcgccgtattcgtaaccgactagactatcagcctacgattcttcaagttttggggacgacgtttacgttgaaagaggcgcgcgaagtgtatgcaccatttttaatgacgactgcaaatgcgattgataattctaattttaagaaaacccatcaacagctgtttattgaagtcggcactgctcatgatcgcacgcgtagtggccggccaccgaagcttttcaagctggcagagttgaaaaatccgatgtgaccgcgtatcgtagagagcaaataaaagtcggatctacttttatcgaatgcgagtttaagtaaaaaatacttttattaagaaaggatacaaattatggcacacacaaatgaagcgctgctgatcattgattacaccaatgattttgtggctgacgaaggggccttgacctgtggcaaggctggtcaagtgctagcaccacaaattgttgctttggccgatgaatttctacagcaagatggctgggtgtatttgccaacggatgttcacacgccgcatgatccctatcatccagaaagcaaactgtttccgccgcataatgttcgcggtacgttgggacgtgctttttatggttcgctggcgccttggtacgacgcgcatcaagccgaagatcatgtcaatatgtttgataagacccgatattctgcttttgccgggacgcccctagatttgcgcctgcgcgaacggaaaattgcgactgttcatttagttggcgtgtgcacggatatttgtgtgctgcatactgcagtggatgcctacaacctgaattaccagatagttgttcatcagaaggcagtcgctgcattgacaccagctgggcaagattgggcacttgatcattttgcccatgtgctgggagcaaccgttatcgattagtgttgagacgtcataaaagaaggttttattaaaatgaatatgaatcatgccatgttaactgatttatacgagttttcaatggccaacggttattgtgcgaccttgccgcatacagatcaggctgtttttgatattttttatcgcacggttccagatcacggtagttttgtcatcgccgctgggttgcaacaggtagtggaagctttgcaggcgtttcattttgacgatgctgatatcgactacttgcgttccttgaatctttactcagagacttttctaaatgagcttgcgacgatgaaacttacttgcaggatgactgctttaccagaaggcacgccggtttttccacgggaaccgctgcttactgtagaagggcccctgatgcaggtgcaattgctggagacgcttttgctaaatttggtgaatcatcagtcactgattgccacgaaggcgcggcggattaccgcggcggcagaaggtcgtcctgtgatggagtttggcgcgcgtcgggcacaaggcccagatgcttcagtatatggcgcgcgggcagctgtcattggcggctgtgccagcacatcgaatgttttggcagcccagctattccatattccggctgcgggcacaatggcacacagttgggttgaatcgttcagtgacgagctgacggcttttcgcgcatgggctaaggtgtatccagataatagtgccttgctggtcgatacttatgatgttctgaagtccggggtgccaaatgcgatcacgatcttcaaggagctgcgtgcaacagggcatcagcctgtgggtatccgaattgattcgggcgatatcacccagttagctaaacaagcgcgagtgatgctggatgcggcaggttttcaggatgccaaaatcaccgcttcaaatgccctagatgaaactgtgatccaatcgttgctaaaagaaggagcaccgattgacaacttcggtattggcgaaaagctgatcactagtgcctcgtcgcctgttttgagtggggtctacaaaatggcggctctgcaaacggatggtcaatggcagccgaagatcaaagtcagcgctagtcgcgaaaagacgacattgccaggccataaacaagtttatcgcttataccaccgtgacagtcatcgtgcttttgctgatgtcattgctttggcagacgaaattttaccggaaacaatcgccgccgttaatgctaatcctttggcaacccagacatgggtcacgcttgctgatttcacggccaagccattgttgcaaccggtgttcgcacccggccacactgctgatgtaccaactgatgttttcgcgatccaaaaatatacccgcgaaactttagcggccttgccagaagccacccagcggcttgttaatcctgatttttacccggtttatctcacgccgaagttggctgagatgcaacagcaattgattgcggttcatcatggaaattaatgtgacttgatagttaatgaacgaacgttaaaaagcacacctgctccaaaaccaccattcttgctgataactggtggctctgaagcaggtgtgctctttttttatcgcaaaaattaaactatttctgaaaaaaatctctgttttccggcataaatagctatctttcagaaaacttacagaaacaatacagcctcttgccgcggttttttacaaatgaccgttaaccttagcattaaggtaaggagttgaggagaagtgagtattcgattagcgaacgtgtccaaagattttggcaatactaaggtgctatcgggtctgtactagaatttcggacagaaacataagagaattgatttatccgaaaatggcctttatggtctagtcgtcagggtgttgcacttgaattgtaaactggggattttgttaaaatcagtgtccactggcaaactgtagcgccgggagctatcgaccttggctttacttaacgttagaataccggacttcgctttgccgatcggttgggtgaacgggtagaacaagtaagccgaatcataattctgaccgtatatattggcgtattgttgctgcgccccagtgaccatcttcacttcattcacatgttgtgatcgatcaccatccggatcaatttcctgatagaaagcaacatcaggattttgcgcctgcgtggttttgatcacaccattaatgctggtacgcacggactttttactgtaggctcgcgaatatttgccgccatccatgaaaaaactataacctggcgggtaggaaccatacccgatattgtaagtcatcgccgtataagtctggcccggtttaaactgcgtactttgttggttcttcacttttagcgcctgatcatcaggcacgcgataataagtggtgaataaataaatcaaatatccgccggcggccaacaacaagacaccgagaatgccgccaacccatttcaaaattcgtttcaccgtcgttcctcccaaaatagttgttttgcttattatagcagttgtcttttcctctgagaccagtactatgaggatagacttttttataaaaaggggatcgccatgtcgactgaaactgacagcattttagctgctttcgaaaaattcaacaccattattatccatcgtcatattaatcctgaccctgatgcgattggctcacaaaccggattggccttgctgctgcgtgccgcttatcctgccaaaaccatctacacagcgggaccggccgcccccgatttagcttggatcggaccacaacaacaagtgtccgctgaagcttacactggtgcgctcgtcgttgtgattgatacttctaatcgcgaacgcattgccggtgatcattttgatcaaggagcgatgctgatcaaaattgaccatcatctggatgaagatcagcttggcaccatcaactgggttgacacccatgcttccagtgcatcagagatggtgtgggacttagtacgtcacagcccacagctgcaactcaccaaagcagccgccacagcactctacgcaggcattattggtgacaccggccgttttctgtatgatttaacaaccgcccgcacccaccaagctgctgctgacctacttgcaaccggcatcgatgccgccgcaattggccgtcaagaagaccagttcccggaaaatgttggccgcttgattggttgggccttagaaaatgtcaaaatcactgacactggggccggatcactcctcatcacaaaggccctgctcgcccaatttggccttgcgtatggcgaagaacagcgcgcagtcggcaatatcggcaagctagccagcattgatcgctgggtggtcttcaccgaacgaactgatggcagctatcgggttgaactccgcggcaaaaccaaagaaatcaatgcgctggccgttcaacatggtggtggcggccatccgctggcaagcggcgccgtggcagataatgctgctgaacttcatgctattgaagaggaacttgcatcgttataaggtgtcatgaagaatggtaatggcccggacgaatgatctaaacccaaaagccagagcgatgcctcatttctaatgaatagctgttgtgataaagactggtagacttggttttcaaaaaatacggtaaaatattagaatcgaggaaaagttgacacgtactttggcctgtcaaatcttgtcaacctctatatttatgatatgctgatagcactttcaagaaatctttcatggttatatcaaaatagccgtttcccctgctagggaaacggctatttttcaccactgcgataagtcgtaggcggtatgcgcgtgggttataaccaaatgaatagttcttcgaacgtgaggactgtcttcatttcagtctaagacttttgattgtttgcttccgaatgagtacgagaagttagtctaacggattcctgccagacgaaacctcgcaatctccttataatcaactttttctctcgaatctcttcgcaaaaggaagcatgtacttaccagcaagatcacgattcgcaattgcttgccaccaacttttagggacagcatcctgaccagccgcaactagcaaagacgcagtaatagtcgcgactgtatccgtatcctcgccaagactgactgcagtcatcatgccatttttgaaatcaggtgcattgcctgccacccaaatggcagcttccaaggtatcaacaacatacccgcttgacttgatggccgacctcggaaggctgataaagtcacgctcaaacaatcgccgataaactggtagttccgcttgttcggccgccggtaaggcttcaatcgaaaaattaacggccattaacgcctgtgctagggttttaccatgtaacagttgccacaaagtttccagataaatgatgcttccgagcactgcccgggggtggcgatgcgtcatctgggtgtaagcccgataacttttcgctcgcgtgacaaaccgcgattcagtatacaaggcaattgccaagggtgctaacctcattaatgcaccgttgccattcgcaaattcagatggatccccacacatgatcggggcggcatgctcaatgacatatttacgaatcgcttttgcacacgtattgccaatgtcgaacaactttccgttcggtgtataggcaccatcttccatataggccacaaatctgtccatcagatctgtataagaatcaccttcatttagatgatcaatcagtgcaagtgtgaaagacgtatcatccgaccaggtgccagccgcctgctcccaaaaaccgccgccgatcatcataggttcaacgatataagtgtctcggtgtttaaattcataaggaacgccaaaagcatcaccgacaatcgcagcctgaagcattcgcaaaatccggtctggcatcatccttttcacctccaattcatgtgttaagtctatcacgtcattgcgatcattttagctcattcgccgctcgtcactttaatcccaatgatcccaatcacaagcagtgcaatgaagaaccaagtcgctggttgcagttgatctttaaacaagaccacaccaacaataatcgatccgacagcgccgatcccggtccaaaccgggtatgccaagcttaatggcagatgtttaacagcaagggccaagaaccaaaagcttaaaaccatcccggccaaagtcgctaacgtaaatcccaaacgactaaagccatgcgacattttcataaaggttgcccaaacgacttcaaatccacctgctaaaactaaatagaaccactgcatgaatgtgtcctcctcgtatcattttgcagcctcaaaacaaaaaggcgacagtatacgcaaccgctgcattgacctaatgcggttgcgatactgtcacccggtagtgactgctatttaaataaatgttgatgttattttttcacatattgacaacggcgtcaaggaaactgctaaaagttccgcgcaatgacccacaaaatgatgagttgcgcaaatgcgaacgaccaagtaaaagccagcgcccatttgctatgttcaacaaccatgagatgcccggcaagattgccaatcaccaccaatgccattacaagccacaacaacgctcttgtacgatggtcgattggtccctttgaagtgcgcatgatccagaaaataatcattgatgtgattgaaacacccaaaagaaccccgataatgtgtaccataacgctaccccatttcgagcgcataccttagttattttgcaaaacattctatccgtacttcttaaccatatcatgtctccacttgatccaaggcaccattttaaacagctttgccaatcagcagctctgtccatcccagcacaaaacccgctctaatcgcaacattcattgattgcacatgggagaattgggtcccataaagtggcaagacatcttggcgtcgatgctggatttcagcggttagttgctgtactaaccggctggcaatgccttggtgacggaaggcagggtcaagcagctcaacgccgatctcccaacagtacctgccattttgactggcgcctgctacggccacgaggtctccgtctagttcgtagccaatcccaaggcgatccggtgccgccggatcataaccaaacgccattttgatcgcatgattggcttggtatttcggaatcgcatccgcttcaatcaaatgcatgcccgcggttaattggcgacttagctggctactaggcacgaagaaaggtgccatattggtcacttttaacccaaaattccgaagcaattcggtgagttgctctacggttttcatttcaaggaaccacgccccgtctgcctgtccaaaagcatctgctaaggcagctgtgacctctggctttgttgtgcgcacccatagtcgtcctttgcgaatgacaatgtcaccaacatcacgcgcccaactgcgggcagtcggcacaggcggtctagtcacgaaaagatttcctgtattttgcagccgcgatgctggcacttgcaaatccagtgctaattgtttcgtgataagtgacatctcatcctccagatttaaaatgttgggcgttacttttcaagggtcttgcttaaccatgacacgttcgcgaatagtcccaaacttggtcgtatcttccataatctgatctgtcacgctaaagccaaaatgctgatagaatttctgcgcagatacattattatccaaaacacgaatataaaactggtcaaatttctcatgcaggcgctgtaatgcccgcgtcatcatgacactaccaacgcctgtatgttgaaactgcggcagcacataaattgaataaagctcaccccagccgttaaaatccggcaaccgcgctggaccaaagctgcaaacaccaacaattttatctttgtcatcaactgctaacagcgtgtcttgccagcgccgttccgggtgccaactggccggtgagagttgcgccaaaaagtcatctggtatgagtccgtggtatgcgtcctgccacgtcacgtagtaaacctgccgaatagcatcaaaatcagagttagctgtggcttcaataaccttcactttagcagtcattctcttcgccatatttaccgttaccttgctgagccaaaatccatgttgcggcatccgccaaactggcacattcaacaaacgaacccgccacctcttgataacctgcatctccacaccctgttgcgacatgaatccccaagatgccagcattaatggcacattgcatatcagccagataactatcaccaacgatcacagcatcacgattcgcaaaacgatagcgaagatgtgcttgtgcaatcagaccggtcttaggttttcgacatggacatccagcgttctcagcatgtggacaaataaaggcatcagaacatcccatttcaagtaacgagatgcgcagcgcggcttcgtccaactgcccagaagcaatttttgtctgattcgtcagcgcaaaaacttgcaacccagccgctcgcaaagatcggatggccgccacactgccgggataagattcgaattgctgaatcgccgtaaaatgaccgtccccgcctatggtgccatcgcgatcaatgaaaactgtcttgatgaccaagtgtgaggctcctttcagtcgtatcaaacaactaattccattgaattgctttcctcaattttcaagtcaagtgcaacgatgataacgaattcttgatagtggtccataggatcaatagctggttagatggtcatctctcacactgtttgcaccagatccgtatttggctttgccaatattcgtcttggtcatgtgggccgtttattatttatcgattcaaaccattggcacaatcggcagtgattatctcaatgacacggtttttggtggctggctgccaagtgtcgtcggcggcaccttgaaaagttgggctgttgccccatggctatccggtctgattgtcgatggtctgattggcggtattggttccgtattgggcttcttgccgcagattatgatgctttttctatgtttgggtattttagaagactgcggctatatggcccgcattgcttttgtcatggatcggctgtttcatcggtttaatcttagcggtaaaagcttcattccaattttaatagcgaccggttgcggggttcctgggattatggcgacgcggacgattgaaagcgaaaaagatcggcgaatgagtatcatgttgacgacgtttatgccgtgttcagctaagttgacggtgatcgcgctggtcagcggcacgttctttccaagcaacagttgggtggcaccatccgcttatttcatggggatcattgccgtgatttgttcgggaatttttcttaagaaaacagccttatttgctggtccaccagcgccgtttgtgatggagctgccagcctatcacttgccacgcctaaccaacttgtatcgcagtgtcatgtcgcgggcacgcgcttttgtgcagaaagcagggactattatctttctgtcatgcgtgttgctgtggttcttatctaatttcaatttcggtttccagatggttgacgaaaatgacagtatgctgcgggggctagggacggtgatcgcaccggtttttgcaccgctgggttttggcgactggcatgctaccgtggccactttagccggtttgattgcgaaggaaaattgtgtcggtaccttacatatcagttttggggcaggcagtgccagcggctttggtcaggctttgcgcgctacctatccggcgatggcaggatatgcctttttcgttttcaatctgctgtgtgccccatgttttgcggcgattggtacgatgtataaggagtttggtgatgcacggtggacatggcgtgccgtgggctatcaaactggcgtggcttatcttctcacgatgttgatttatcaaggcagtctcgtggtatccggccaagccagtgtcatgagcatcgggctagttttagtcgcaattttagtcattgtttatgggctgttaatcaaacggccggttccggaaattgcttcaagttattaacttgtcaactcatttaaaaaagggagtcttagctcatggcaacatggattattggcggtatcgttgttttaattattgcggttgtagcataccgtacatttttcaaaaaaaataagactggttgtagccaatgtgaagaagtcggatgcccgctgatcgatcatgcgaaaatggtgcaggcgaacaatcggcggaaggcttaacccgcatgattttttaacgtatcacagctaacaacgcgcgagcccaaactagtgaagcaaatcgctagtttgggttttttaaaactcgcgtccgctgcttcgtctcggtataattgaaccatgcaaacattttcatttggcatccatgttgttaaaaagatagtgcgtgattcagcgtgggctgaagagcacgttcaaagagggggattcaaccatgacaagtaagcaaagtttttcaagcagtgacatcaccagtcagagcggctatttttcagcgcttaaggccacggttgaaacagcattttacggggagaatgtgaagcaggttaccaccatcgcccaagcctatgctttagccaaaacagcgccgggtgtgattatcacggatttaccgatcaaacatacggctgaactgggattgccgccagatgccaaggtgttagtggctaatgacggccgtgtagttggtcggacggcagctgcccgccagattattgatcagcctgacgtggatgagactaagctggcggcgattgctcgggaagctgtctttttagggagtcgcaagacttttctccgtggggatgtcacggttggcttgtcctctgattttgctatcaaagcgcatttgatgctgcctgaggcgtatgcaaataatttgtatacgtacttgctgaattttcaaattgatacgccacaacgcaatgctgaatatgaacaatcgcgcccactcccagaggatgatatttacctttatgccgatcccgattggcatgatccggcgtatccaaacgggttggccgtgtttgatccaacgcataatgctgccatcgtgttaggcttacgctactttggcgagttgaaaaaaggcacgttgacgcttgcgtgggcgacagcgcatcggaatggttttgtcgcctgtcatggcggtatgaaacaatatacgcgacaggacggcgattttacgatggcagcgtttggcttgtccggttccggcaagtcaacgatcacgttggccagtcacggcgatcagtatcccgtgaaggtcttacatgacgatgcctttgtgattgatcgacaaacgggtgcaacaacggcgcttgagccttcatattttgataaaactcaggattatccgttgagtgatccgggcattcagtattttctgacggttcaaaatgttggggtgaccctagatgccgctggtaagaaaacactggtgacgcaggatattcgcaacggcaatggacgaaccgtgaagtcacgttacgtcacgccgaatcgcgtggatcatcttacggagagtatcgatgctattttctggatcatgaaggatgataccttgccgccggtggtgaaactggaagatcctgatcttgccgctgcttttggcgtgacgctggcaaccaaacgctcaacagcggaaaacgttatcggtgatgttgatcgtgatcatcttgtcatcgaaccgtttgcgaacccattccgcagctatccgttgggggaggattatcaagatttccaccaactctttgaacaacgccaaacagcttgttatattttgaatactggttcttacaacggtcaaaatgtgaaaccagccgatacgttaggcgcgattgccaagattgttgacgaaacagctgccttcaaaccatttggcctgctaccaaagatgcggtatctgccgttatccggttttaatgttgattttggcgacaacgattatcgcgttcgtctccgtcaacgtttggaagataggttggcgtttattgcgactaaagacgttgaccatgatggttatgatcgtttgcctattgatgccagccgtgcgcttgaagacgtcatcgctgcccttgaccaacaagccgccgcaatgtgagcaaggtagacccacccccaaattttaggatggtaaccatcgtcatttaaccatggacaaacccatacgcattgcatgaatgattaaaataggggatagtaaagctaacctcaatacacgcagcccattgcactaaaaagatggcagcgtcatgcaaaggagtgcagcgtatggcgattcattttgtgatttatgaaaagcctaactgcgagtcatgccggctcaccaaacgctggctcgcagaacacggtcaacattttcgtacgaagaaccaccgaggtgaatcaaaccttgttgatattaacgccaatgatccgttaaaacgggcgtggagtcaccaaaaaattgtcaaatttcgtgaggccggatatgatcgttttccagttgtgtgcgttcgcgacgatgcgacgggtgatgtattggcaacatggagcggtttccgacctgaagcgttggctagctggacagctattaatcaacttgggtaaggcttcagctactgacatgaaaaagcacctgaccgtttttgtgcggtcaggtgctttttgacttgcatgatcatgacgaggaaactgggcatgattttagatacgccactacctatcgcttaactgttgaagaatgctgagctgggcagatggtatttggccgttcatatccggaccaacattgagtaaaagtcgaccgcgtttagacctaagctctgcgatcaattgcttgatgtcatcagcagtaatgtagtcctctggccgactgaggcggttataaccaaaacttttgtccatgccgcgtgtcatttcgaaataacgatttgtttgcggccagtcagtacgatattcaagggtgcggtagtcatagtacttaacctcgctgagatcgtctgagtgatgttggtcacgtttaatgacctgcgccgcaacgagattgaaaataggtcgtatccaactggttcgcatccaatcaggaaattgttgccagcggtcattcactaaaccttctgggacttgttgataataatacttgaacagcgtttccaagcggtgatcatctgcgtagccgatatcgctccaaagcacatctgggtgataccgatcaatcaattcgtgccactgacgccatacataatctttgtaagtttggcttttgtcgttgcccaatagaaagctgccgtaatctttgattggcagatgcgggaaagtccagtccaataaagatgaataataggttccaaaacgcattccgtgggcacgaacagcttgggccagtttaccgacaaagtcgaagttcaaatgatagtcaggttcgtacggattcttggtgtgcgaatcaaacatgacaaagccgtcgtggtgctttgtaacgatcacgacatatttggcgccagcattggcaaatgctgtggcccaggcctgcacatcgacattctgggcggtctgcttgaacgtttttgcgaaatctgcataagaggtgttgccataatgcgtccggtgataggctgctacggggctgtttggcaataacatgctgttgccataccactccgcataaggttgatgttcaaacaaataacctaatgatttggttttgattaaagtgccgtaatcaggaatattaactggcgcgtaagctggcacactatagggtccccagtgaatgatgatgccgaaatccgcttgtttaaaccagtctggtggattagtgcgatgaatattaacagctgaaggtttggtcatgaagatcgtctccttgagagcatgatacacgtcgaaagctgtcacttctgctcaggtcgaaaaaatgttgccagttaaatgattgatcgatgcatcatttagattttgatgactgcgtattcgtcacccgtttagcagctagagcagcgtacatctcatcacgagcggcaccttgcaatggataatgtcgggcaatcagataggctaaaaaagaaaacaccgcaggaatagcgaagaggacaacgcctaaactttgcaacaagttgtctggcacatgcgttgccttttcgagcgtttgggcgttgtaaccaacgatcagtagtgcagcaccgacgccgattgtggctagtcctgattgcagtttttgcagaaacatattcacggcattgatagtcgcttccataccagcattaagtttgagtcggttgtagtccattgtttccataatgatcaaattggcagggacaaactgtgctccagcgatggtcatgacaataccgatgagtaagtagaagacccacggattatcaatgacatgaatttcattaatgataaacatgatgactagaaacggtgccatggccagatagcaccactgaacaccgcgaatagccgaaatgtactggattgctttttgagaaataagtgtgcctgcgactagtgtgatcaaggttaacaggccaaaatacatggactgtgtgccgagatttttcaccccaaaggcatacttgatgtaataaagcgaggttgcggtcagtaatgcccaaacaaacccaccgacaaaggtaaagtacaagttgatacggaaagggtgattgatcttgatcatctgaccaatatctcgcaatcttggcggcttagcctcctcggtaaccggaccttctttgaccatgacaatgccgatcaacgacaaaatcagaaatggtatgacgatcagatcgacagttaagggaatattggggttgcgctttgttcctagatatgttgcgatcgccatgaagaaggcgaaaaccaccccgacaatattgctggtgatccgtggccatgaaattaactttgcacgcacttcctggtcggctgacatggtactggtcaacggaaccgtcacaataatcgtggcagcaaacataaagagaaaataaacgacatagaggtaaacctctttaccgaaattggagaagttttgggggatgtgaaaaagcatcatacccaaaataccggctaataaactgcctattaacacgtatggtttaaactttccccaccgggttcgcggcgatatatcgatcagatagccagtccagaggtcgttaacagcgtcccataaccggccaacaaataacagggtcgttgccacagcagcggctttgccgggtacaccggaatagatccccgagtagtcagttatgaacatcatcagaactgccgtgtataaataataagctgttgtgctcattaaccccatagtgttgatcccaaataaagtctgtcgatcgagtggatattgctttggataacctttcataacgttcctcccagatagccgtctcggtgcgcttgcaaaagcccgagtgcgtaacccgtgtttgtatggatagcaccgaacagcttgattaaattataggtgatgttctgcgaacttgcgagaaaacgttgttgaaaggttcttttaaagtgactgaattaacaactaatggcgcaaaattcaaattaccaatcagatcaagcatccggaagtcaaatattaagatataaattgtcaatatttaaaaaatatttttgttatcttattttcagtgcaactggccatgaaacatgaaaatcacaattagttgtctgtcaagacatgggagcacaactcaaataaaacaagttttcataattgaatagattgcgtgcaatatcaaagaaaaaggttttcacagactgctgtcatgtttgcaaatcgtaataataataggcttttggagggttatataacgttaggtatttaaatattagacaataattatattgattataagacattagtgggtataattaagagcgtaagttgatgaagtcacaagactaggggggactatgaaatgcatacacgatgccaagaaccaaactatgttgaagttgtgaaccagaacttggaacgactgcttgtttttgaaaccgtttttaaggaatatgtgcacacgtgcaaaaacatcgagaaaggaaattgctatgcaagtgaaagtctcgatcatttgcgtttgtacttcaccaagaatgtgatgaaattttgtacattcgttgacagtgtggatgcggaagcagcaccttgtaattatgcggccttccacaaagtactggtgattggtttgcgcggtattcgtggcggtgttttgaacatgcttcaagcaatcggcactgacaaagtagatcatgaccgatttgccgctggtttagccgaacaacaggctgctcgagctgagatcgatacagctttctcaaaaatcctcgacccaattttttaagccgatcacccgcttctttgtggcataatagaggcaaagctagaactggcgcggttagaaaccgaagtctcaacaagattgagatcgtgccacgcaggtttctgcgccagcgagtgcgttcaaagaaggggatgacggcatggcagtttggcgcatgatgtttgcgcggccacagtttaagcacagacaaattaagcgcatggtcgatgatctcaatcgtgaaggtaattttggcggcatgccgattcatcgcatcacgcttactcgacaaacccgcgaactcatttatgtcgacttggaatttcagctaaccactgggctcacacaacctttatttgagcagatggcaaagtatattctggtcgcagtcgctgggttggctcacgctccgcaacccatttatcttgccgcaatggcgaatcctttcgcaaaattaaatattagttattacatctatccggatcatagtctggatttgatttattggcagccgttactgagggagcccacttaatcagtgctgacatatgcatttaccgaaccgcaaacctgttgaacaggtagcccggctcggttttttcgtatccactttttgctcatgaccggtatcgactcatcgttggtgtttaaatgcaacgatagttagcggcatgattagtttgcgtgtgacatctcattgagaaacagtagcgcgtttctagactagcgcaccaattcagactatgggctgattatcaagtagttcataagtatgctaagatatggcaagttatttcattccaaagtataaacaggcaccattaatgtaacgcgtgatttggcgtaggcagaaaagtgggatcagtgattagccgttaacacccgcttggggatcgcgattgcgagcgaacgtttcaactattttctatttcagaaaacgcattaaggggagaacaacgattgctagacttaaaacatattaaaaaatattaccagacaggcgactatacgaccaaagcgcttgacgatgtctcagttcaattccgggaacaagaatttgtcgccattttgggtcccagtggttcgggaaaaacgacgttactgaatgtgatcggtggccttgatcgttatgattccggtgatttgctcttacacgggcgatcaaccaaaaattttaaagaagccgattgggatgcctatcgtaataactcggttgggtttatttttcaaagctacaatctgattatgcatctgagtattttggaaaacgttgaacttggtctgactttgagtggtgtgtcagcagcagaccgccgtaaaaaggccgaggctgctttgacgaaggttggtttgaaggcacatatgggtaagcaacccaatcaactttccggcggtcagatgcaacgggtggccattgcgcgtgcaattgtctcggagccgtcgattctattggccgatgagccgacgggagcactagataccgaaactagtgaagaaattatgcgcttaatcgctgatttatctcgcgagcggttggtaatcatggtcacgcataatcctcaactggcgcatgaatatgcagaacggacgattgaattcaaggatggcaaaattctttctgactcacggccattcaaagatgaagaaaaaactgccagctttgacctgcatcgcaccaaaatgagttatttcacggcgcttaaattgtcatttactaatattatgaccaaaaaaggtcgcacttttttgacggcatttgcttccagtattgggattattggcattgccgtggttttagcactttcctcgggctttcaaaaacagattgataatacgcaagcggagactttggcgcaattcccgattacgatctcgactaacgccactagcttaacagcgggagcggcggataatacaaagacatcgacttttaaaacaacctcaacagttgtggctaagcaaagtgctagtgataaggcgcagcacaccaataagttaaatcaaaagtatattgattatgttaatggcattagcaaaaaactaactgacaacattggctacacttatggcactggtatgaatctgttacgtgacgtgaatggtaccatcaagccagtccaattttcgacagctaagccaagcagtaatcaaactcaacgtggcttggcgagcgctagttcatcagtttatccagttgatcgcgaaggcggtaccagttatctgaagaaaaattatgaggttgttgccggtagttatccgaagcatgatggggatgttattctgattgttgatcgggacaactcgacgaacatcaatgctttgaagaacctcggttttgatgttaaagatggtcaaaaagtgaaatttaaccagattgttggcactaagatcaaggcaatctcgaataatgcctattaccagaatgttgcaggcaatgtctatgtcccaacgaaagattacgcaaatgcttataaacaaaacgacaaccgcgaactgacggttgctggtgttctgcggacgcgctcgaaaacaagtgatggcttgcttagccaaggctttgcttattctgatcggttaacaaaagatcttgtggcattgaacaaagactctgatgtcgtcaaggcacaacgagccagtgacgtgaacatctttaccaatcaaagtgtggacaaagcgactaaggatcagttgatcacggcattaggcggttcggaaacacccacgcagattacgatttatccaaccagtttcaaggataaagacaagattctgagttatcttgataaattcaatcgcggtaagaaaaaagccgatcaggttgtctatacagatttagcggggacaatttccagcatgaccggtggcatcatgtcagccattactatcgtcctagtggccttcgctggcatctcactggtgacctcgatgatcatgattgcaattctgacgtatacttccgtgcttgaacggacgaaggaaattggggtgttgaaggctttgggtgcacggcgtaaggatatcacgcgtgtgtttgatgctgaaacgattatccttggcgttagttccggtattctagggatcattatcgcatggttattgaccttcccaatcaatgccattctttatagcatgacagagttgccgaatgtcgcgcaactcaatccgattcatgcagtgatcctcattcttattagcaccatcctgactgtcctcggcggtcatattcccgcccgcatggcagccaacaaagacgctgcgattgctttacgcgcggattaacgcatatttaggtaaaagaactgagcaacatatctcgatgatttgcgccacacaccgttttttggcggacaggcggtcatctgggaatgttgactcagtttttttgctttggtgctggttttttaactggacctgcccacgtttcacataaacgcgttcgctggcccagaaacctacacataaggaccgcggccactttatgctccggtttctacccggtccagctcacgctcttgcctatttgtcttcaccaaaaaatacatctataatgagagtttattgattggcattttgagggaagtgccatgagagcagctaggggatcatttcctagtgagaggatgtatttcaattgaataattcaaaggatcgcacgtttatggggcatccccgggggctattaaccctgtcgatgactgaattctgggagcggttcagttactatggcatgcgggcaattctgatctactacatgtattacgcggtggagaagggcggcttgggttttgatcagccgactgcgttatcgatcatgtcgatttatgggtcactggtttatttaagtgctacaatcggcggcttcattagtgatcggttgttaggctcacggcgaaccgttttttggggcggcgtgttgatcatgctaggccacattgttttgtcattgccaattggggcgactggactgtttggttcgattgttttaatcgttctgggcacgggcttattaaaacccaatgtgtctgaaatggtcggtagtctctatccggaagatgacctgcgacgcgattctggctttagtatctttgtcatggggatcaactttggatcgctcattgcacctatttttgttccgtggatggcggataaagtcaattttcatgctggcttttcgctagcagccattggtatgtttgtcggcctgatcttttacgtgattgacgggcgtaaatatattaacccagctgacaatactgctcctgatccgttgaagcctgaagatgttcgtccgttggtgatccgtgtggtggtagcaattgcggctgttggtgtcattttactggcgatggccgggttcaatgcgctgacgattgccaacgtaatcagcctgattaccttaatcgcgattggcttgccgatttggtactttgtgctcatgattcgtagtaaaaaagtcacgaagactgaacaatcacgggtgattgcctatatcccgctgtttttagcagcaatgattttttgggccattgaagaacaagggtctgtcgtgttggcgctttttgcggcccaacagacaaagctggattttggcttttttaaaattctccctggtaattttcaaactttaaatccattgtttattttgctttatgggccgctttttgcatggttatggatgaaactcggtaaacggcaaccgacatcgccgaaaaagttttatcttggtttgatttttgcgggtgcctcttatttatggatggttatcccagtgatgctgtttggcagcagcgccaaagtttcaccattatggctggtcatgagttgggcgattgttgaaatcggggaaatgttaatttctccggttggcttgtcagtcacaaccaaactggcaccgaaagcttattcgtcacaaatgatgagcatgtggttcttagctgatgcctcggcacaagccgtgaatgcgcagattgtccggttttatacgccaaatcacgaggtggcttatttcgccattgtgggtttggtgtccgttggctttgcggttgtcctggccttcttcacaccacggatcgaaaaattaatgcaaggtgttaattaggcttcgaagcttcaacgtcatttggtccatgctgctgacaaaatttggtggaggtgcgctgatggtgaaaattgcgttcagtgttgacaaccattttgatgtgaatcgcgtcgatggctttgagatgctgaagaagcaggccgtttatctggttgaacatgattatcagatctatgtgaatgccggtgatacttacaatgacttcaccaaatcattggcttattttcgcgcactgcaggcagaagttgggtctgcagtcaccattcgctttttggcgggcaatcacgatatggtgaatggcgcaacgtacgatgaaattcaatcagcggttgatccgctgtatctgcatgaaaagattttgccggtgcctagcaccaatgctgtcattattggcaacaatggctggtatgattattcgctaggacagcttggcaatatgaaaaccgatgcggaatatgctcaatggaaacgcgccttttggattgatagtaccattgacgcgcctgtcactgatgctgcgcgaatgcaacgggttttgaccaccacgaaggcggcgctgcaggccaatcagacgcaccaaatgatctatgtgacgcattttgtgccgattcgtgaggcaatggtgtacacagttgatcggccgccttggcagatggcaacggcgctaatggggtcggccaaactcggcgatttgctgacaggtaaagtgtcggcagtggtgttcggccatgagcattttcgcgatgcgcctaagcttttaagcggtactacgtattatcatcagccgctgagatatggcttaaaacgattattcgagtggcagagtcaagattggtggactgaatggcggcagacgcttgtgacattaaccgtgccaacgttgtcttgaacgctatcacctttaaggacatgaaaaatgcggtcaaaaatcaggcaaatgctgttgatttttgaatcgcatttttgtatgctatttaagttgattcgcagcaatcacacggaggagtagcgaagaggctaaacgcggcggactgtaaatccgctccttcgggttgaatatcagaacgcaatggatctaaggcaatctttttgaacagccagctgccagcgctcacgcccacccctatgagtgatatgaactccgcccagtcaccaatcgtgtatccaaaaaacgtcactttctcacttccttccataaggatgtaacggctagttatagttgactcaattttccgatgttttgctgctatctgtgccctttttttcagaagtcaaagaatcctctgtgtcataaagcaattgctgaaatttggcaatgtcagctcgaacttctttcttgttcgcgtcatagagtgcctgattctgaattgactgattgaccgtattggctccatttccttcttggtcaatagttgcgttcaaataagcgacctgaacatcaccaatggtggatgtacctgtgagactgatgctcttgttagttttcaatgccatgattacttctctcctttttcgaatgcttcgtacaacgctaaatatgcatcaagatcgggtccgcctatttcgttctcatcaacgtagtcactgataattcgctggacatcgtcaatgtgattcacataagtaccaccttcgatttcggccttctgctcaagccattcaccatgaaccttgttgtactcacgagctaggtcgggattcagctgaatattaccgttcgaatctgtttttgattctccgttctcgtctttaagagcatactgagcgactaaggcttgctcatcctcaccagcagatttcaaagtttgctttaacaatttgatgaacttggcaagcgccagagcatccctgcccttaactttgatttgttcaacaagtctgtatacgttagcaatatttgtattttcaagtgtgattttcatgttttcctcccaaattaaaagcgccagcctatgccgtcgctttgagttcatcgatttcagttttcatttgtgccagcaacggcaagagtgctgccgcgatccggtcgtactggatcccttcaagctcaccatctggcccacggacaaccagatcctcaagaccggcagcttccaaatcctccgcaatcaggccaaagtttttctgtggtaactctttttgctcgccgcttgcatatcgctccatggctgccttgtccagccagtgagcgtttggcacggtcagcacccgctcagccaaatcggtagaccgggttcgctcgatgttgaccttgtacttgctggcagacgtgctgcggacgagagcaccatcagaagcaacaaatgcgtttggagatgatgaggttgtttttgaccacgcagaaggtatctgcacgtagtcagcttcaatattaatgcgtgttcctccagttaatccgtcttggttgtagccaaccataatagatggaacggtagacattcccaaacccgttgaatatgatccgcctccgatgattctcacaccacgattagcgccacctacaacagtgtcatagttttttgaaatcgaaataccactgaaatctttttggaaaagtggtaccccactaagaaaagagttgttttctccagaaacagagacggttaaaacatcacggcctacgatttcagcgccccttccaagagtttgacttgatccgacattatcgatagtcaaataaggtgtctgatccgtgtcaaaagcatagggttgggtaaatgtcattgatccgcccttaagcaaaacactattgttgctgtccgttactgatatatatttttggtcgacgttgatatcaatgttgttgtcagttgagtgtatgcggcctttctggaactcaaccatccctgtattcaaattgatggccaagttagcaccagaaatcgtgccagtcacaatagctgaggcgttcaggttgatcacgttgacgttggccgcattcaacgtcccagtggtgatcttgtcagcagacaaacttgcgatcgctgctgaggggatgaaggcattgcctgtaaaaacaactgttggtgcatctagaacaagcttgccgctttgaatcagagtgcggttggcttccagattaatctggctgagcacatcgcctttggacacgcggagattaatcgcatcttgcagctgggtgatctggctatcggtgcctgattgtacgtcaggtgtagccattgaacctagctctacctttggctcggcaaaacctagcaatgagttttgaccatcattactaccgttgttgtcgatgcggataaacgcctcatcgtacggtcccgcgttgaacaccacagtatacttgtttatctcagcattacttggcttcactccattcaaaagaaaaacagcaccgccgtcagtgtcatatccggcaggattggagctgcctcttttacgtttcaagatccaaacgtccatgctgctcatattcaaacttgcgtatgcccaaatactgaaggtgtaagtgacaccacgagtcaatttaaagcgattggttgccacggtccgttcatcggtcgttgaattgtcaatggcaaagtgtgtttggccgcccttagcatagaaatcgtgagtattgatgtacatgtcagtgacatccagccagcctagcaagttcttatcgaccggatacatgctgttgaggatcagattggggttactcaatccgccaatgacgcttgtccattggtttgacagttgagtctgttgcgattgcaatccactgagttggttggtcgctgttgtttggaaaccctgcaaggtttgcagcgctgcggttgtctgaccttgattgttggcaactgtcgcctgaatcccatcaaccgtaaccttcaagctagccacacgttcatctgcataatccattgagtcttcaggcgccggtgagtaaacaggtacttggtccccttcggccagctctgcttcaacaacatatagatcggcagtttcgtcagcctttttaccaccattcatatcaaatcttaggaatccaaattcttcatccttcagcgtatggaatttggcagtgatttgtctagcttcagaatttgaaatccagattgactctagcaacaagtgaatcttgttgtcgtcataattgtcgccatgtgagccggcgtccgtgtccttgcttcgacctaagaagtaaacagagactgatttgacgttaaaattatggaagccaacgaagtgaacggtataatcagtgtcaggtttgaccgcgacagcgtcagtctgcatatgcgcatcgataccatcacccgagtgcaacacaatcatgttgctagcaccatgtttataaaaatcgtgggttgtcaaacttacggaagttgttggacttccccaaaccgcctgatgccaatggtctaaattggtgatatttgacgtgttccgaatcagatttcgattgccgaatttcaaagcatcaaccttgccagaaatcgagctgaactgggcattaaactgactggcagtcgccgtgatctgtccctgcgtccacgactgtgtggcatatggcgtcaacagcccagtcacatcattcttggtcatcgttaaagacaaccgatcatttgcaaccttgagatcagcactcaattggttgactgacccattgatggtgttaacgacactttgatcggctttaagttgcaatccatcggcagtctgttgagccagcgtttgcgctgcggtgacttcgcccgacaacttgtttatgtccgtcttagtcgccaatgttgccatcgttcctgctaaatcatcagtcttagtgaccaatgtagccactgtcgtcttctggtctgtcgcagtatccaaagcagaatttgcggtcgccaaggcggttttcgcatcagatgctgctgacactgcttgtgttgcaagagcattggccgagtcggctgcacttttagccgcctgtgcagtctgattgctcattgaagccaactgtgcgctactatttgcttttgccacagcatcattggcagcttgtttggcagcagcaacatccgcgattgcggtgtcaaccttcttctgaacctcggtgccaaaagcgtcaccggtttcggcattccattggccatcatgaaagagccacaaaattgtccccttggcagtcgtttgatagtatacgtcaccggttttaccagcaatattcagatcgaccggcgattgatctccccagcctgttgaattcatgccatttgttgccttcgcaatcacgaccttatcaactaactcaatctgtgacttgatctcgttgacacggctactgagattgctatatgcaacatctggccgcgatgtactgtcgtacgtctgtgttagatagctatgatttgacggttgccaggtatatccagtcaaacgcgctctcacatcaatatcatcaagcttgtgcgtgatggtgaccgtatcgcctggcaacacagtggtagtgatgcttaaatccttgtactcttcagtattctcaagcaacgccacattcaacttgtacgtccacttggcctcatcaatatgactttcggagaactctttcgtagcggcagcacgaagtaactcgtacgcttcttgaaccggaacagcacctttttgatcccctgttgcctgtgtttcgtcaatggccttgatgtcctgataggttttggtgccaatcttcggtttgcgataattgcctaacttggggctgtcaacatacaactcaggcagtaaaagaccattgtagccttctggcagcagtcgcgtaatgataccactactgtccttggtcgcttcgtatccggtcaagttgtgcgcatattcaaaatgaacaccacgatcttttcctagacgagggttgacactgaaactaaagtcctgccaatcgaattcaccaccccagcggttaagaaacgagttgtcatccgttcccaaaagtgccttgatgattgacattctaaccagccgggcattggttacatttccgattgttgatagaactttgaagccagttggatagttggcagcgcgcatgatctgatcaagtgcgccctggccatctttgtcaacgatgttggtgtccgcgatgaaatcatcgttaagatcccagaacacgtgataagcagtgatgctaagatgacccatggacttgatcacttgcgcgattcgaaaagcagccttgccccccggaactggcacgcgcacgatattttcagccacgaggtctccagcatgttcgctaaacatcggataatcgaacgtcaaggtgaacttcgcgttgagctgccaagtgacgatatcattgctgatgtcgtccaaagcatagccgtggtgactgaaatcattctggtcacgcggatagagttcaatatcggtactcatacataacaccacctaggttgcactgtgatacttgtgacgccggtcaaaatgacatgattgacacctggcacaaagagcggccaatcacccgctgtcgaggttgtgatatccttgccagccatggtcgccgtgtgtttagcacagtcgagagtgacaggcgctgtcaggctgtcgattgagaactggttcgtgttcacggagatcttgactgttccggacccatacacggtgagcaacggttccgctgccacgttaccggggttcacgatgtcaaagttatccgtgaacgtctttggatcagtcgtctgatactcaagcggatccaaagtgaagctgggcttgtaggagccactgacctccacatcgtctaccgaaaactcgccgattgtgactgacttgatgagccgatagaagtcggggtcatcactcaacactagcttcgacgcggattgcagtaactgccgtgtcttccgccatgactggttgagcgtcttgaagtccacgagttggagttctggtgaccaagtaatatcattccaaccccgtttctcggttaatgaaccactcaaacggccaggcacgtctgtgaactgcacatcgcgcttagctgcgggaatgtttggcttcttggtgaccaacgtccccggcacagactgggccagagattgaccgtccagaattaattcaaccatctgttatcaaagcctccttccatagctaaagttttgagttgcatcctgctgtttcaagtagtccgaggtgtatggaccggtgatagtcgcaaacgtgcggccatccacctgcagcgtaattggtccctgggatggcatatgagccgcaatagctgcacccatcttattccacgtatcatcgttcagtggaataacgccctccggcccagcttcgccaccaacctgtgcccggccattgttattggcaaacatagtcggctgcgtcataatgccaccttgcgcgtaccagtcaatacccaaatgagggatagatccatgcaaaagatcaccaacagaccaaccactgggttggatgctgaaatgtggcattggaatatgaggccaatggatactgaagttgaagaaacctcgaatggcgtcaatcgctcctcggacgatatcctttgcagtattgattggcccagagattgcatttttgatactgttccagacgttagatgtcacagaactaaccgcattccaagcacttgagacggcatttctaatacttcccacaacatttgagatagtcgatttaatgctgttccacacatttgatactgcacttttaacactattgaaaatatttgaagtagtcgaactaactgcgttccatgcattagatacaactgacttaactgcatttacaacatttgaaacgacattcttgatgttgttccaaatgcttgaaacaacacttttaaccttgttgaacacactagaggtaacactactaatcgaattccacgcactccggatcacattacctatgctggctaggattggcccaaagaatgatttaataccattccaaacattggtgataatacccttaatgaagttcattgcggtcgtaataatggtcttccagatattgagatacgtaccaataatgacagcaatagcggtaatcgccaccgtaaagattactttgattccgttccagaaagcagaaaagaaggacttaataccgttccaaattgacttaatgacatttacagcggctgtaaaagctggcttcaaaaaattggtaatggcattaatcgcaatcgtgaagatttgcttaatgcttgtccacattccagagaagaaactggtaacggtactacaacacccttgagccaagtgacaatcgcaccccagttcttgataaccaaaacgactgcggtaatcgcggcaattacagccgcaatcactccgacaatcggcaggagcgtggccataaaagctcccatgcctgcagctcctaggccagcccctgtaccggcagcggtcgcaccaacaccgagcattggcagaactgttgcaactgccgtgatgactggtgccaagacaccaagtgcgacagtgatcgcaccaaacgcaacaaccagcgctttcacgggtgctggtgccttattgaatgcatcactgacacctttaactaccggcagaagccccttgatcacaggcaacagggtctcttgaattgttccaccaatcttccccatagtctgttcgtattctttctgagcttgtttggccttgtcgactggatccaaggtctgctgaaaagatttcgagacggttccaccagtgtcttgggctgatttttttagaccatcaagtgaaaccttgccatcacggatagcctgagccatctgtggacctgatttggcgccaaatgtttgaattgcaatgttaaaagcatcttggtctgtcttggcatctttgattcctttgaaagattgcgtcatgacatcgctgaaagatttgttctcagttttggcggcagagaatgccttctgcatgcccttgagcactgtggaagaatcaatccccgatttgctccaggacgccagtagtggaattccctgctgaagactaatgtgcaattgtttgaaggctgggtaagcctttgatgcatcttcttcaaggtcggcaactggtacacctgtccgctgagacgctgcagcaaaggcatcaagtacgctaggaatatctttagcgctgagattgaatcgtgacatggaatcatgtaatgcgttgaccgcgtcagtcccagactgacctgtgatctggctgaacttggcaacgtcttcggatgtcttttccagctgcggaccactcaaattgaattgactagtaagccctgccatggtattcgacaaatccatcgattccatctgcgcaccagattcggagcgttcaactttctcaaatgactcaccgagcttatttgcaacgtctccaacagcgccagttttgctggtcaggttatcaacagcatcatcagtttgtgtccatgcttcctgcgccttttggttaaaatcttgtaggccttgaccagcagattgaaatccattggcgacagtctgcagccgttcagcagctgtgttcttagcaatctcgtcaagtttggagctagtatcttgtgactccttacccaatttatccatttggttacccaaattggccacagatgtttcggcgtcattcaacttgactttcatctgtgttgcttcagctgagttttctccgtaagcggtgaccgtttccttcaactgttgcttcaagttatcaactttttgccgagacaagtccatttgttccgacaattgccgttgggcggcagctgtcttctgcgactcggaagcattatcacctagttgggcattttccagtttagccgatgaagacgcgagcttaagcttagaatcaagctcgccctcttcctgctgcaggttactgatatgatctttggcatcgttagctttggaaccttgctcactgagttggctgttaacttgatcaagagcacctttcaggttattttcaacccgttgtgcatccgcaaccttgccgacgagccgatcaaatgaagaaccagatgtttcaccacgatcctgcattgtcttcaattgttcagacagaatttgtgttcttttagcagcagcttcggattgaatttgcaatttttgttgttcagcagccagtttctgagtcgaactagcattgtcatccatagacgatatctgggctcgatattcctttgcggccgtgttcatcacggcgttgatgtctttcactgtgttagcaaactgtacttgaccattcatcttgaaatcaagaacaacgttttgagtttcgtcagacatgattttcctcctttcttaattagttaaaaaatggaatatcgtccagtgtgacctgtttccgaatgggattaggtttctctttgtaaataccatcaggattattaatctcgatatagattagatattgtttcagccacagattaggcgttaatttcatgaattcttgaagcgagtatcccatcagcgctttcgccacatacaaataaaaggcccaggggtaatcgttatcctcctgggcctcaccttcctgttgtggcgactttatttttttatgtcacttagttggaagttctgctcatttagaatatccattgcctcttgaataacactaggaatttccgaaaagggaatagcacggttcatctcatcaaaggtagtttccgtacctccaccgacaagtaagccgtaaacaagcgcccaaatgagtttcatggttttctgatcgcgatgaatcactttccgtttgagcataagattcagatccttctcgaatgttttgtagccttgcccatatgcggattcaatagcgtcaattgaggcaaaagtgaacgctgcaggtacctttgcaccttgaatcgtgatgaaatgattgtctcggagcctaactagatcagagagctttgccatattcctttgtcctcctaattagcaataatcgttaattccccgccttgtttggcaatcgtcttaactgcttgcggggttacacttttgggatcgctttttcttttgctatcgtttcaagctgttctggagaaaaaataacctgcttgaaaaagtcgtcaacagtcaggtcagcactgtctcgggctgaattatagcgtgagtagtaaatactcgaattacgcaaaccacctgcgttgtagacgacatcagggttgacttccttgaatgactcttcagaagttgcatgagtttcattaacagcagggttaagtgtacaagacgtcaaccagatgccatcatgctgtccattggccaaccatgtgtcaaaaccaattgcaaactctggcattgattgtgcaagtgtggatccaaactcgaccccatgcttcgctgcgatgcctttcattgcatccagaactgcaattggcatcccgatgtgggtgtgtgtcacttcaatactggtttcttgcgtgattgtcccgaactttttaccgctggcataaatgtcgttcgactttccgttccctttgaaggcaatctttttgatgttcgggatccggataacacttgtatcgaagaccggatcagtagatgccgtctcattttgctttttcatagcgaaaaacatatcgccaatagtgagctctagctcaatatcgtttgctttgcttgatttatcagacatagcaattcctcctattttttcaatgcatccatgaccggtttgaccatagtctgcataattgtatttttgttggcagcaaaggtgttgtgaacataattgcgtgccctgattccttgatggttcttgggacttgtcccatgctccagaaagagccaccaaaatgcatttccaaacgtcacttggatgtgatcgcccttgtcaacaacctgtagcttatctcttaacgtcccataggtttgtgcgagcggagcgttaggttcacttggcaactcgggccggagcttgtcagcaaattgacttgctgcggcaacaagcccttctttcgacactgactcatctactttgataccactgagatacttggccattgtctcaaaaccgttgttattgaccacccgcaatcacctcgatgtacgtgtacaaatccgtgatagtttcatcattttcatcgcccggaatgcctctgaatgattggaacgggacatcatcaaacatcttgatgaacggcagtagctcgtcttcaacgccctttgtgtacaaagacacctgatactcattcacgattaaccgtgtacccgtgctggctactagacgctgagtgtttgtataggtgtatatccagtacggatacttggccgtccgtggtgcaacgtctcgatagaccgcacccagttgcttgagtctggccagaaactcgtcaaatgtgatcaacatagtccagactcaactccattctttgattgtcgggcgtctcgtagattcgtgtgattttgtaatcagttcctcggatccggacacgattcccaccctgagtaatcgacatatcccgacgaatcaaaatgcgcaagacgacatcctgcttgttctgctgcgcgagatatttttcagttgaggtgatcccaatgtcggcgtaatacaagacccgcttgtcttcccacgtttgttttggacggtcgtgtgcgtcaacgccgtccttaagttccaacagtgtggctatccacctgagttggttcgttagattgactgtctgggtcatctgttctcacctccaagtagaagatcggctccaaggcttcaagtgccgccgctagatcgtcaccggcagatcgattgtcattcatcacggtagcaaccataagctgcaagtatttcacgctatggccaactttacgctggacatacttgtcagctgcgtccagatagaattgcaacatggaagggtccatgtcatcttccaatcggatgtgttgttttaagagatctaacaaggttggttcttcttcagatttctcgtcagccatctttgatcaccgcctatcctagactaggtggcgttgttggcacagttacgccaggtgcatcaatcggatcactggccactgaagacagtgtcttggtgttgtctgtatcaaaaacaacctgatagtcaccatctttgacgactgtcccatcggccaggccggtaacgtcaacttcaccagtgcccttattgccgacagcaaccaccttgcctttttggagtgcctttaagaattcggcgctccgatctggtgtatcagccatgttctagctcctttctactttgctgttaacttaaccccgcccttgattccttcagacttaactgattgcggggctacacttttgggcctgctgtgagcaatgctgcccccttggttgttaaaagacctgcgtcagcaattgcataggcaccataatcagtggaacgccccttgacgtggtcttctgttgccactgtaagtgcttggttaatgttaacaacgactgtatctgccacatccgcaatcaggacgtccccatcattgacaccagcatctggtttcacaactaaaccaagaatgctaccaacgcctccattgattgggctagcaataaacaacggacgaccttgaccatcaacgatgtttgccaattgattccaaatggttttgctatttgcataaactgctgccttgccagcaaaactagagtggatcttggccatggtgctagtgatatccttatatgcgatttgatccttataagtggcaacttgtggcgtccctttttcggccttcaatgcagtctcaatgcctagcggtgaatttttaccatcgccttgatgaatcgcaacaccaagcgcaacacccagacgatccccaagctcttgagtcaagaaactgatgaagtcctcttcagacatgctcttcatcttccaggacacggtggcgactttattcagctcgtaacctttaagcaccaattgactgaatttattttgctcatcatcagcctgcgtgttttcgtcaacccactgagcatcaccagaaacaatgccatcgtgcttgttgatggtcagcgtgccagaaacgttgaatttcttggcatcagcgaaggctggatattgttcttctgcgatcttccagatgccagctgccacagtgttaggaatcaaggtcggagtgttccccgtttggtgagaaaatggtgcgccattaaggcgcgcgttttccttatcgaatacagcctgctctgcagtattgagagtgtgacccaaaagcgttttagcccataccttgtcataagtcggctgtgttttggcaacagtgttcaatttggtgttttcaagagactttccaacaccaacaatgtcgttggctggtgctacctgagccaaggtgattggcgcatggtcatccagggctgccaagttggcttggtcttttgtttgctgatcccactttgcgtccaaatccttcacggacttcattgctttgttggcatcctcagacttccccttatcgattgcggtgcgagcatcgttcatcagagcttcgcgttgcttcaagtattcttctttgttcatgaggttattcccctttcaaatttaagagattgtattctgcattcaaaagcgccatctgatcatcatcagacggcgctctttttagtgctgttgtgtttcggaagtgtttcatttggttcagcgtggcaagacttggaatcttattcaggctagcagtcatgatcattttccctggcttctccgcattgtcaaacatcatcttgtcagcaaaccctttttcaatggcagtctgcggatccagccagtaagttgaatccatcaagtcaaggatttctgcttgagatagacccgtcttggccatataggcattagctattgctgtgtttgacttctttaacaaatccgcagcattctccatgtcatgatagtcacccatctgtccaccggagacattgtggatcatcatcatccctgcaggtgacatggctacgacatcacccgccatcgcgatcaaagatgcagcggaatatgccacacccacaacgttcacattgaccggccctttataagcacgaagcatggtgtaaatttcagagccggcatcgacaattcctccacctgaattgatctcaacggataagtcgtcaccattagccttgttaattagattagagacgcttttaggtgaagcatagtcatcgccaaatagatcgtaaagccatccgtaatcattagtaacgatgtcacctttaatcggtaccactgtcgtcattatcatcacctccttccgttggatcaggggcaccgtcgctaccagttgctgaaggcactgtccctgtatcctttcggagtaacatcttgtcgccatccggaactggtgacagattaaagaatccacgcaattcattcggagtcatcacagcacggtcaactagttggacgagtgacagtttggtttgcatgcttgcatagctcaaatcgcttgattcaaacacaattgaattaccaaacgaacgttgccgtcggttgaacaagcggctcgtccattgctcagacatctgcctaatcactggttcaatctgactttcgtagtaactaatccactggttttcagtgtagctactttggacaatggccttgttggtatggaaaattgagtagattcgatccacagtcgcatccatttgcttagcatttggcacaaaatcagtgggctgtaactgggttgcatcggtcttagcatcaacaccagctgcaccgattgaatcctgatctttttgtgtctgcagatacgatgcaacaaaagctttcgtattcttctcgatatcctccgggcgcatagcagtattgaatttcaacagccagcgaacagcggctgaattcttaatggcagatacaataccttggtcagtggtcgtaacaatctccatgagtggtgccaaagtcgggccattggattcgccaaagatttcgtccttgttgaaatctttgcgcaggtgaatcacctgcgaatatggaaagatgtaggtctgtgcattcggcatgtagaacttgagatagaggttgccttgattgtcttgaatggcttcgacactgttagccacgattggccagattgctgttggcattccattggcatcattctggacaaaggcaaaagcgttgttattcagttcaagctgcgtgatcatcttttcttgcagcatctggccgctcattaacgggttcgggtctgataacaagaactggatataaacgtctggattgactgcgatgctgtcaccggcaccggaccgaatgtgcttggccactgctttgccgatcgtggttgctttgacctcaatggctgacctaatgatgtcagattcatagaccttgccattccaaccaaaaaagccgttaccgtagttggtaacaagcttgtattccggtgtgactgtgacgccgctattttttctatgaaaaagattgttccaaaatgccaaataatcacctccttacggttaaatcagcgtctgatattcttcttgattattctcaaaaacaacataagcatcgagtaaagaagccatcccatcaattcgcttgcgcttgttttttcccttgtcaggttggatatttccatttctgtcagtcacaatcgtcgtgttagacagacaccatttcaagattggattgttgttatagacaattcgctttgaacaaagatctgcaccaagtgaatgcatgggacttgataacgtcttcaccccttgcggaattgcatcaaaggtcttttcgccatatcgggattcaagatctttgacgaagtatgtggctgaccatgcgtcataaccgcctttgaacaggtaaatgtcatattcttgttcaagctcctcaaaccagtccatgatgtcacgataatagactttattaccttggctcgtcctcaacaatccttgatcgcgccacgtggcataaggaatgttgtcctcctgtgcgcgctgctcaagagtgtcttccggcagccagtacatttgcttaacgtagatgtgatcatcattaggtatctggaagatgacagttgcacaagtcaagtcagtcgtctgcgataagtcagcgccagcaatgccatatcgcggcttgagtttgagcgtgtcaaacgtggcctcgttattcagttcatcaaaggttagccacgactcagttgctgtctcacggatattaaaatccttgcagactaggtttttaaccagtcgatgatttgccttggctttttcgacacgttcagccaatgtggtcttgtttttgatcgtgccaagtccagggtttgccttgacccagcatttctcatcacgccattccgcacgtttgtcgagttcgtagatgaagaacaatgaacgttcatccctgtaaccttcgggttgatcatatcctgcaatcgtcatctcagcgtcgtcgtagatctgatcataaatatcttcgcggatcgtgccagcggtggatgtgatgaaaatcagtggttgatcccgtgcagtgatcccatcggccatgatgttgtaaagtggctcaccgttcttccactggtgaatttcgtccatcaggatgcaagaagaattgaggccgtcaagcgtatcgctgtcagatgacagaggcttgaagacgccgtcgttgtactcttctgaagacagatcagccacatgcgttttgattcgcttagccaaagtcggagattttctgaccatgcgcttggcttcattccaaatgatcttcgcctgatccttcttcgtagccaccgcgtacacttcaggcccagcctcaccatcggcaatctgcatgtacaacccaacagcggaaccgagcagcgacttcccgttcttcttaccaacaatcaggacaacccgctgatactttcggaaacccgcaccatcaacgaatccaaaagacgctgccaacagtgctttctcccatagttctaggacaatgtgcttcccgcctgctggtcccttgctgtgacggcaatagttctcgataaattcaagcacgtgattaccacgacgatttgagtagtaccattcactattgtcattgtgcatgtctgcgatgagcttcttgtacgtgcggtagattttcttgccgacaacttgatcaccaccattctgcacaaacgattgccagtattgagtaattggatcgtaatcaggtggataactgacatgtcgatcgacacgaatcttgatctgaatgtcagccattgctattcgcctcgctcatcaacaaagtcgtcaaaatcgtcgctctctttgttgggatcggcaggcatgattgcggattctctcggtagcaaactgattaacttatccatcgcggcagtgtatcgattgatcattgtgttgtatgatttctgggcgggattctcaacacgcatcgtttgcttcccattgtgcatgagaatcgtcggccctttagatttgacttcatcttccaagatttgcagcgtgatggtcataaatgcacatctttggatcaagttatcggccgctgccaacttctccgctgagataccggataacgtttgacgcaaccgctcatattcgagctgaatggccacatcctgcttttcaatcgacattttcaggctcaatttcgtcatccccttaaatttgttaccccccctcatacgaaaaaacaacctgtgtattattcgtgtgttgcatgccgttcctttttaaacagcttcttatggcttcgcaggggggcccgactaactggtactaactgaccatgagcatcaaacataacgtcagaacgaactgcagccgtcttctcaaagtgttcctcttggtgacaatcaaagcaaagatactctaggttgtcccagttaagcgtgatgcttgggtcattgatgttgtctgctgtgatgtagcgcttgtgatggacgatgtagccgggcttgatgatacctcgcttcaagcagcgctcacacaatccaccgacactggcaatgtaggcagcacgcgtcttcttccactctttgctatgatagaacggctcgctgatctctcgtggtaccatggccatcgttatccacctcccaatgacatagtaaaaggacaaccgtttggctgtccttccatcaatcatattgttaatataactagcttgtcggccgtctctcgtctggtaaagccttcagaggcgagcttcctaatgccactgatttgttcatctgtccattagcgccgtcacagcgttccagccccatctggccggagattgcggagtttggcacgacatagaactttttgcctagagattttcctcagataattcagaatcgtggagcaatctgagatgttttaaatcaaaaacgtacctaactcggctctttattaacatcaagccggttcaaccgattcaaccttcacatcttcacgctgcaccgcaagcaaatccgcccctgcctgaaccgtggtatcagccgccactggctcgatccgtgcataagacttgctgttggtaatcagcacgatagtagtcgcgtctagcccagcttttttaatagctgcttgatcaaaggttccaagcaagtcgcctttgttgacgtgctggtcggctttaacggcgactgtgaatggtgcacctttgagattgacggtatcgatgcctaggtgaacgaggatttccatgccatcatctgtcgttaggccgtatgcgtggccggtgtcggcgacgacggataaggtgccggcttgtggtgcgtaaactttgttgatgccgggttcggcaggcttgatggccatgccttcacccatcatccctgaagcgaaaacaggatcgctgacttgatccagtgcaacggtttcgccgccaaccggtgcatagactttgttgtcactgacggttgaggagatcacagcattggcggtttcgacatccccgtctggcgttagcacttccttcgggatcgcaaacgcgctggtcgcaacaaaggccgcgacaacggtcccaagtgacacgatggtataccacaacaacgcatggccgttatagatgtacatcagataagatggcaccactgcaaggccatacgagttagcagcgacgttgagcatgcttaaaatcgcagcaccaattccggatgtcaaaacggtgacgatcaatggccgaaagttgtagcggattaagaccccaaacaacgttggttcagaaaccccgaatagttgtgaggtaaaggcacccattgaagttgctttatccttgttggaacgagcccgtaagaaaatggcaagggcaacgccgaggttggcaaagccatacatcgcttcaagtgtgatcaacggattcaaaccggttgaagcgagcagcgaagtttcgatggcaatcatggtctgatgaatcccgatgagaaccatcagtggataagcagccccgatcaggaacccaccgattccaaatggcagatggatcacggcttcaacaccgacaagcatgccactttcaatggcatggacaattggaccgacgcccatgatcatgatggcgaacgtgacgagcatcgtcaagaatggcgtgagaatctgttccaaaacgttgggcatgtgacgccggaagaatagttcaagtttggccccaataaacccagcgaccaaggcggttaacacggagccttgactaccaacaactggcaaccagccaaacagcataatggccttggcactgccatcagcaaccgaatacgcatttggcaaaattggcgaaaccagcattaaaccaatgacgatcccaatgatcggtgtgcctttgaagtagcggaaggtcgaccagacgatcaaggcgggcaagaaagcaaaaacggtatcggtgagcaccgagattaccgatgtcaggctagccggtatatcgcttgggaccgctccgaaaagttttaatacttgcgcattggttgctgcacttttcagccctaagaacagaccggtggcagcaatcacaggaataattggaatgaaaatgcctgatagcatcgccattaatcgttgtacgactgtcttgtgctcgttgctggttttaccggcagtgtcggcgtcgtctttaccataaatcgcattcacggtgccaagcttagcaatggccgcgtagacatcgttgacaacgccggtgccgataatgacctgatattggccagagccatagaaaacacctttgacttccggcaacttctcaagggctttgtcatcaattgccttccgatctttcaccacaaaacgcagtcgcgtctggcaatgggtcacggaatcgacgttattttcaccaaccagctttaaaattgcttttgcttcttcttcatagtttttagccatgatcatttcacctcaataagaatcgcttgatagggttgtaagctcgttccaacgtccgagtaattgttcagccaaacgtgaccggctggtaagtcaactgcggctggcttcgagctaagattcacaaaaatttggacatgttgcccgcgggcataggcaatcacgttgtcgttgtgcgcattcagcggggcaaagtcgccttcgatcaaatcggcgcgcaatggcgaggcattccgcaggcgacagagcgtttgataaaacgtccagaccgaattgggatcatcgtgttccgcctgccagttcacgccagcaacttgcttggccagcggcaaccaaggttcatgaccagcgttgaagccgccattttggctgtcgtcccatggatacggcgtacgagcattgtcacgtgagcgtcggttgacacaggtaagcgcaacgtcttcggagtaaccttctgccagtgcacggcgatagttgtcgtgcgcggaaaggtcgttgaattgatcaatgttggttcgcaccgcattgaccatgccgagttcttggccttgatagataaacgggcagccacgcaagccgaagtataacagtgctaaggcttttgccccgatcgcattgcgatattgcggctcacggatatacttgcttaggcttcgcggttgatcatgattttcaagaaaattagcccccaagccaactttttgaatcgccagctggcttttggcaatcgcctcgccaagcattttcggcgtccagttggtttgcttgaaccactcagacccggaagcgacgtcaatgtcggcataatgaaaatcaaaaatcattgagaagtagccgttttcgccaatgaagtcaccgagttgattgtatgcaacgccggacgcttcgccgatcgtgacggcattggccggcttaaaggtggcagcgttcaactctttgagaaattgatccagacccggtcgattttccgttttgagcttaactttgcctaacccatcgctgccatctggcgtgatagaagcaaaatcctgatcctttttgataaacgtaatggcgtcgacccggaatccggcgaggcctttggctagccaccagttgatcatgctataaatggcatgccgcaacttcggattttcccaattgaggtccggttgttgtggggaaaagacgtggtgataataggtgttgggctcaccgggaaccgctgtccatgacgagccagcgccgaagtttgagcgccagttgttcggcggccgaccatcatgaccttggcggaaaatatagaagtctcgatatggtgaggccggatccttgagcgccgcttgaaaccaccggtgctgatcggacgtatggttgaccaccaaatccatcactactttgataccgagatctttggcagttgccatgagctgatcgaagtctgtcatggtcccaaagcgcggatcaatcgcctgatagtcggcaatgtcataaccattgtcaaccatggggctcttgtaaaccggcgacaaccaaatcgtggtaatgcctaattcttttaacttcggtaattcggcagtgatgccaggcagatcgcctatgccgtcattattgctatctttgaatgaggccggatagatttggtagaaaatttcttgctgccaccaagtacggctagtttcgttcgtcatgactatatcctccagttagctgatgctgtcgtatgaaaatgtggtatcgattccatatgaggtaaaaataaaactcaggcgctttgcctgattttcaacgataagtgcaaggttggttgcgtgtcttgggcgacttgtcggcccaacccttttaacaactcgtgcgtcgctgccgctgccatcgaagcaacaggctgatgcaccgtcgtcagcgggattttagcaaaaggcgcaaacggctgatcgtcatatcccataactgcgatgtcatcaggcaccttcacatcggcagccaacagactgtcaatcacgccgactgcgacctcgtccgagttggtaaacacggcatccggccgcacattcgaccccagactcgcgagctgcttgccaattgcctgcccttctttggctgtgtgaatttgaccaaacagtaaatcttgcgccattaaaagctgatgtgcctgcataaagtctaaaaacgcttgcgtacggctctgtccatggtgggcgccgctgatggtgccaccgctgacatacgcaaaccggcgatggccttgattgaataaatagtcgagtgcatcacgggtcgcctgataatgtggcaataccagcgaagtagccccggggatctggacatcggcattcacaaccacaacccgccccggaaaggccttcgcaactgccataactcgatcaggggcttcaactgaagctaaaatgacaccgtccaattcgcgacttttcagttgcttgagaaaacgttcttcagcctcgggatcatcatatgtctgggtaatcatcacttggtaaccgtgggcatgtagttcccgttcaatcgcatcgaacaagccagcaaaaaacggattggtcacgcgggataccaaaaccccgatgttgccagtggcttgggcgcgcaatgacgtggcggccgcactcggcgtatagcccaactgatgaattgctttttcgatccgcgtacgcttttcagcggagatgtagggatgatgattcagatagcgcgaaaccgtggtcacgccaacccctgctgctttagcaatttcactaatcgtcgccattccttgcatctccttttatatggaatcgatttcatagacgagtatacagcgctttcagaaattgtcaagcattgactaaaaagattttttgcgtcccagtctaaaaaagccttacgccgtgtcgccacaacgtaaggcttgcgatcaaagaccgccattatcctttttaagattccatgacacaacatcactggccgctgacggtggggtgatacgtgccgcagtgggtgcttcattgccaaagaagcgaccggagacaacgcggtagccttggtcaatgaataattcgaacacggatacatcaatgaacaagcggatttcaactgttttcccagctggaaagccgaactggcgcaaactgccgccattattgcgattctcgcgctgaatcatcccctgcccgctatcagagtcgagatgaatcagcaactgatcatggtccccatcaggcagatgaatcgttgtcttttgacctgccgcaagcgtgaaggctagttcaaaggcgccttccaagttggtaacggtccactcatcatcatgctgctgaatgaccggtagatcttccaccgccgtctcccgcagacttttgatagccgggtgcggatagaggcaaacgtgatcatcacgcagcgtcaattggcgcacataactcaagaccccggcccaaccatcatcatctgttgggtaggtggtatctggcaagccgagccatgaaatcgccaaggtgccatcatcatttgtattcgccagacgagtcgcataaaagtcaaaacccttgtcaatgttttgcagccgctggtgggttaagttaccagttgccggatcaaagttatcggccacaagggcaatgttaggatagacattttcatattcgaaaaagtcctgatcgaggccttgtgggcagtatactaggaccactttgccattgatgaacgtgatgttcgggcactcaaccatgtaaccgcaaaattcatcaggaatacttagcggtgccacaaaccgccagctcttgtcggtctgcttggcataaagcagaatggcgccggtgtgatctggacgctggccgccaatcaggacataggtctggccttcatagttaaacaagaatgggtcgcggaactcctgggtgtagccagtaggcggtgttaggattaatggcttcggatccttaaacaaccggccatcagcgccgagaacggcccctagctgggtgctatgccgatgccactgatcatcccgcgcattgccggtatacatcaagcgcaacgtgccgtgtgtcaccaacgctgatcctgtgtaagccccatgcgagtcatactcgttatctggcaatagatcgcctggcacccggcgccagttaaacaaatccttcgacaccgcatgcgcccacgacttcaggccatggaccgggccaaacggaaattgttgataataaaggtgccatttgttgttgaaaaagttcaagctgcacgggtcattgattaaaccagtatctggttgaacatgcgtctttgtccgccatttactcgcagcaacctgagccttcaacttcataatataatcaggcgcccaggacgaatacggctgataccgcgccgccgtactccaagttgcttctttcatgaacttaccaccttgtttgaaatgttacccccatcatatatgagttaggggcaatgtcaatgaagacagataaacaggtttctgaaatcttgatgcaatcatttttgggagggctggttgaccaccgaaaagacgaggtggcgccgcggtgatccgcgaagctagcgtggtgggcacggactttgagccaacgggcaaatccggcacgctggctcaaaactcggccttctcctaaagcaggcagcccatctgctttaggaaaacctcaccactgagcccatcgccgcggaatcagctcaggctagcggataaatcgctgcccaagatagatcctgaaaagcgatccgcaacaaacaaacttgatgcaaaaaatccgcagcttaggccgcggatttttgattggccgatcggagggtggccgatcagcgattttttactttggaggagtaaaaatgaaaaagttgggttggggaaggaatgagtgggtggctcatttctatgttgttaatactacaagcgatgtgtgaaatttttgtgatggtaaatgggtctttatgttaagtctgttgattaaaatcatctgctcacgacagcggtttaggcagaaattctgcccgataatcatgaacgtattgctcaaagctgattgctgggcgcccgagaacatttggcaatgttgtcgtaaccgttttggcgttacctaactgggtgatcaagtaaagcatcaccatgacattgacatagttcttcggtagcccgcgttgcagcatgaccttgcgaaaacgccacaaactcggcttgctataggtgatcggcacaccgagttccatcgtcatgatctgagcagcatcggcgtaggtgagcgcttgggcgccggtaatgtcgagcttttggccaatatatgccggatcgcgcaggacaaccgcagcagtcgcgccgatatcacgggtatcaatgaaactagtgcgagcatgcccagcaggcacaaacagatcgcgatggccgacgatatcagcttggtgggtggtattcaaattttgcataaagaaacttgggcgaatgaaagtataaggcaaaccgagttcaacaatccgtttttcgatttgatgatgcggcgtcattggattatgcgccaccccaagtagtgacacaaaaacaacttgcttcacatgtcgagccaccaaggcatcgagaaaaggatacatatcctctttgggcttagccaattgtggcggccgaacgaagaagaccttgtcgatgtcagctaaggcttgctcgaaagtggcaggatcgagaaagtcaaaccggcgtacttgaaccttcagcccgcttaacgcctgtttggcatgttccgaattgtgcacaccagcaaataggtgaacatctggatcatcttgcaagtcgcggatcagcggttgaccgatattgccagtagcaccaatcactaatagatttgtcaataactttctccttataaagaaaaagtgcctgaacaggcacttttttaatctcgatcaccgcttaattatcgcggttgaccctattcatacatataagcacgggttgccggcagatcttttccagacggccccttgctgatcaaatactgcatcacgtcaatgttgccagattcaaagctggcagcggccgcctgcagataaacatcccacatccgcgtaaattcgtaaccgaatttttgctgaatcggattgcgatgattattgaaattggtatcccaaatctcaagtgtgtgttgataatgacgccgcagtggttcaagatctgcaacttgcatgccagcatcgacaatgtgattaaggttttccgccatcccgggcacataaccatccgggaaaatgtatttgttgatccatgcgtttaccgcgccgccttgttgtcgcgtgatgccgtgaatcagtgccacaccgtcatcttttagcaacttagcgacatctttaaagtagccttctagattttccttgccgacatgttcaaacatgccaactgatgtgatgtaatcaaatggctcgcgattcagttcgcgataatccatatacagcacctcagcaacatcggatagatgttctgattcaatccgatccgaaaccagtttaaactgttccttgctcaaggtgatgccgacgaccttcaagtgataggtcttagctgcgcgtaacatcaacgtaccccagccgcagccaatatctagcaatgtccgccccggctgtggattaagtttccgcaaaatatgatcaattttatttaattgggcggtttctagatcgtcactccagtcctcaaagtaggcacaggaataagttaaagtcggatccaaccacagtttataaaaatcattgccaagatcgtagtgagaatgaatgtcttcttttgacttatgttcggtatgactttgcttcgggagaaagcgcatgagtttcttgttgcgcataaaactgcccgcattcgcataagccgccgcgattaattgttgcaatggccgtgtgccgccaagcacttcaatgtcgccacgcatataagcctcacccagtgccaacgatgcatttttcagcaaatcacggaccggaatggcctttttcattttaatcgtgatcgttggctcacctgtaccatacgtttcttccgtatgatcccagtagtccacgcgaaccggaatattgaaagagtgactgaacatggtatgataaaactttttttcaagcatgatggcctccgttttgagaagttacaagaagaattatacggctttttaaccaaagaaaaaacaccgccgtgaaaatggacggtgtgtagccgttttcatttaaaattttcgaaaacgctgctgtcgcttggcaatcagtgcctgcggatcagtagcaactaattctgcgagcttgggcttgatcgctgccttcaacgtcgtcgcgaaagtcgtaccggtatccggaataatgcgatcacagaccgctttagccaataaatcttgcggggtcagttgcatgaccgcggccgcctctttagcacggctggcatccttccacaaaatagccgcaaaaccttctggggatagaatgctatacatgctcttgtccgtcatccagacctcatccccaaacgccaaagccaaggcaccgcctgacccgccttcaccgatcaaaatcgcaagaatcggcgttgggagatcagcacaggtggataacaaatcagcaatagcggcgccttggccattggcctccgcctctttgccgggatatgcgccgggggtgttaatgagcgtgacaatcggtcgatgaaacttggctgcctgcttcattaaccgtagcgccttacgataaccccaaggctcaggactgccaaaatgcgtctgcaatcgctccgttaagtcttgccctttatccgttgcaatcacggtcacggcttgctgatcaagccagccaatgccgccaatgacagccggatcatcatgacttgagcgatcaccgtgaaattcatggaagtttgtcaccaacccgttaatcagttcccgcgtgcgatatggtcgtggtgctctggctgcttgaactgtctcatacgctagcgtttctttatccgtcatgcttgaaagcctcccttattgctgcaactgtatgcctgtcaatgtgtttgtcagacggctacgcgtgatatgaagaacgctaggcaaattgatccaagatggcaatcaatccgtctagcgtcgcgtcaccatgcctcatcaaatgtcactgctcaggctgtgtgcaacgccaacaaatcccctaaataactaggctgatcctgccgctgtaccactgcatcaataaaaccgctttgcaaaagggtttctgctcgctgaaagttttgcggcagcttttggttaatcgtttgttcaatcacccgccgacctgcaaaaccaatcaaactgtgcggttctgccaacgtgatatcaccttgcatcgcaaaactcgcggttacgccgcccattgttggatcggtcaagacactgatgaataacaagcctgcattgctgtgcgctttaactgcggcacttactttggccatttgcatcagcgaatgaataccttcctgcatccgcgcaccaccgctagcgcagaaaagaacaactgctaaattagcgctggttgctttttcaaataaccgagtcaaccgttcgccagtcacagttccaagtgaacccatcatgaactttggatccatgataccaagcgcacagctttgaccaccaatcgtcgcctgacctgtccacacactgtccttcaaaccagtagcagcctggcctgctgccaatttctcggtatatcccgggaaatccagcgggtccgacgtcaccagatcggcatcccattcttctgttgctgtcgcgataagtgacagtcgttttttagcagtgattcgaaagccgtagtggcagtgcgggcaaacttgagcattgcccaaactctcacgatagctgccttgcttacaatacggacattgaatccacaagttttcgggtaaggctgcctcacgagcaagtgcttcttgggtcagttgtggttgtgacatgcagtatccttcctttcaaaacgcgtttgccaccccagaaacctgcatgtagggaccttggtcgcaatggcccaaaaccggccatcacgcccaaggccgcttacactccggtttctaaacgggctggttcgcgctctgccattttggtaaaaagtcgcgattgagataggccgtatcggctttgccggccagaacagtcggtgcttggaataacgccagcgcaaaatcccggttggttttgacaccttccacatgcaattcaatcagtgcacgatgcattttcgctaaggcctcgtcacgggttcgcccatggacaatgagtttagcaatcatggcatcataataggggctgatcttatcgccaggcgcaacgccggtgtcaacccgcaaccccatgccgcccgttggaaagcgcagttgttcaagggtgccaacgtctggtcgaaaatcatgataaggatcttccgcgtttaaccggcattcaatcgcaactcctgatggttcaggtgtcgttaatgccacttcatcgccagctgcaactcgtagttgagcttggaccaaatcaacaccggtcaccatttctgtaattggatgctcgacctgaatacgcgtattcatttccatgaaataaaaatgatgctgctgatccatcaagaactcaatggtaccagcattgagataatcgactccttcagcaatggtcgcagcgaggtgaagtaactttctgcgttcaggtgacgtcaagactggacatggactttcttcgaccatcttttgactgtgacgttgcaagctgcaatctcgttctgggaaaacactggtatgcccgtgcatgtcgcgtaaaacctgaacttcgacgtgtttggcagggacaatgactttttcaagatacatcgtcggatcgccaaacgccgcttgagcctccgcttgggcccccgcgaattcagccttcaatgcagcagcatccgttaatttgcgaatacctttgccgcctccgcctgcgctggctttgagcatcaatggataaccaatggcctcccctgctgccagcgcggtttcaacgtcctgtaaaggatgactgcctggaatcacgggtacgcctaagtcaatcatcgtttgtcgagcaacggctttgtcgcccatttgatcaatggcagtcggttttggaccgataaaggccaatccggcatcggttacgagtttcgcaaactcggcattttccgataagaagccgaacccggggtgcactgcctcggcaccgctcaaaatagcggcactgacaacattgcgcatattcagataagagtcggccgcccgcggtccgccaatacagatggcttcatctgcaagggtgacatgcaggctgtgacgatcagcgtttgagaacaccgccacagaggtgatgcccatttcgcgcaaggtctggataatccggaccgcaatttcgccacggttggcaacgagtacttttttgaacaaagttccacttcctcacacaaatctggtttcaatggcagtttcagccaatagcaaaaactaaatccgcactgctggccatgttttcgccaacataaattttgcctttgcccaaacctgcattgtcaatcagtttctccaaggtcacttcaatccgcagcacgtcgcctggacgcaccatgtggcggaacttggccttcttaatgccgccaaggtaggctgtctttcctttgaagtccggcatcgaaagcaatgcaatcgcgccagcctgcgccatggcttcaatctgcaacacaccagggaaaattggattaccaggaaagtgtccctgaaaaatctgttcgttaattgaaacattcttttgtgccactacggattcaccgggcttaagatccaagacccggtcgaccattaacatcggatagcgatgcggcaaaatggcctgaatttcttgtgcttcaagtgttttcttggtttcgagcataataccctccttttaaacgcgttctccagcctagaaacctacgtataagagccctgaacgcaatgccatcaggttcagacccgcgtacacaccgatttctaagcgctcctactcacgctctgtcttcttcaattgtgactaatgcctgatcatattcaacgaggctttcattgtcgacgttaatcgccttgagtgtgccgctgacggtgcttttgatttcgttcatcattttcatcgattcaatgatacagaccacatcgcctttgttaacgtgcgcgccgacttcaaagtacggatcagcgtcaggtttaggggaaagatagacaataccgaccaatggcgccttaatcgcggtgcctgtcggagcttctggttcagctggcaccgccgtttccggggttaccggttgactaggcactgttgcctgagtattaacaattggcgccggagccgcacttgctttgaccagatgcaaagaatcgttgccaagcgtcagctctaattcatgcaaagaactttgctccaactgtttgatcaggacttcaatcatttcggtgtccatgatgctcaccaccttttgaaggccaagaccgcattatgcccgccgaaaccaaaggaattgctaagtgcatagtcaacttcgacatcgcgattagcggcatccaccaaggtgactgggcattcaggatcttgctcagcatcaccgacattgatcggcaatttaccttcgtgcaacgcactaatcgtcatgatcgcttcaatcgcaccagccgcacccagtaaatgaccagtcaaagccttggtggaactcaccaaaacatcgtcgccgaaaagatcgtggatcgccttgctttccatggcatcattagccttggtcgccgtgccatgtgcattgatatagccgacatcacttggcgcaatcccagcttcttcaatcgccagttccattgcccgtgccgcttgatggccgcttggatcaggcgccgtcatatgataagcgtcgctcgtagcaccataaccaacaacttcgcctaaaatgttggcaccccgttgctgcgcatgttcgaggctttccaagataatcgcaccgccaccttcgccgaggacaaaaccgctgcgatcagccgcaaatggcaaacttgctttggccggatcggcagccttggataaggcagacagggctgcaaaaccagcaataccgatttcgttaacagaagcctcggcaccacctgtaatcacaacatcggctttaccactttgaatccgcatggctgcttcgccaatggcattcgtggctgaagcacacgcagtcacaacaacatagctcggtccgtgcgcgccaaagtactgagaaattgtcccggcgaccatgttgctaatcgcttcaggcacaaacagtggacttacccgatcaggacctttggcattcatttttgtgacttgttcctgaatggttgtcaagccaccaatacctgagccaaaaatgacagccattcgttcagaatcaacatcatctttagttaaacctgactgttcatatgcctcgattgcactgtaaaggccatattgcgtgaaaagatccagccgtttgctcagccgtttttccattcgcacttcaggtttaaaaccttcgacctcaccagcgactgtgatcccggtcttctcggcatcaaacttagtgattggccgaataccaatcttgccagcatccatcgttgccactgtttcggcaactgaatgacccagcggattcacagtacccattccggttacgactactcgttgcaatgtcattcctccgttcatgtacttagcctaatccaccagcaacagttaatgtttgcccggttatgtaggcattttcgaccagaaaacgggccgcatgcgcaatttcctcaggttgaccgaatcgctttaacggaatctccgccaaaatctgatcctgactagcctgactcagcgctgcggtcatatcggtagcaatcatgccaggtgcgatcgcattgactcgcacgccacgcatggcaccttctcgtgctaatgttttggtcagaccaatgatgcccgctttactagctgcataattggcttgaccgatgttcccggtcaaccccactacactggcaagattgataatgacaccagtgcgtgccttcagcatttttttgaatactggctgactcacatagaaagtcccatctaagttgacgctgacaacccgggcaaaatcttccggtttcatccgcatggccaacatgtcactggtgatcccagcattgttgactaaaatatcggcactgccaaacttgtccagagcggttgccaccagctgctgaccggttgctggatcgtcaacattgccaaggacagtgacgacgccatgaccaaaggcttcaagctctttgatcaactcagtgggaaattcgtggcgagcgtttaaaacaagatttgcgcccgcttcagcaaagtttcgggcgatcgcttcgccgatgcctcgtgaagcaccagtgatgatcgcggttttatcagttaatttcaatctgccttcactccgttattcaagtcaatgactgcattgaggctcgctgcgttactgatcaagtgtgtggtcatactgcgatcaatgcgcttaatcattttgctaagcactagttttggtcccagttcaatgaccgtgtcaataccagttgccttcagttgccgcaccacatcagcaaacttagtcggttcagccacctgagccgccaaaattgaccgcatgttttcagccgagaagggctcaagggtcgtggtactgatgaccggtgtagctggatcaaagacatgtacttggtcaagggcagcacgcaatggtggctgcgcatcagccattaacggactatgaaatccgccagcaactttcagtggcacagtgcgaacgccttgatctgacaaccacgcttcaacctgcgccaagccagccttgctgccagccagtacggtctgtttagggccattgtaattgactggccaaacatcaggcacttgttgacaggcagccgcaatcacagcagtatcgccagtcatgacggctaacatgctgcctggatgggcctgacaagcagcggccatcgccttgccgcgggcagcaaccagcttcaacccatcttccaaactgatcccgccgccagcaatcaaggcactgtattcccctagacttaagccagcaagtgcggtttcatcgggcaatgccgcggctgctacttcatgcatggccacgctgtacgcaactaaagccggttgcaaagcatccggatgagcagcaaaatccccagtcgccaaaaactgcggcagatcgaagtccaaaactgcatcagcgcggtcaataatctctttgaatatcaaagtattctggtaaaaatcaatccccattccggggacctcggcaccttggccattaaacacatatgcaaaacgcaagcaagtacctcctcgtttcaatgcggacgtttgccgttaagcctgtgcctgcacatcgacttgacctgtcaataaggccgccatttttgagccagccaaaatttctttggcctgacgcatcacgtcctcaacaatgtcttcgctgctttcttcacgcttaactaagccagcaatctcaccagccatgaaggaaccgtgttcacgatcgccttcaaggacggctttacgcaaactaccattaccaagttcttcaactgccgaaaaatcggtcgtgtcagaaagggcaattttcttttcaagtttcaggaaattccggctcattgggttcttcaaaacgcgggcagcatgaccgacatacaggccggttaccagtgtatcaacgtccttggctttaatgacggcgtccttgtagttctggtggattcggctagacgttgacgtcagaaaacgcgtccccatctgaacaccgatggctcctaaactcaaggcagccgccacaccacgaccgtcagcaataccgccagctgcaacgacgggaatatcaaccgcatcgacaacttgtggcactaaggccatcgtggtaatgctaccaatatgaccgccagattccatgccttcagcgataacgccgtcgacaccgtcttttgccatccgttttgccatggcgacagacggtacaaccggcatcacaatcgtgccattttgctgcaaccgttctaagtagcggcttggatcaccggcaccagtcgtcacaagcgcaaccttagcgtcaacgatcacgtcaatgacttgttcgacaaatggtgaaagtagcatgacattcacaccaaatgccttgtcagtcagtgacttggcaatatcaatttgctctttgacccaagaagctggggcatgaccagaaccaatgatgcccaagccgccagcttcagaaactgatgcggcgagcttgccgtcagcgacccacgccatgccgccttgaaaaagcggatatttaacgcccaggcgttccattaatggactcattggcccactcccttcaagttgtcttaagcttcagccttttcggtgatgaagttaacaagatcagccaccgtttcaatgctttcatcggtatcaatcttaacgtcgaattcgtcttcgatttcgttgatgatttcgaaaatatccaaactgtcagcatccaaatcattcttgaagttggttgtcagttgaacttcttccggcttcttatccaattggtcagcgataatgttttgtaccttaggcaatacttcttcgtttgtcatgtttaatgttctcctttaaagttaactattttgtaagcgccagcagaagcggacccataagcgggcttctgcgactgcgagcgcatcagactcaaacatactgttaataagtgacgatcaacgagccaacggataaaccgccgccaaaaccgctgagtaccagccgctgaccgcgttgtaagcgaccgtcttcagctaattgtgccaacaagatcggcacactggctgcactggtgttgccatgctcatcaatattgattgggaacttggcaggatttgctttcagctttttggtgactgattgcacaattctggcattggcttggtgtaagagataccaatcaacgtcatcaaccgcaacggctgcctgtgtcagtgcccgattgattgagcgtggcacttcggaaatggcgaattgataaatcgctcgcccattcattttgaaaaatggggacggcttagctgaaggtgcttcggcaaacggactgtgattcgtctgttcaccagcaaccaaagccatctcagtatcgccgaaacttttaagatccacggcctgaaccgggaaaccttgatcattgatcaaaaccccgccagcaccatcagcaaacaatacggccgttcgccgatcatgccaatcgacaagccgagaaagtacctcgctgccgatcacaattccttgatgaaccgttggactcgtcatcaggcgatccgcaacatgtaatgcatattcaaagccggcacaggcaacattgatgttaaaagcaaaggcatggtctgcctgcaaggccgcctgcaaacgattcgcctcagctggcgtcgcataatccggactcatggttgccacaataataaaatcaagttggtcagccgcgacctgcgctttggccaataactgctgagcaacatcgtaagctaaatcaaaatttttttgattggtgacgacatggcgcgctttaatcccggtgcgttccttgatccaatcatcggacgtatccatgtactggcgcaattgatcattctcaatccgcgtggcaggtaccgaataggcactggccagaatctccaaagcgggtccttctttctaatgacgatattcgtcaataaattcattcagattatccagtgcccgctcgatcaattcgatctgtggctcggtaaatcctttgacgaaactcgcaaccattttttgatgaaaggcaagatgggcgcgatacatcaggcgacctttgcgactgagccgtaaattcacaacgcgtttatccgactcaagatgcaaccgctcgacataacctttacgcgctaaattattgatggcaacgctcaaagtgccttgggtgacatgcagtcgtttagcaacatcgcttgaactcggtgtcgcatgaatgccgatcgcatcgatcgtatgcatttccttgatgcctaaatcgcggaactgacttttacgcagttcttcttcttccattcgtaaaatatcggtataaactctgatcaatttatcattgatccgcttgacgcttggcttttgggacataggtgtgcctccattgacaactgatttgatattcaaagtatcagttgaaaaaaatagcctgtcaagtgagctaagcattggcttctaccacgaaatgcaattctgcgtggcaaaccaattcatctccgatactggcagtcgtcgcaacgacccccatattctctcgaaccttaaccattttgatcgccagtgttagtacactgccagttggaacttgtgctgaaaaatcagctttactgatactgcctagataagctgttttgccagcaaactttggcgattttaaaatcaaaatggatgccgcttgcgctagcgtttcaataatcagtgttggcggcatcgttagttcatctggtagatagccgaccaaatgatcctccgcaacactgacatacttctcagccaccagcgattcatcaggcactaactcactcacatgatcgatataaaacaatggatatcgattcggaattaatgcctgaatggttgaggtatttaaagttgtcatagcttcgcctcctcttttcaaacgcgattgccggcctaaacgttgcctgctcacgctttctttttaaacacggtcgccagcccggaaaaaaacgggccagcttttttcaaaacgcgttcgctgacccagaaatctacgtgtaaggacagcgccgtcacagcgttccagccccatctggccggagattgcggagtttggcacggcaagaaagttttagcctagcaactttctacgattattcggaatttaatgaatcacaagtcttgcaaggaaattatggctcagcctctttttttaaatgtgaccccatgtttttcacttatatacgcaaaaagagcatgtcagctcgtcaaggcgagttgtgacatgctcttttaaattggcattaagccaaagcttttttagctgtgtcagccacagccttgaagccatctggatcgctaacagcaaggtcagcgagcattttacggttcatgtcgacatttgcaaccttcaagccatgcatcagcttgctgtaggaaatatcgttcatgcgtgccgcggcgttgatccgtgcaatccaaagacgacggaaatcacgcttcttagcgcgacgatcgcggaaagcataacggtatgacaccatgacttgggcattagctgccttaaacagcaaatgcttggcaccacgatagcccttagcgagcttcagtaccttcttacgacgcttacgagtaactgttccacctttaacacgtggcattagaattcctcctcaaatcaaatccgatagattattatttcatctggctgagcatctggcggatccgcttcatatctgagtgggataccaatgctgacttacgcaattgacggcgttgtttcttggtcttgccgtggaaacggtgagacgtataagcatgaccgcgcttcagtgcacctgatgcggttttcttaaaacgctttgcggaagcacggtgggtcttgaattttggcatgactttttcctcctgtaaacatcagcgtgttgctggtgaagttcaccagtttgcgctttttatacgatcttgccgaaaactacttctcggcacgcggtgcaagcatcaagaacatgctgcggccgtccatcttaggatgcgtttcaacagcagcaatttccttaacggcatccgccatctgctcaaggactttgcgaccaaggtccttatgggtgattgcccgaccacggaaccgaacgctgactttaaccttgtcacctttttcaaggaacttggtggcgttcttgagtcgagtattgaaatctgcttcaccgatggttgggcttaggcggatctccttgatggtgacagtcttttgtttcttccgagcatcgcgctctttcttttgaagctcaaaccggaatttcccgtaatccataatacgggcaaccggtggcttggcattaggcgatactaggacaacatctaaatttgcatcctcggcaatggccaaggcgtcacgcgtactcttaacgccgagctgttcaccggtctgggagatcaatcgaacttcacgtgcgcgaatactgtcattgactatcagatctcttgctatggttgttcacctccgtgtgaatttcagagaaaaaacaaaaacagcgtggccacaaagaccccgctgttcattaaataccgaactaatgagcctagcggtccaaggacttaggcgagaagcgggaacttctgctttttctcaacgggtataactatacaggaacattcaggcgacgtcaagtttcagcttttagcgattttaccgctgataaaatggcgcaaactcaccactcacatagcgtcctaattcattgtcgttaggactcacgtggaattgggtcgtttctggtaaataagcttctgcaaaggcaacaacggcgtgtaggtctgttcccttatctgcatctacgaccagcaacaggctttgggtatcatcagcgcggatcatggtggtcaaataggctgcatgaacagttctcagcttcgccaagtagtcgcgcaagtgcttaactaatgtggcggtttcccgcggcggttcaccgatccgcacagcctcaccatttttagcactatcaggtttagccacgtaaaacaagttggcgcgtgatagcagcatgttttcgccgtatggattgatggcgacaccttgtatatcgtgatcttcgtataaaaagttggcacagtcattgatggtggcaacagcgtattgatcatgatctgggcttttaccgaaattagcctggtcggtaaaaattggtaagaagtcctgtccttgatcatccgtaatcatgacgattgtcggatcaccatctctcgttgtcccaacaggcaacatgaatttagcagtctttaaagcagcgtaaaaagcggcttgggtctcatcattctgatcagcccgtaataactgaatcaaatgaataagttgtggattttgaacaattggttcatcagtcatcatcgttttcccctttatctcgtttctgatcggcactcactttgccacgaaacctgcgtaatttttttggtaggccaaccagccatgagagtaacacaatgccaacactgccgaaaacagccacaccttgaggttgaaattcaattttagcaaaccaccaagttgcgatgccataagcaccaacaacagttagcaacatcacaatgcccatgatcactaacaggccacggccgcgatgggcaattaaccagtaaccgcgctgattcggggtccgccatggcagcttcatgtaagcgaacaaaaccaccaaatacaaaacggcagcgaggatctttgtgaccacgaataagacgagccatgaagcccataatgcgataaacaccgagtcaccctttcttttgacgtgtgtcgtaaatgtgtccagtttatcatacatgctgaaaacaaatggcggatgtgctaaatttggcgagaacaaacctgttcctaaagatactaacaacaaaattatgaatgaaaggagaaatcaccatggcaacaattgacttagtgaggcatgctgaaccagacatcacaattcatgatgattttttgcggccactgaccagcgctggtcggcggcaaactcagcagttagttgccagtttgcatcaatatccgtacacaggctttttttcaagcccactcaaacgtgctgttgatacgatcacaccgattgcagatgatcacggcttacccgttcaaaaaaacgaactattggtggagcgaaaaatgcctgcatggctgccaaatttttctgaatatgttaatcagcagtggcaagatttaacattctttgaaaaacctggtgaatctattcatcaagttcaagaacgttacctttcatttttatatggactgccaagttcggcattcgtcgctgtcggtagtcatggcacggcgataagcagtcttgtcgaagcggccatccccggtatcggctatcattttttctcgaaacttggttacgccgctgtcacccgtatcgaaatgcatgcaggcaatgtggttcacctagctgtctgggaaccaaaatcaaagacatttaaagttctaaaatagtgtttccaaacctcaaaataatccaaaactgatggcgcgtttcgggattttgatcaaaagaaaaaggagctttgagaacaatgtctcaaaagttccttccccatttgattgaaaatgacactaatcacctaaaaccttggtcgcttcgcctggcttggttttgccgtcacggctgtaattcttcacttcagcgactaaagcatcgatgaacatgttgcctgcttcttcttcggtgtgttcatccccatagcggcgaactgaaaccgcagcatcattcaattccttatcgccgacaacaacggtgtatggaatcttcttggtttgcgcttcacgaatcttgtagcccatcttttcgttccgatcgtcaactttaacgcggagaccggcggctaacatttgtttcttaatgcgattgacgtaatccagatgcagatcattgttgactggaatcaaaacagcttgtgtcggtgctagccaagttgggaaggcacccttgtagatttcggtcagataggcaatgaaccgttccatcgtgccgacaatcccgcggtgaatcatgactggccgatgctcctcaccgtctttaccgacgtaggttagattaaaccgttccggaagcataaagtccagttgaatggttgacatggtttcgtcattgccaagtgcggtcttcgtttggatatccaactttggaccatagaaggcagcttcaccttcggcttcgtaataatccagtttcaagtcgtccatggcaccttttaacatgctttggctacgggtccacatttcgtcatcatcgaagtatttttcggtgttcttagggtcacgatatgaaagccggaaactgtagtcggtgatattgaagtcttcgtagacatccatgatcaagcgcagaatctttttgaattcttcttgaacttggtctaaagcgacaaaagtatgaccatcgttcagcgtcatttcacggacacgttgcaggccggacagggcacctgacttttcataacggtgcatcatgccgagttctgcgatccgcaacggtaattcacgataagagcgaatgtgatggttataaatctgaatatggcttgggcagttcattggccgcaattccaacatttcgccgtcacccatgtccattggcgggaacatgtcttcgcgatagtgatcccaatgaccagacgtcttatagagatccaagttagctaaaacaggtgtgtagacgtgttcatacccatcggcaatttccttgtcaatgatatagcgttcgataacacgacgaatcgtggcaccatttggcatccagtacggcaagccagcaccaaccttaggatcaacgaagaatagatccaaatcacggccgatcactcgatggtcatgttcagcagcttcttggcgtcgtttggcatcatcttccagacccttttcgctccaatatgccgtgccgtagatccgttgcagcatcgggttgctgctcttgccttgccagtaagcaccagccactgacagcagcttcagatgcttcaagtccttgagacttggtaacaacactttttcttcaaaatcaacgaagtcgcctaacttatagcctttgatcggatcgccggcagcttcaaccaactgcttcttgaatggatcatttttgaaggcttggaaggcttcggcacgactcaacacaactggttcaagtgctgcgttttccttgataatcgcttccattttcttttgaacggttggcaaatcatcaacactcacctgaccgtcagcacgatcggtatcgtagtaaaagccgtcttccgttgcttgaccctgaccaaaatgaatatccgggtataagtctttcaaagcagcggccagcacaaacgctgctgtttgccgcaaaacggtcaaaccttctgcatcatccttggtcataatttgcaatttaccagaatgcgcaatcggttcgtcataagcgatcaaatcgccatctaacttgccggcgacagccttctttgccaagctattactaataccctcggtgattgccttaactgtggtgccatcaggaaactgtttgacgttaccatcaggaaatgtaatatctaatgccatgagtaagactcctttattgttttttcgaagaaaccaaaaaatccctgacatctcttaagagacatcagggacgatcagtgatcgcggttccacccagtttgccaacagcactggctgttggccacttaattgacgcgtaacctgcgtaacagggccttgcggcaatctcgagaagtggttcggatcagatcttacaagactttcagccatggtcttgctctctattggatgatcctttgttgcttccgtcttcgatagcttcattgaaacacattgcgcagtcaggtgcaagaggttttctgaaaaagagcgctctctggcgcgtttaggaaccggaacataagtggcctcaagcctcaatggcggggctttggccatttaggcttgaggtccttatgtgcagatttctgcgccaaagagcgcgtttcagccacagcgtgaactagctccgtccgcacggctacaagtaattctggaaataacatcatccgccagcggtttacaactgaatagcgatactttgagcgtcaatctgccaatggattgcgccgattttcaccgccgacctgcacttctttagctaaaaaatgaatccgttccatgatgcgcttggctttgagcatctctgaatttccgcgatctgtgccggcaagtgaggcagttaaatcttccatacttttattcgagctaaacaaggtcggcattttttcctgcatgcgatactgcaaaatgatgccaagaacatcgtcgcgaacccatgggctaatgctttcagcaccgatatcatcaagaatcagaacttgcgcgcgtttgatgcgatcaatctttggcaagacggtgttgttcccgatggcatttttcatttcaaccacaaatgttgggacatgaatcaaggtactggcaatcccgcctttttcggcaagatcattggcgatcgcgccaagcaaatatgttttgccgactccaaatggcccactcaaatatagtccttgatgaaaagccttaggatcggcaacaacggcgaggacgaattgattagccgccaacaaagcatccatccgctcatcagtcggatcgtaattggttaagcttgccccacgaatgtccttgggcatgttaaccgatgtgactaaggaagcctgtttagcctcctcatcggccgcaattttggcatctgttggttcataagcgacgtcaatcaaaccgttagctgccaccagggtcggcttataccccggtgccaatggtaattcgccacgagcaattttgtttcgttcgctgacaaattcgtagatcttcgcggttccgcgatcaatcgcatcatcggcgagttcgccggtatgttgttttagaaaagcctgaacttcagggtcctgcaaggcttctttgaccatcttgaaataacgatcccgccactgtcgagaatccatcaacatggcaattcgtttccgcatatcttccatcagttcgcgcctcctttatcaccgagttcacgcagtttcgccaattgggctgctagtttctcgcggtcagcatcgctcacctttttcttttcaggctggtaaccttcttgtgcccaatctggcaatttctcctgccgcggacctttggcgctaccttgacgccgtttttggccactggccttctgtttttcaaagtcatttatctgtttcaaagcagcctcgggactgttcacattagctttcagccaactgttagcaattgcatcaagcaatgcctgattgatactgtcattggttcgtaaaatataatcaatcaaaatattgatcgtcggcgcatcgaacacattccgctcactcagctgctgaacggcacgtaactcgttgttagccgggtacattcggacattttttgcctgcttggcggcggttaagaattggcgcggtggcatacttttggctttttgcaacaaagcttcgtcagctgatgccacttttggcggcgccgtcgtggtcgtcggctgcgcatgtggttgtgctcgggtgtagccttgttcagctaagcgccgcaattgactcaaattaattttgccagtcatgacatctgtggcgcgactaatcaagcgagcaaaatccggcggttgaatcccgtaaaaaccggcgatttgatacaacgcttcctgatgcgtggcgagttgccccgcttgaatattactattcgccagcatcgctttgactaatgcccaatcatagccgccgcctgtgccaagccgtggccgcgtggcttctttttgcgtcatatctgatttagctgccaccactgctggtggttccttgctcaaatcatgatcaaaccgaaacacatcgagaaaactggctgtaatctcctgccattcaggtctgcgcactggtttgaggctaaattggccaaccagctcatcgtatcttttttccccgactttgtcgtataggagcaacccgagaagatcgtccttgaaaaaggcatcaggtgccaccggtgcatacaactcataagcgtagtaacgccctaatgagtcgacttgcgtataagtgcgcagtaacccgaccgcctccagtttgacacgcgcattgaataattgatcaatatcaatatctaataaatccagcagccataattgcagacgtcgatcagtcactagtgcgcgatctttaacttcctgccacaggctcagatacaatgccatcgcaatcggcccgatgagcggctgatagagtgaaattgccactttttcgtcaaaatcactcaaatgaccggcttttgttaacacaaaccctgcctgtggactaaatgtatcaggacgttgcatgcactttcacctcttttcagacaacggacctgagacatttgcctcaggtccggtttaccattttcagctgcgatgatctttacttcttggtcttttctttcttcatcatgtcctgcagttcctgcatgaagacggacatatctttaaactgtcgataaacgctggcaaaacggatataggcaacatcatcgacatcggctagtttagacatgacaaactcaccgatcgcctgactggagacttcgttttcaccaatcgcacgcaactgattttcgaccgaatcgacaatactttgcatttgttccatggtaacaggccgtttttcagcggcccgaataagtccttttaaaatcttctcacgattaaattcttcacgtgtaccattctttttgatcactaacagcggtgtttgttcaacccgttcaaaggttgtaaaccgaaacccgcaattttcgcattcgcgacggcggcgaatcgcacggccaccgtctgttggtcgggaatcgacaactcgcgaactattatgatggcaatggggacattgcacgactccaccctcttaatcaaagtttgatagcttattatagcacgcgtaagccgcttatgatagccgttgcagccggtggatcaaggcattggcttgggcaatggttgcctcttgagtcccattattatcaatcacaaaatctgccaatgctgccttttgcgctaacggcatttgcgattgaattcgggcctctgcatcagcctgtgagagtccgtctcgtgccattaaacgcgatagttggatattggggtcaacgctcacaaccgcaacaccgtcaaagtcatcggcataatcggcctcatacaacaaaggaatgtcgccgacaacgatggcggccccaccggcttttgcctgtgcaagtgcctgactgatggcctcgcgcaaataaggccgattgatctgattcaaggctgccattctgcctggctgggaaaaaacaatctcggccagcttggcgcgatctagactgccatccgcgcgcagcacttcaggaccgaaagcttgagcaatgcgcgcaagaacaggctgcccaggctcgacaatctggcgggcaatgacatcagcatccaccaccggaaacccagcggctttgaaagtgcggctcaccgtcgatttccccgatgcaatgccaccggttaaccccaagagataagtcacgctggccgcctcctttgatgtaatggctgacagtgtgggcagtaatgggttccgcgctgaccaaccttaattttgacaatcgtcgtgccgcagcgatcgcacggggtaccttcccgatcatagacgtgcaaggcattttgaaaagaaccgcgattgccttctgcatcaacatacgtatgcgcgctggtgccgcctgccgcaatggctgcgtttaattcttggataatcgcatcatgcaatgttttgatttctttagatttcaaggtgtcagctggctgcagcggattcagttggcttaaccacaatacctcgtcagcataaatattacccacgcccgctaccacggtttgatcgagcaaaaccgacttgatcggtttatgatggcgtttcaggcgccgggcaaactcagtctcgtcaaacgtgcttggcgttggttccggtccgagcttagcaagggctggcacctgatcttcctgaccagttttaatcaatcgcatccgaccgaactttcgcagatcccgataccgcaactgactaccatcctgaaatgtgaacgtgacgtgatcatgcttatcaaaaggtgtgtttgcatctttgacaacatagtaacgcccttccatacgcagatggctgatgatcgtttcaccattgctgaggcgcatcaaaagatacttgccgcgccgatcaatggtcgtgatctcactgccgacaatttccttttgaaaagtcgccaacccattgatcaggattttctcccagttagtgttgatggcagtaatgactttatttttgactaacggcagaagcgagcggcgaactgtttccacttcaggtaattcaggcattgaaatctccttatttagcgtcgaaccaagttggtccataatgactttcaacctttaatggcacatcaaggtgaactgctgagtccatgactttgggcacgagctcgctaagctggacaatttcttcttcaggtgcctcgaagatgagttcatcgtgaacctgtagaagcattttagcttgcaaaccggcctcatccaaggccttttgcatgcgaatcatggctaccttgataatatccgcagcgctaccctgaatcggcgtattcatagcggtccgctcggcaaacttacgcagattgaagttgcgtgagtgaatttgtggcagatagcgccgccgatggaatagggtttcgacatagccgtcttcacgcgccttcttgaccatcgcatccatataatcatgaaccttaggatattgatcaaaataaccatcaatgaacgcttttgcctgtttacgggaaatgccaatgttttgggatagaccatagtcactaatgccatacacaataccgaagttagttgccttggcttgccgccgcatatcaggtgtgacttgatctggcgaactcaggccaaaaatcttcatcgcagtgttggcgtgaatgtcgacgccatgtttaaacgcctcctgcatattctcatccccggaaatatgcgacaacacccgcaactcaatttgggaatagtcagaactaaaaatttgccaaccttcatgtgacggtacaaaggccttgcgaataatcttaccttcatcacgagcaggaatattctgcatgttaggatcaactgagctcagtcggccagtttgcgtcaaagtctgcaaatagcgggtatgaatcttatgatcaggcaattgcgccttcaacaagccgacaacataagtcgaattcaatttagcccagccgcgataatccaaaatgtcctgcacaatcggacttgccgatttcaattcgttcaacacgtcaacgcttgtcgagtaaccggtcttcgttttcttgatcacaggcagattcaatttttcaaaaagaatttcgccgagctgctttggtgagttcaaattgaacttcacgccagcttctgcatagattttctcttccaaaatcttgatgctttgtgagaattcagtgcccatagccttcagcgttttagcatttagggtaatcccttgaatttccatttctgccaaaacccgagaaagcggcatttccatatcagtgaataagtctgtttgggcctgcttttccaaatcgccagtcaaatcaggccgcaatgcgaacaaagcattagacttgcgagcaaactggccaaacaacttatcgtcttctggcacttgccgtttggcgcctttgccataaatatcctcatcacgcggcatgtcatgataatcgtgatcttcagcgattttacccaaatcattgctgttttcgtcaggattaatcaaataggacgccaataacacgtcaaaagcgatatccggtaatttcacgccgagtcgattagcggcgacgatgtttcgtttgccatcaaaaactgtcagatctcgtttggcatcttccagccaccgtttaaccgctggcagcgtcagcaaggtgacatcggtactcacgtaagtttcttccttagtgccaataaagaaaccgatttgttcggccacatgataattatcctcgagcatttcaatctcaaaagtcagaggttcggtcagcttggtgagtgcaagaatcgattgctcatccagcacggaaaaatgaaccgcctgaacaggtttagcgacactaccaccgatttttttgagcaacgaattcatattcatttttgtatagaagtcccggagtttgtctaaatccggtccagcatatgtcacatccgctaagtccacagtaagcggtgcatcgcgatcgatcgttgccaactgtttgcttaagaaagcgttatctttatcgttaatcaaattctctttaagtttgctctttttcatgtcatccacattagcatagaggttttccatgcttccgtattgattgagcaatttcagagctgttttttcaccgaccttggtcaccccaggatagttgtccgaggtatcacccatcaaacctttgagatcaataatttgagccggtgtgatgccaagcttttctttgacatgtgctggggtgtaagcttcaagctcattgacacccttcactgtcacttgaactgtggtccgatcggtcgtcagctgcgtcaaatcgcgatcaccagtgacaatcgtcgtttcccagccggcctcatccgcacgcttagccattgtgccgataatgtcatcggcttcgtaatcctttaattcataatgcgcgatgcccatgtcatccaacaattccttgatataaggcaattgttccagcaattcgctcggtgtcttggcgcgaccacttttgtaatcagcatatttggctgtgcgaaaagtcgtcttgcctgcatcaaatgctactaaagcggcatctggttggactgcctttaaaacaatctcgagcatgttgttaaacgcataaatggcgttggtgtgcaagccatcttggttcgtaaaacggtctaattgattatataaagcaaaaaatgcacgaaatgcgactgagttaccatcgactaataataattttgttttgctcgccataagtgggcttccttttctacggccgctactgtcaccgcgacctgagttagttgtcatagtcattgtaccaaattctgctaaccggtgacttgctggtcaggggaaaactggcagaaaacaaaaagagaactggcaaataccagttctcttgaacatttttagttaattattgttattcccaacaccgagaatctgtaggattgcggtgaacaggttcaagaagtcgagatagagcattaacgcaccgagaaccgctagcgagccttccgaaacggcagcttgtccatcattgccagtggtgagatacaggttcttcagccgctgcgtatcccacgccgttaatacaatgaagataatcaggacgccgtatgaaatcagcagttgcatgcctgaagaaccgatgaatgcattcacaatcgacatgatgataatcccaaacaaggcaaccatcgcgatattaccggctttgctcaagtcacgcttgccaaaatggccaaccatcgacatgaccagaaagacaaccgctgtcgtagctaaagcaacggcaaggttagtaccgtccgcaaccatggcaactgaagcgaacgtgaagccaaaactagcggacatgaggtaaaacatcgctgttgcataccccggacttgcctgtgcgcgacgccctgtcacaaaaaatgacaaaataatcggcataaaagccatgatccaaaaaacaatcggatgcccactcacaaaactggtgtactcagctctgaatggaaatcctaacaaataactgacgagcgccgtcacgaccagtccgctccccatcaaggtatagatgcgggagaagaactgtgtcaagccggcctcgtttacaacacggcgttcttgcatagcgttcattcctttcaagtaactctttcgagtatctgaagaccattataaccggaatgatgatatttgtcagtcaggcgaaagaccgatctttattatgagcagttttcgatcattttagacacagttttcgatgtccaacaaatcatgatcacacggtctattcttcagccaataaggtttcgtaagctttttcatacttttgaatatcaccggcccccataaagacaaccactgcattatgatattgcagcagaggcttcatgtcttcctgatgaatcactgcagcgcctttgatctgcgcggtgatatcttcggatcggattttaccagttttctcacgagcagaactgaaaatcggggttaagaatgtttgatcagcttggcttaggacctgaacatattgtggttcgtaggcctgcgtgcggctgaaggtgtgcggctgaaagacagcaataatcgccttgtcaggatacttttgacgagcagcatctagggttgctttgatttcattcggatgatgagcatagtcgtcgacgatgatcatgtccttgagatccttttcggcaaaccgacgcttaacgccactgaagttgccgagctcgcgggcaatcaactttgcatccagcttttccatgtgagcgaccgcgaccacagccagtgcatttaggacgctgtgttcaccaaacagcggcacaaagaaatgaccgatcagttgatcgtggaagtaagcatcaaagctgctgcctttcgtatcgcgatcaacgttgcgagcctgaaaatcatcacggtcactaatcccataataataaaccggcacctttgcctttagcttccgcagccaaggatcatccccccaagctacaattgcttttttaacttgattggcctcagtttcgaaagcattgtatacatcttcaaaaccagtgtagtaatcagggtgatcaaaatcgatattggtcataatcatgtagtcaggatgataggccagaaaatgccggcgatattcatcagcttcaaatacaaagaatttggagtcaggaatgcccttgcctgtgccatcaccgatcaaatagctggttttagcaacgccgcttaaggtatgggccagcaaaccggttgtactggtctttccgtgcgcaccagcaaccccaatactggtataaccttcaatcagcttgcccaagaattcgtgataacgataaatcgtgagtcccaattccttggcccgtttgatttcaggatgatcgtccgtaaaactattgccagcaatgacagtgtaacccggtttcaggttagccggatcaaacggcagcatcttaatgccggcagcagcaagtcctttttgggtaaacgtatattgggtaatatcactgcccagaacctgatgccctaaatcatggagcaccaatgccaatgcgctcatacctgatcctttgataccaataaaataataggttgcctctgtcatgacgtttgttcctctttctttgcttgactgtaataaacttcccgcggctttgcgcctttagctggcgaaacgagatgcttcgcttcaagcgcatcaatcaaattagccgcgcggttgtaaccgatagaaaaaacccgttgaagctttgaagtcgagatatgtcgttcaccagatagatagtctagaacttcaggcatcaactcgtcttcatgtgacacgctggcttcagccgatttgaccaaaccagccggatcaaaaagataacgtggtccgcgccgagctttgacataatcaacaatcgcatcaatttcgcgatccacgaaggttccttgcaggcggatcggctgactagcgccattgcccagatacagcatatcaccacgaccaagcagccgttctgcgcctgccgtgtcaataatcgttcgtgaatcaatttggctggcggtcatgaaggcgatgcgcgtcggaatattattcttgatggtaccagtaatcacatccacacttggccgttgagtggcgaccaacaaatgaatcccagccgcccgggccttcgccgtgattcgcgcaatgtcatcttgaatctcactgcccgcagctagcatcagatcggccaactcgtcaatgataatcactaagtatggcaggacttgcgcgtattcgtgaaaacgctcggcctttgcattgaactgttccaaattacggacaccagccgccgccaacttcttatagcgatcattcattgttgacacgacccacttcaaagcggcactggcagctttgggatcggaaataactggcgataccagatgtggcaagccattataaccggcaagctccactgcttttggatcaatcagtaataaccgcacttgttccggtgtagccttatagagcaaggatactaacagactgttgatgaagacagacttccccgaaccagttgctccggcgatcaagccatgtggcatcctagccaagttggtgaccacaggctggccaaaaagatccacacctaaagcaatcgtcaatggcgatttagcctgctgaaaagccggggtatctaggacttcgcgtagcatcactggtcgcggtttcagatttggtatttcaatgccaaccgtatttttgccaggaatcggtgcttcaatccgaatgtcttttgctgctaacgccaatttcaagtcatcattgaggttcgtgattttattgactttaacaccactggccaggcggacttgaaattgggtgacagtcgggccaacagtgtgagcgaccacatgtgcatccacgttaaaggcttgcaacgttttatccaaccggtcgctttgtgccacaacccaatcttcttgggcagcctgatcaactttgaccggcgaagcaagtagcttgagcggtggcaatgtgctaatccccggtgttggccctgtaggcgcggaacctgtgtcctcagccgcagccattgatgaaggtaaaataccagttgacggtgattgcgttagtgctgacgttgaatagtcggcatcattggctgatggtgtttcagccgtcgttgaaggtggccttgatgtttttggtgatgtttgcacctctgcctgagcttgctttgcctttgccttctgggcagctaattcacgccgtaactttttggccgcatgtttgcgccgcaacgcctcaattctcgctgccttgcgactgttaggcgcatgtggcttattgatgacagactgtgaggacgaatcaacaaacggcttgttaaccgatgctggagcctcctctgcctcatcagcgatcacagcggtcagtaatgtctttttttcggtctccgctgacttagcctgtggttcaacagcatatgttgccggtgtcgaagacgataattggtgcgtgtcggttggtgttaccggtttggcggcaactgacggtgcggttgcttctggcaaagtctcatcaagcggcttttggttctgcgtcccggcttcatccgatttttctgctaataaggtatcttcctgcggtgctttagaagcgttcgctcgtctgttagcctcattttcatcttgtttttctataaatgacgtcgtcgatttggctgtattcgtatcagacggtgtcagcgaaatatcatgattgacggccatcttattttcgatgccatggcccgcaaaaagataaaccgtttgcgaatctggtcgcaaaatctcagcaatttgtgcgtaatcggtacgatcaataggacgccgatcagctgtgctgtttggcgttgataggcgcgataactcatcgcggccccgcggtcgttgcggataatcaaaggcacgcaaatcggcctgagcctccgcgaccttgcgcggatccacatcaggcattggttcgtgcgccaattgcggtggcaactgatattgttcctcgtgttgcgcctgtgtccagtccgaagtattcaactcagattggggttccggcactttattttgatgtagaaatgccgggccatcataatgcgccatgattgaatccccttctattcatgtttctagcagtgcctctattttagcataagcaccgcaaccaataatccttgatccctaaaaatatcaccagcaattggaaaaagattcatgttaagaccagtgattttgcaattggaggcaaaagaaaagacgtaagcacgaggcttacgtcaaattttttcgttattcgcgatcaaaacaattacaaccggctgttcagatgggcacaaattatgatgcttgaacagcaacaacggcctcggcttttttagcatcaaatggtgtgcctgcaggtaaactatcaggcatcaccaagataccgcgacgttgtggcgcgccaggaatgcctaactcacgggcactgctgatcatgccgtaagagtcaacaccgcgcaacgagcccggccagataattttgccatctggcatcatggcacctggcaaagcaacaacaaccgtttggccgagtgctgcattcggtgcaccgcaaacgatttgaacctgttcattaccaatatcaacttgcgtcacatgaagatgatcagcatcaggatgatccttaaaatcaacaattttgccaatcacaaacttaggggtttcatcaaccgctagtttacccggcagccctgccgtctgaatagcctgattaagctcggcaatttgtgttgcggtcaacacaaggcgaccttggccagttaactgacccagccactgtgtcacgttgaaaaagttgtagccaatcacgttgcctttatcattgagaattgcaacaatgtcaccacatcgctgaattgtttgtgttgccgtatcctgacctgtgatggcaagcaaggtgttgccaaacgctggttgattataactggtaatgagcatataaacctccaaaaattaatgcaagccgttaatgaaatcttcgacttgttgtttcgtcttacgatctttattcacaaaacgaccggtttccttaccatcgttaaaggcaataaagctcggaatgccaaacacacccatatcttgagcaacttctaaattcttatcgcgatcaaccgcgatgaattcatagtctgaaaagtccttctcaatttcaggcatagctggtttgataaaacggcaatccgagcaccaatctgcagaaaagaacaacatttttttacctggttgcttgacctcatttaaaattgctgcattagagcctaattttttcatagccaacatcctttcgcttactatttataagtaactataacaggaaatcgtcttaagatcaatgatgctcgtgctgtgttacattatactcaaggtgataaagcttgaacaggtcaacaaaagccaagtcacacatcgtcagatcagttagagattagcagaagacgtcagcaatgtctcgcctttatatcagttttaaaagaacgtccggaataggttggacaggtccgtctttatcactaaagggggtcacaaatttggcaattttcaaaaagaagtcgaattggcgtgtctggatagccgctgctgcggtgacggccggcatggcctcgattgtttatcggcgcctgtattatcgaaccattcctaatcgcattttgtccatcgtcaaggccaactttacaaatcgcggaaccatcgaaaatagctggatcaacatgcagccaaccgaacgcgggactggccgtgatcgctatcgcgtgtatactggcgggttgaccgtgcgtgaaggcgaccgcctcaatcagtttgcctttgctgttgaacccgatggtaccttaagacaattaaaacaacttcacgaaccgattaatgcttaaaatgcgcgacaagttcgtagattcgaccgccatcagcgctgaacttctcttcgtattcagtaggcacgttatccgtaacgcgtttgtcgtgatgtaggttcaaggaaaccaaatcgaacgtcatcccaaaatgattcatgctgaccaaggaatattcaaacaacccttgattatccgttttaaactgcagcaaagcatctggcttcataatggcttgatactgtcgcaaaaagtcacgataagtgagccgccttttttcgtgacgggtttttggccacggatcggaaaagtttaaaaacaagccatcaatctcaccttcactaaaataatcggttaagtccgcaccatcgcccagcacaagctgcaagtttggcaattttaaggcaacctgttttttcagaatcatcgctacagcggcttcctgtaactctaaagcaataaagtttcgatctggatgggtcttggccatttcgacaataaattgacctttcccagagccgacctcaagatacaatggccgtgattggtcaaatcgcgattgccaatgaccttgcatcttttctgggcgaaccagaatcatctcaggatgagccaagattagcggtttcgcccactgtttgttacgtaatcgcataaaatttctccttaacttgaacattggctaggtcaaagtacaccgtgaccgctcaaaaggcctgggacaaaatcactttttgcctcaggccttttttgatgaatgaccttgcttgtttgcagcacagcttaccgactcgcttgtaaacattcgaattgatgcaaaacttgcgcaacttcttcgaatcgttgatgcgtggctgctaccttaatatcatgaagcaaatgcagatcaccgtaccagtacagtcggcgtttcaaatcctcatcaagtcgtgcgccgtaagcatccaaaaactggtgacttgtggctggactgccatagtgggcaagtacatccgcgagatcataagccggatcgcccagcgctacctgctcccagtctactaaatacaaccgaccgcctgcctgtaaccaattcttgtggttcaaatcgccatgacaaaccgtttgcacattcgtgtgcggtaaccactgctttaaatcgtgcagagccgttttgatcttaggctgcgcagccacatcgactgggaaatcctgaagtagtgcgattcgtaatttctcaggatcaaggacttgaccgcctacttgacgtaataaccgttttaacagacttgagtggtgcacctgtgccaacactttggccacgactggcaacatcatttgttgccgcgttaacgtttcaccgtccagccactcttgagcggttagcacgtctcccgtactcacccgccgcgtccacaacagccgcggggtaatgtgttcaactgatagtgccgcaagaaacggcgaggcattgcgcttaaggaaatatttttgattggcataaaccccaagaaacgcacttccggtggatccacctgcaggctgcagggaccacccggaatctaattcaaactccataggcactactccttacttctggccgcaggaatgattcacaacatcaaaaagacactcccaggcgctcgtgcgtccacgctcaatattactaacttgcgaaattcacgtcaagagcagagcgcaaactggcccgctttgaaaccggaacataagcggccacaagtgcgatggccgcactttggccattgtgcttgtggtccttatgcagaggtttctgcgcctgtgaacacgtttaggcagagtgcgaactggcgcatctgtcattcaacgcatcgcatcatgtaccttcaaccgaacgcgtgcataccatcgcgtgaagccccagacaaatgcagtcccgccaacaaatatcgtcaacgcggcgagccactgcagtcggatcaacgcaaccagtgtgaaaacaaccacttcaagcagcaacaacgtcatcaaaagccgttcaaaggccgccagtttttgatttggttctactggatacaagtgcgtgaagacaatttcatcatattggaagaagaatggcaacagctgaaagccaaccatatacaagaatagaatcgcaaaaccaagcaacagccaccactgagacaaaaccgccacgataatcgcgccgatcaccagtagccgcaagtacaacccaagatactcaccgccacgcaaaaagccgcgcagatacaagtatgcccacgtctctgacttgcttggcttaaccaacttcaaaagtggatcgaggtaccggcgacgatggacgctgtttgccaaacctggcacatccgtgaatagattataaaatcgatacagtcgacccatgcgatctgcttcgaggtcaattaaagcttcaaaattcaataacccctctgccaacaaggaacttcgcagccatctgaagaccaaattcagagtcagcgccactaacaaagccacagccggatgcaagtaaaaacctaaaaaaagagctgcgaatgtgatgacaagcagtacaagtcgtggatgtcgccaattgatcggcagataatagcgctgaagcaattgctgccacaagtcgagatctttgaataaccacacagctagtagcagcgtcaccgtcgcactgattggatcttgacccaattgtgcaaataatggccacatcgccaaagccgcaaagcctaataaagttgccggtaaaatcatgctgtatcgccgtgccttcaacaaatagtcactgaaggcctctgcttttggcagtaagaagacttgatcgggcgcctgcgccaacgtggctaactgtccaagcgcgattaaagccgtaaaaatgacagccagacacaaagctaaccaccaagatggttgcaatgttttcactagcagactgtaggcatataaggcaccgccaaaaagtattagcaagaccagtacaaaatggtcattgaacaccaatcgcaaatatttttgctgttcttggacatgttgtcgaagtcgagttcgccataacgcgaccattactgttcctccgtcattttcatatagatgtcatccaagctaccatcctgaagatcaaattgctgcttcaaagaaggtaaatcaccagttgctctgactttacctgctttgatcaaaacgaattcgtcagcatattgttgagcggttgccaaaatatgggttgacatcaaaatagacgctccttgctccttttttgctgtcaccaagtccaaaagatcatggacggccagtggatcaagtccagtaaaaggttcgtcgatgataaaaagccgtgcatgcgtcataaacgccgccacaatcatgaccttttgctgcatcccttttgagaattttgctggaaaccagtccaacttattgtcgagtcggaacattttcagcatattatcggcatcttgccatgcaaccgtcgcatcaagatcgtaagccatgatggtcatttcaagatgttcccgcaacgtcaattccggataaagcaccggtgtctcaggcacatacgcgaggtcagctcgaaaaccagtgggatcatcgtgcaatgttttgccatcaagtgaaatagtcccgctttgtggggtcaacaatcctataatatgcttgatggtcgttgacttgcccgcaccattcaaaccaattaacccgacaattttgcctgccggtacggtaaagttgatatctttcaagaccgttaaattgccgtaaccaccggtcaatccttcaattgttaaagtcatcttaccagtcccaatctgtataatttcagttagtgatatgatagcatgaaatcaaggtttctattaaaaaagcgcaagcagaaatgaggcagcaacatgaatgattgcattttttgcaaaattgtccgtaacgaaatccccaatgttaccgtatatgaagatgacgttgtcaaagcctttctggatatcacgcaggttacaccgggtcatactttattagtccccaaagttcacattccagatattttcgcttatgacactgaacttgccgcagctgtttttgaacgtctgccaaaaattgcccgcgccatcaaggccagtgacccggcaattaaaggtatgaatattttgaataacaacggcaaggtcgcctatcaaagcgtttttcactcacatatccatctgattcctcgctatagcgatcaagatgattttggcatgcactttggcgatcacagtgcacagtatgacacagagaaacttgaagcggtcgctgacaaaattcgtacccagctggaggcccaagcatgaaatttaaacacggctttttactcggagcactgaccggaacagtttatgcgctgttgactgccaaaaaaaccggttcacaacttcaacaagagatcgcggcctactttgaaggcttaaccgacggggttggtcaggtgcgtgagagtgttgctcagttcagtcaatccctcacccatttatctgacgaactcaacaatactttgaaacctgccatgaaagatatcacagatcgggtcaagacttttgaatttgaaacggcaccgcgcgttgatgcgatccaaaagcatgttgaaaatatcaatgatgctgtcagcaatcttgatgctatgccgactgccgatcagcgtgaacctttaccaaaacattgaaaattgccggcgatgcccatcaattaagtcgtgacggtttcgtgaaacttatgtgaagatccgcgtgcggcagtaagttatggtatagtagacggcagtgttaaccgaaacttttaagattaggatgtgtgattgcatgaaaaaatggattctcggcgttgttggtttgtttgtagcagtgacgttagctggttgttcaagcagcacggttgcaaacatgaaaggtgccaaggtcaccaaagacgagtactatgacgccatgaagaagaccaccactggccaagcaacattgcgtaacatgattgttttgaaggcattggaacaacaatacccgaataaggtgtctgataagaaggtcaacagtcagttcaatacactgaagaaacaatatggttcttcattcgataccacccttgaacaaaatgggtataccgaatcaagttttaaggatcaaattcggacaaccttgtactcagaagttgccttgaaggccctcaaaaagccaacagaaaaacaaattgctgctcagtggaagaagtatcaaccgaagatcaccgtgcaacatatcttggtcaagaccgaagatgaagctaaacaaatcatttccgactaccaaaaagacccaaccgaaaagaactttgaggcccttgccaagaagaactcaatcgatactggaacaaaagataagggcggtaagttgacggcgtttgacaacaccgatactagcttggattcaaccttcaagaaagcagcctttaagttaaccaaggccggcgatatcaccacaacaccggttaagacgcagtatggctatcatgttatccgcgttatctccgttggtaaaaaaggcacgatgaaggaacacaagaaagatttggaaaaccagctctatacaacatggcagagcgaccaaaccgtgatgaacggtatcatcaccaaagtgcttaagaaggaaaatgtttccattaaggataacgacttgaaggatgttctttcaaactatctgagcaccagctcaagtaccagtacttcaaactaaaaattaaatcagtgttagcacttgaaagcctcgcaattaattttgcgaggcttttatttgtgttgcaaacatgacgcaataatggcaagtgattgtttgtaggactcaaaaaaggctgataaagataggcgctatcccatctttatcagccttttgacaaccacatgactacaactaaactgactgaattcgcctagtgcggatccggaaaagtttgaccatttttaggtcgatagaagcgacgattgtccataccgaaaagtcgttctgtgaaggtaccaggatcaacatgttggtaggcggttgtcatcatattgattgatgcgtccaattcgtctaaatcatgcaacacttgcgcttcaagcagctctggccgcaccggcgagccgtattcaagcaatccgtgatgtgcaagcacgacatgacgtagtaagagcatatcttcagcgttgatatcaattttaagttgctgtgctgctaagacaatctgttcgtcaatgagaatgatgtgaccaatcaagttgccttcaaccgtgtaatcagttgagattggcccgcttaactcaatggtcttaccgagatcatgtaaaattgcgcctgcatatagcaaacttttgttcaagctcgaatactgttgaacgacacttttagcaagtcgcaagatgcttagcgtatgaaaagcgagaccaccagcaaaagcatggtgatttgacttggcggccggataactgaaaaatgccttcttgtgatcattgatcagtttacggacaattcgattccagttagcattggtgatttcgaagatgtaactgttcagttcctcttccatatcactgggtgcttctggcgcccgctcaacaaaggctttaggatcattgccttcttcttgggttgccaaccgcaatgaaaaaatcttaatttgcggattgccttgatataattcacgcttacccgacaattggacgacttcgccagccttaaactgagcaatgtcattgtcgctagcatcccagaacttacctgaaatatgtcctgaattgtcttgaaaaatcatcgcaataaattttttgccattctttgcgacacgcacttcagctgatttaatcagcacaggaagccgaacatcttcttcattatgataatcgaaaagccgttttaccaaggtcgtcaccttttccttgaattttcacactacttaaatcatacagatatcaatgataaagtacaaggaaggttggtgcttgagtgtatgagaaaccatgcttaattgtgtcatacaaatgttaggcacatccaaggacgagtcagcgcccaagtaagagctggcacctaaccctttttaaaaataatggttggatactgcaaaagaaaatgcaccacctatgaattgccttttgccagcaagtttagttcaaacattgtcgcgacacgctcagccttctctatgcgcatgaatttccaaagaaaaaggatctccgcaatcaacggaaatccttcaatcaccagtcattacttgccttgatagacatcaataattggctgggaaataattttattcaattcgtccatcatctgagataggccttgttcttttgccatcaaattttggatcggctggatgtcgcgcatcttgtcgccaagttcttgcaatgacttcacttcatcatccgtgaaatcttgtccctgcattgacttttgctgcatctcatattgcttttgttggaattgttggaacaaaccgtaagcaacggtgtccagcttcaagagatcaaacgccttcttgagatcttgaaattcctgtgttgtcttgatatctgccgccatctgattagcggtgtcgtaaacatttgccatactttacctcactttttgagcctatttaaaccagcccttgatattatcataccattgtcccacagtttgcttggcactgtctatgcctttctcgatgctatcctgaattccttgccatgttttgtcgccactggatggcgtttggatgctggccatttgtgcggcatctttcgtgtcaaaggcggtttgtggcgtattcggcattagattcgtcatttcgagtttaaataacggtgccaccccagacgtgctggtgccttgaaggaaatgctgactgtcggttgtcgggtaaccaatccaggtcgcatttacaatgtctggcgtatagccaatgacccactgatccttagtgccatagccccaactacttggtacctcagtactgccagttttcccggcgattgtgtagccagctggtttagcagtttgaccggtcccttcgttaaacgttccgatcatcatgctcgtcatttcctgagccactttttttgatattatttgacgcatcgttggatgtgagttgtcgaccaccgtttgacctgacgcatcgacaattttgcgaatgaagtgagtcgttggcaatttaccgccattcgcaaacaccgcataggcccgtgccatcatcagcggtgaaaccccatttttaaggccaccaagtgcagcagcaagattctgatcgctttcttttagttggatgccaaaccgatctaagctagtgacccctttttgtacaccaatcttattaagcagccaaacagccggcgcgttgatcgaatcggccaacgctttatacatcgggacagtacctaaataggtgccggttgcattggtcggcgtataattatttttaccgtaactaagtttctcgtccttcaagacagaatcataatgataaccattttcaagtgctggtgtataaaccatcaacggcttgatcgtggaacccggcgaatttcgaagttgtgttgcgtagttaaaccctaagaaggtatgctcaccgcgattaccaacgaccgccctgacaccgcctgttttcggatcaagcacgatggaagccccttgaacctgcttaccatctgcggcatttgccggaaacgcccagtcttgagcaaagctgttttgaaggttgcgttgataagtttgatccaaattagtataaattttataacctttgttcaaaatatcatcgacactaataccttcactgcgcgcctcttcaatgacggagtcaaaataagacggatatttttgactgttggccgttgaaaaagtatcgataacctgcactgactgcgcttttgccgcattggcctgcgcctgcgtgagcttcttattgtccaccatcaattgcaaaacgacattgcggcgcgacaaagcattgtccatgtgatcagcggggttatagtagctaggattccgtaacatccccgccagaattgccccttcactcgcatcaagctggctggcatctttgccaaaataccgcttagcagcatcttgaaccccccagaccccattgccaaagtaagcattattgaggtacatcgcaagaatgtcttgtttggagtaaactttattcaactgaatggccataaataattcttgggccttgcgcatcaccgtctgtttttgcgtcagcaaggtattcttcgccaattgttgggtaatcgtactaccaccacccatgatttggccatggtgaatgacataattcaaagcagagcgaaaaatccctttgattgaaaaaccgccattggtataaaacgtacggtcttccgttgagataacggcattttgtacttgcggactaatcgcctttaactcgacgtaggtccctttttggccgtacagtgtgccggcttcttcgttgttagcgtcataaatgacggtttttgtttgtaaggtactcttgatgttttcaacatcggcggttttggctttataagtaaaccaagcagagaacccgagcatgactgtcagaccaattaaaatcagccaacgaatcacctgaaaccggcggaaaaaccaccgtgttccctgccaaattcgtgataagaactgcatttccgtcctcctaatgtgaatcttgtttattgtagcataggcgacaaccgccaaaatttcatcgacatctttttaagcaaactttatggtcaaatgaatgaggaaatcacttgttgtttcaaacttctgcacgtgccacgctgcccgccagccttcgcgatcaacttcaagcatggttgataccacgtaaacggcaacaccaattgcgcgttgccaaaacaattttagttaatggtcattatcgtaattttaatgaaaaagtacagcctagtgatgttatcacgatgacttatgatgaacccacgccacttgcctacgttccggaaacgccggccctcacaattcattatgaagatgatgatctactcattgtcgataagccggctggtatgaaaactcacccaaacttaccaggcgaaaccggtaccttaatgaaccaggcagccgcttatctggccccttttccggcgttaattacccatcggctagatatggcgaccagtggtttattggtcatcgcgaagaaccctttaacgcaagccatcattaaccgacagttggctcttaaagccatgcatcgggattatatagcgttagtaccgcagggaattgcggccagtggcaccataacggctccaattgggcatgatcctgatgatcagcgtaaacgcatgattagaccggacggagcatcggccattactcattttcgccggatcgcagaaacgtcaacaactgcgacggttgcgctcagacttgaaaccggccgcacccatcaaattcgcgtacatttagctagcattggctatccaatcctaggtgatccgctttatgcccctgatcagacaacctatcagcgcatgtatctgcacgcctttcaggttcgcttcacaaagccgctatcagacacaacgttgacggtgaccagtcccctgcctttttgaacaattttgagccaaagtaatggcacataccatggcaagcagcgggccactaattgtgtgacaacgaaaagagctgggtttgacaaggttgaccttgttgcccagctcttttgcttgtgatgttgctagatgcttacgaattgaaggcttgccgataagccgcttcaaaccattttgcctgcttctcatccgggctaatcacgacaatcgtgtcatgaccagcgatagtgccgacaacttgctcaaaaccgatgtcatcaataatcgctgccaataaattaccgttgctcggtaacgttttgatcacgttcatgaaatgtacccgggtaatcgacagcccgacttcacgaattgagcggcctaaccgttctaactgggactctgaagagccgcgaaaaatggtataacgtaacgtcccggttgcgtcttgcgatttgacgatcttcatctcgcgaatgtcgcgcgaaatcgtggcttgcgtcgcatcaataccagccgcttttaatgctgccaataactcttcctgcgtggcgattggcttttgattaatgattcgtgttaaggccgcttggcgttcacttttattcatcacatggcctccaccattattgttgcgcgggagtcagtccaggagacatcggcgtgtaagcggccttagacgtgatggccgtactttgaccattgtgaccaaagtccttatgcgtaggtgtctagactaacgagcgcgttatcgtcactgccggttgctgacgcgcaaggttacatttcttctggcgcaccgacgcccaacagttgcagcgcatttgttagtacttgtgtcgtcgccttaaccatcgccaatcgagctggcagctcactgtcctcaaccagcactttgacattggcataatacttattgaaagcttttgccaagcgtagtgcatacttagcaatcacagaaggttcatattccttggctgcacgcaagaccatgcttggataatcgccaagggcgcgcaaaacgtcccaagccgctggatcacttaaagccacttcaggcgccggatcaatcgcagccttccgcaaaatgctattagcccgcgcgttcgtgtactgtacatatggaccagtttcaccttcaaaacgcacgacttcttctaagttgaagtcgaagttgtctaagcgttcgttcttcaagtcatggaaaatgacggcgccgacaccgacttcatgcgcaactttatccgcatttggtaaatcgggatgcttttcagcaatttgttgtttcgccagaccgacagcatcgcgcaaaacattttccagtaagataatgttgcctttacgcgttgacaacttcttgccattcgccgtaatcagcccaaatggaatatggtgaatatcattcgcccagtcgtaacccatttctaacaagacggcttttaactgctggaagtgttcgcgttgttcattaccaacaacgtacaggctttgaacaaaatgataatgttctttccggaaaatcgcagcagcgagatcacgcgtcatatacagcgttgcgccatctgacttcttgatcagcgctggattcaagttatacgcactcaaatccacaatttcggcaccttgactagttttcagcaaatgcttgtcttcaagccgcttcaccacatcagccattttgtcattataaaaggcttcgccattgtaagaatcaaagtcaacaccgagaattttgtaaattcgattgaactcagccagtgaaactgtgcggaaccagcgccaaagcgcaatggcttcttcatcgccatcttccagccgcttaaaccaagcacgggcctcatcgtccaactcgtgatttgcctcggccttctcatgaaattccacatagtaatgcaatagatttttgatcggatcggctttgacagcgtcctcggatccccacttcttgtacgccacaatcagtttaccaaattgtgtgccccagtcgccaaggtgattaattttaatcggtgtatacccgattttgctgagaatgttggctaaggcattgccaatcacggttgagcgtaagtgccccatggacattggtttagcaatgttcgggctgctcatgtcgatcggtacattcccgctgccgatattagcatcaccataatgctcgccagcttgtgcgatcactttcaacacatcgtgggcaaaactgattttatccagataaaagttaacatagccaccaacagccttcacttgttcaaatggggtcacatcaatttgaccgaccaaatcgctcgcaatcatctttggtgcgcgatgcatgatcttcgccaaggaaaaggttggaaaagtataatctcctaagtctgatgacttgggtgtttcaatcaaggacttgatcgcagccgcgtctaattgaccggcaagtgctggttcaagtgccttaacaacaagttctttaaaatccataacttcctcctaaaatgatgatgccacgaaaaaaggacccatctctccagttcgaagagacgagccctagcccgcggtaccactctgcttgacaatatgtccactcaaagcactgattctcaaaagcgcgccatcaggtccgacgtgatcgtttgcactatccgatctcactaagaaccgccaactgaccttatttcctctttctcacagaaccttatacagcggtcgacgagaatcgaactcgcgacaccagcttgggaagctggagttttaccactaaactacgaccgcaaatcaacggatataagtatatcacgagggctacattttgcaaaggtcatcaaaggcgactttttctatgaatttgatgagaaaaaatcttaaaaatgagtaccggaaattttctcgttaatgtttctcaccgtgctataatattagtaaagaaggagtggtcgagatggcaaaaacgggacgtcactattatttcgtggcgcgcaacgagaaaaccaaaacaggttatcacattagttttccaaatattcctaacgctgaggcagtcgggacaacatacgaagagaccgtttattattcatatcgggtcttggctgacttcctgagccatctgccaaaacaagaagcggaaattcgtgcctacacgctttccgatattccggatacggtttccagcaatgttttctattcattggtgagcgtcacgcctgactttgatccgcacaaaatggaaacacattttaccttgccacaaacaccgcctgccgatattcgacaaaaagcagctaaactggctggattagtgaccccaaatgataacttggttttgtaactaggtattcaacatgcaaacttttcgaatgttgttgttagttatttttcttgttggcgttgggttagctttgatcggcctagtaagttggttgattgccctattgcgacaccgcgaaacaaaaccgatgcggcgactgacttggctgagcggcggagtggcgcttgcggcgctgattgtcaacgcgtttacgtaaacaactttgatttaagcgataattcttaagtcatcatttcaagaagagcactgccagtgatgggagtgttttttgtttgggattgcacggaatggtcgtgcaatcaaatcgagaatgacaattgaacgctgttgcttcaaaaatgcgttcgctgccgcagaaaatggtgtgtaaggaccttggacgcaatgaccaaagcccggtcatcacgtccaaggccgcttacacgccggtttctaaacgcgtcagctcacgctctgaggcgttgactggtttctattgtgtttctatgcttaaataggaacagcaaataatgaaggagtgggcttatgactgacctgcaaacaagtattggcgactttcaatttgataatgtgttcatgaacgcaagcggtgtacgctgctacaccgaggaagacttagatgcgttggcgcaaagtgatgctgggacctttgtcactaaaagtgctacccaagcaaaacgccttggcaatcccagcccgcgctatgctcgactagaactcggctctatcaattcgatgggcttacctaacgagggtctcgattactatctcaactacgccttgaagtttcaggaaaagcatccaggtcaatggatttttctgtcagttgccggcttgacaatggaagaaaatctcgccatggcacacactatcgaagactccgattttaatggcttggtcgagtttaacctgagctgcccaaatgttccgggtaaaccccaaaccggttacgattttgaccgaaccaaggaagtgcttaccaacctcttcacgttctttaccaaaccagcaggcgttaaattgccaccttattttgacctcgcgcaattcgaccaaatggctgccatcttaaatcagttcccgttgcaatttgtgaattctattaacagtctcggcaacggcctcatgatcgatcccgaaactgacacagcgttaattaagccaaaaggcggctttggcggtattggcggcgcctatgcgaaaccaatcgcactagccaatgtccgtgccttttcacaacggctggacccgaagattcagcttatcggcactggtggtgtgaccaatggccgtgatgcctatgatctcatcctcgccggtgcgagtttggttcaagttggcaccttgcttcgagaagaaggaccggccgtattcacccgcctgagccgtgaacttcaggctgtcatgcagaccaagggatataccaaccttggcgactttaaaggacaattgaaaacccaatgacgaacgaaaaaatgaaggtttgggcatactttaaacacaacgccggcgactttagccgacattggggcgcgtatatcatgctcatcagcgtcaccaatctatttattgggttagctgtgatcccgttttttaattttgctgctcagcaaacattgcgaattggtcacgtgccttacattaccttgacgaacctcggacaaattctgactcatgatcccggagttgctgcagttctcaccttgttggggctgctactactgttattcgtttactggcagttcaccttcttgattctaggcattcaaaacattcatcggcaaactcgcttaagcttctttcaattagcaatcgcgactttgaaaaaaacccgccgcctaacaccgacaaccatcgctgtcttaatcgcttactttgttttaatctttccattttcaagcgttgttttcaaaacaagcttgctggccaaattaaccattcccgatttcatcgtcgattttatttttgcccgatggtatctcggcctactggtcatagcgctttacatgatgggtacctggctcgccgtccgcttgttgccattattacctgctttaattttgagcgaaacccctcctcgaaaagcggttgccaaaacttggcggatgacgcgcggccaaacttggcgcacattgttagtagtcttgttaatcttcataccggtagctgttctgaccactttgctgaccattggcctatatttacttcagtcatacttagacagtcactgggaacattgggccttacttggagccaccatcaaccttggtgtgttgcaagtggttatgttgctattaacagtgttctttaccgttatgctttatcaattgggaacctcgcaggcagagacatttcagctcattcccaaccaagacttgattgcccgagtcccaaaacgtcggcgcaatcttcttttccgaattggcgccgttggtttaattgcgttagtcatcggtggcagcagtcttttctactacgcttatctgactggtgcactggcaagtcagccgttaactatctcacaccgcggggttgatgatggtaacggagtccaaaatacaatcccagcgttacaagccaccgctaaagaaaaaccggattatgttgagatggatttgcacgaaaccaaagaccatcaatttgtcgtcatgcatgacgagaacctgaaagatctaaccggtgtcgatgccaaaccacatcagctgactttatcagagatgaccaaactgacagctcgcgagaatggacataccgccaaagtcgctagttttgaccagtatttggcggctgcggaacgactgcatcaaaagttattgatcgaaattaagaccacacctgaagacagcccgcaaatgatgaatcattttattcaactatacgggcaacgacttctagccgatcatgatcagttgcattcgctcgattatcaagttgtcacaaccatgcgcaaacaagtgccaaagttgaaaacttttttcattttgccgtatacgctcgtctttcctgaaacaccagctagtggttacacacttgaaacaaccacgttagccatgcgggtgattgacgaagcgcataatcgtgatcaaaaagtctatgcttggactgtcaatgacagcgatgatatggaaaaagtagctttcatggatgcggatgggattatcacagatcaattgggtgaattaaaaacaacactatatcaaatgaaccaccatccaagttatgctgatcagattttgcaatatctgacgagcttttctgatgatgctgaaaactagttatctacaaataaaggcgacggatttacaattcaagtgcaacaaattagtcaaatagaaaagactcatagtcaagcagtgagcaagcctctttctaggtggtaactttattattgcaatctaggttgcggttccattctactagatttgacagatgattgcgatatgcagagcgcgaacaggctcctgcgcctgagagcgcgtttatggcagagcataagcaggcccggtttctgggtctgcgaacgcgttttctacgagaagtcaaaacacagaagtatcattcaattcaatttctgagactgacagtaaagatctagggaaagctcttcacagcctccccgtgttcataacagcaattatctgctaaaataacttagtagtatttgtgaaaggacctgatgttgtggtggatgcgccgcgtacgcttgaaggaattaccatgatgcatgatgaacctttgagtcattatacgtttacgaaaaccgggggaccggctgatttattggcgtttcccaaaaatgtggccgaagtgcgggcattagttgatgacgctcgtgaccagggcttgcttttgacggtgattggaaatgccagcaatttaattgtccgggatggtggcattcgcggactggtgttgattttaaccgaaatgaaaaccatcacggccagtggcaatcaagtgacagctgaggcgggggcacggttgattgatacaactgaagcagcttaccgagcaggtttgactggtcttgagtttgctgctggcattcctggcagtgttggcggcgctgttttcatgaacgctggcgcttacgatggtgaagtctgcaacgtcatcagcagtgttgacgttttgacgcgagaaggcgaattaaagacgtatgatcaccgtgaactgaaattccgttatcggcacagtgttgttcaggatacaggtgatgtcgtcttaagcgctacctttacgctcaaagcgggtgacaaaccagtcattcgagcaaaaatggatgagttgaatgcgcgtcgggcggctaaacaaccacttgaatatccttcttgcgggtcggtctttaaacggccaaaggggcattttgttggcccaatgatccaaaaagctggtctgcaaggtcatattatcggtggggcacaggtgtcaaagaaacatgctggcttcatcatcaacctcggcgatgcaaccgcaacggattacctagacatgattcatcttatacaaaaaacagtgaaagctaaatttgatgttgatctggaaaccgaggttcgaattatcggtgaacctggtcaaccaaaatagaccttagaaaggggcgacacaatgcatttagtcgaagccgttttgttcttgatggcacttgtcatcgtctcaaacgtgctcagtcactacattgtggctgtcccggtctccttgattcaagtcgcgctgggattaggcgcggctttgttttttcatttggagatcaatttagcgacagactggttcatgctgttgttcattgctccgctgctattttatgacgggcgtaattttccgcggcgcgagttgtgggaactgcgtggtccgattatcggaaacgcgatttttctggtatttgtcacgatgctggtcggtgggtatctgattcactttttgattccgccaatgccgttgcccgcaagttttgccttggcagcgattctcagcccgactgatccgattgcggtgcagagtctagctaagcgagttcatctaccaaaaggtgtgctgcatctggtgagcggcgagagcttgatcaacgatgctagcgggctgatcggctttaaatatggcattgcggcgaccatgacaggtacatttgtccttggcaacgccgttcgggatttcttttatgtggcaattgtcggtgccttggctggactggtgttaatcagtttaatcaacctaagtcgcaaatggctgctgcagcaagggattaacgatgtcattttgcatactatcttgcaggtgctaacacctttcttcatctatctcgtggtggacgagttcatgcatgcgtcgggtgtcattgcagtcgttgtggcggggttgcttagtaatactcgctacaaccgttacattgctgccttgccagaacttagaattgtttctgaacgtacttgggacattattgtctatacacttaacgggattatttttctcattctcggcattgaattgccggttgcgatgaccgacacgattgctgatcatgaggtcagcacgtttcaggcgctcggctttgtggttgtcgtttacctgggcattttaattgttcgaacgctatggatttacggttacatgctgctggcaaaacgttccaaagaaggcaaagcttcatggcgagcagctcttttgagtggtatttctggcgtgcgcggcgcgattacattagtcggggtgcttgccgtcccagcagctttgagcaacggtgatgcatttccggagcgtagtttaatgttgttcatcgcggctggtgtggtggtgctaagtttaatcgtcgccattatcgctttgccgttagttacccgttcagtggcaccactgcaaacgcgtggatccacgattgtaactgacgacagtggcgatcaagatgatgatgacagcaacgatattcgtatcatttcgctgagtcaggcacaaacctttgtctttcaaatggcggttcgccgagttgagtcggagcgccgtgagacgaatcaaaaagccgctttggacttgattgcggaatatcagtacctgattcgccggttagaactcgctgaagataccggtgctgccattccgccgctcattcaggatgaactggatctgcgaaaagtcggggttcaaggcgagctatatgctttagacgatctatggcgcgacaacaaaattatgtccaaaagttacgctaaagcccgcaaacaattgcaacaccgcctgaatgatctggactcaatggccaaacgctccggccgaccaactttccgcatgttgttcgaacgttccgccttacgcttatcgcattggtggtacaccgtggccagcgagcaaaatcgttcgcaccgattcttcaacgagcgcttatttattgaaaaagaaaccgcaaaaggcggacttaaatatttatcgcagtttttacgacaaaaggagaacaaagcccacaattataaccgacaagttatttatgctttgattgtccaatatcgaaatcgaattgcttcggtgaaggctttgaacacgcacaaatcaactcaatatgagcaggaactcgggcgcttgcgcgctattgcgtttgcagctgaacgggccgctatccacgatctgacagaaaaagggtatatcacgatgacgatggcgcaaaaactgaatcaaaatgttaatttcactgaaaatgcggctaccttaacgtcacttgaagaggtttaagggccgctgcggacaagtcatgcctgttccaaaagagcgtttggttgggttgaatcagttgatttttgctttttaaaacagacgttaattgacaacggtatcgtccttgtctcgattgagactgggccggtaccgtttttttgatgtccatgacatacgtatttgtcggcgctttgtgaggattcggcgaaacttttttgacgaattacaaatcaaatacttgcgttgttggttggcactcgtataataggcagagttagtaaacttaaagtttagtttaacgaaacccacaaaggcggtgtcttatggagattggcagtcgaattcgagacttgcgaatccggaaaaacttgacccaagaagagttaggcgagcgaacggatctcacaaagggctatatttcgcaggtggagcatgaccagagttcaccgtcacttgagactttttttgatattttgagtgttttgggtgaatctccggctgatttttttcgtgaggaaccaaaagattccttggtttatcacgaggatgatcaagtcacatatttggatgaagaaaaagggtaccgcttgaaatggctggtgcctgaaagcaatgaaaatgaaatggaaccggtcatgatcgattttgccgcgcacggcatttttaaaacgttcgagccttcaccggcagaaacctttgtttacgttgttagtggtcgtgtcaaattactactgggtgaacaaacttatgttgcaaagaaaggcgagacaatttactttcacgcaaccaagcaacatcaattggtcaacgccgcgacgggtcgtagtaagtgcttgctagtcgcgacggcatcttatttataaggagttggggtcattgagcaacattatcgttgaactgaagcatgttggtaagcggtacggcgacacgcaggtgctgaaggatatcaacattgaaatcgaacaaggcaagttttacacgttgttggggccatccggatcgggtaaaacaacgattttgcgtgcaattgcggggtttttggatgtctcagaaggtgaagtgctgtttgatggcaagcggatcaatgatgtgcctgccaaccagcgcaaggttaatacggttttccaagactatgccctattcccgcacctaaacgtttttgacaatgttgcattcgggttgcggttgcatcggatgagcaagcaggacattcagacaaaggttgaagatgccttaaaaatggttcgattacaaggttatgctgatcgggaaatttccgaattatccggtggtcaacaacagcgagttgccattgctcgagcgattgtactcgagccgcaagtattgctgctagatgaaccgttatcagcacttgacgccaaattgcgtaaggatatgcaatatgaattgcgcgaattgcaggaacggttggggatcactttcctatttgtgacacacgaccaagaagaagcgttggccttgtcggacgaaatttttgtcatgaacgatggtgaagtgcaacaaagtggtacgccagttgatatttatgatgagccggtcaatcattttgtggcggatttcattggtgaaagtaacatcattcaagggcacatgattaaggacttcttagttgagttcaatggcaaacggtttgaatgtgccgatgccggaatgcgtccaaatgaaccagttgaagttgttttgcgcccagaagatttggacattaccccagcaaattcaggcaaggtcaatgttgaagtagacacccaactgttccgcggtgactactacgaaattgtgggttacgacgatctcaagaatgaatggttgattcactcaaccaatcccgccaaagacggcgaaacggttggcttgacgtttgaccctgaggatatccatgtcatgcggcttaacgaatctgaagaagatttcgacgctcggctggaaacctacgaaggggaataacgtcagtaaggatcagttgggacagtgtcatcgaagcgttttgacgattagatagacactggtcggcgctgatcgattttcgaactgaggagggtcatcgtgaaaaaatccaccacaaacgccgcattctacacaccttatgtgatgtggctggcattatttgtgatcgcaccgatggttttaatcgtttatcaaagtttctttaacatcagcggtcactttacccttgccaattatcagacctattttcaatcaggcacttatattatgatgacgatcaattccgtctggtatgcgttcttgatcacgttagcaactttgttaatcagctatccaacagcatatttgctgcattatgccaagcataaacagttatggttgttgctgattattctaccgacttggattaacttgctgctgaaagcatacgccttcatcgggatcttcagtcaggatggcggggttaatagtttcttgggaatgtttggcatcgcgccccagcaattcctgttcacggattttagtttcatctttgttgctgcttatattgaaatcccgttcatgatcttgccgattttcaatgcaatcgaagaattaccggaaaaccttgtcaatgctgcccaagatttaggggccaaaagctggcagaccttcaccaaggtgatctggccgttgacaatttccggcgtgaaatccggggttcaagctgttttcattccaagtttgagtttattcatgttgacgcgtctgatcggcgggaaccgggtcattactttggggacagccattgaagagcattttctgacaacgatgaattggggcatgggttcgacgatcggggttgtcctgatcgtcgccatgttcatcatcatgttcctgaccggcgaacgtaagaagaagggggcgcggcgtcatgaagcgtaaattcaaatggtccaacctttatctgatcttcgtcttcatctgtttgtatgtgccgattttttatttggttatctactcgttttcaacgggagatcgcatgagcaattacagcggcttcacatggaaacattatgctgagctgtttgccgacacccggatgattcaaattgttctggatacgttgctagtcgcgctattatccagtttgatcgctacgattatcggtgcgttaggagcattagcaattgatcgtactagtcgacctgttgttaaaaacacggtcttatccctcaacaacattctcatggtgagtccagatgtcattatcggtgctagttttctgatcttctatactgcgttgaaagtgccattgggtttctggtccgtcttgatgagccatattgccttttctatcccgattgtcgtgttgatgatcttaccgcggcttcaggaaatgagccattctttactagatgctgctcgtgatttaggcgcgtccaactatcaagttttaacgcgcgtgatcgtgccttatattacgcctggtattttttccggctttttcatggcctttacgtattcactagatgattttgccgtgaccttctttgtcactggtaatggttttgaaacactggcagtcgaaatatacgctcgcgcacgacaaggcatcagtttggagatcaatgcgttgtcaggcgtcatgtttatctttgctttactgctggtagtcggttactacttcattcaacaagcaggtcaaaatcggcgagccaaacaaaaacacaagcgagaaagcgaggcgttgatcaatgaaacgactcattagtattgcgattgccatcttagctgtttgtctcggattagcagtttggagtgaagggttacaaaaatcgcaaggtgacacaggtgaaaacacgttaaaccttttcaactggggcgattacatcgatccggcgctgatcagcaagtttgaaaaacaaactggctatcatgttaatcaagaaacctttgattcaaatgaagccatgttcaccaagattcaacaaggtggtacaagctacgatttgacagtaccatctgactacatgatcgaaaaaatgaaaaaggccaatctgttgctaccgctcgataaaagtaaattacgcgggatgcaaaacatggacccgcgtttaatcgataaagattttgatcgcaacaataaatacagcattccgtatttctggggaacgctggggattatttacaacgataagtttgtcaaagccagtgaagttcaacactgggatcaactatggaacccgaaattcaaagattcaatcatgttgattgattcggcccgcgacgtgtttgcaccggcgctcatttcgatgggcaagtcggttaatgaaaccaacccgcaaaccttagcgctcgccaaggcaaaacttgatcagctgtcgcctaatgtgaaagctgttgttgctgatgaaatcaaaatgtacatggccgagaacgaggctaagattgccgttgactggtcaggtgaagccagtgagatgttggccaacaataaacatctgcactatgttgtcccgcgcgaaggcagcaatctctggtttgacaacttggtcatccctaagacggctaagcattttaaggccatctatgcctttctaaacttcatgatggaacccaaaaacgcggcccaaaatgccgaatatgtcggttatgcaacaccaaatgcagccgccaagaagctcctaccaaagagtgtgcaaaatgatcgccaattttatccagatgatgaaacaatgaaacatttggagatttattctgatctgccaccggctaaggttgggctttataatgatcttttcttggaattcaaaatgtatcgccgatgataaagatcatcacgcacagtccactatggtcagctaaaagtctgacattctgggctttttttatttatatttttcgtacttattagcatggaagctcatcaaaatgtggtacattttgtgggtacattttttgtacccacattaattagctgattctttgtcattgcctttgtctgtctcttttgagatggtttctgtaaagtttttgaagacctttaatgatgactgctcagttgcccttgtgtagtcgaaagtcatctgcatgttcttgtgcccaagatagtgcatgacttctgcctgaggagtattggcagcaattgcttgtgtagcaaaatagtgtcgaagcatgtgcggtctgattttcagacccgtagcgtcgttgactgctgacatgcgttcgacaagataagcataagaggcagcattaccatagcggtttacccaaagccattgcgtggcggttgctgggacacaattgcgtttacgaatatttttgcttgccaagatagcataatgaagcaaatccacaacgtcaccagaagcccagatggtacgatttgaagttgatgtttttagaggaccgccagtaggataatcgacccctcgttgcatatctatcttaatagcagcgatttcagtattattgacttggtcacgagcaaacttaattgaagatactctcagtcctagaatttccccacggcgcatgccaagggtagctgccttaatcaaagcataatcgtatttatttaatattttttcagcagttgtaatccatctttcaaaatcttctcgacttaagtcaaccggttttgcttgatggccatgtatctcgactcgtttcaacctatttttgtcaagaacgtcttcagtcacagccgcgttaacagtttccatcataatgcgatgaatgctcctaatggtggtgacgcccatgtgtttctcatcgtctaaatgatcaataaacgcttgatattgggcacgggtaatctcttgcatacgcttatttccgaataccggtcgaatgtgattgttaaagtaacggacatgagcatcataagttgattgccgccatgctttgtatttaagtttacgggttgacaacttatcaaaataattaccaagtgttgttgccgcattgctcaatgtcttaagattgccattaacgtaaccgtcttcgaactttttcaatattgattccgcatcacgccaactcatctttcctgatcgtgtgaattctcggcgttttccttcactatctgtatagacgcgccgaataccatatcgagtcccgcgtcgtgtttcatacctgtaaacattgggatggtgagggacttctttccatttacgcacagcgtccatatcctttctatgtgtagttttttggttaaaattcaaacgtatgttcgttctggcattaaaataaaaccccaaaatgggggtgaatccaattcatctttgctataattagatgaattatgtttacttgtaaccagatggtgctatttgaagccttcagcaactgttcattaaccgacattgcgcgacgcttccacgtggctgataagaccgtccagcggattattgatgaagaagcggcgaagtataactaccatcaaaagctatggctcccgaagcatctggcttttgatgagttcaaagctaccaacaaaatgagcttcatctggggtgatggcgatcgacaccagattggcgcaattctaccgagccggacggcatacgcaataacgaagtactttgaaggctttccactcagtgtccgccagcaagtgcagaccgtgtcgttagacctgaacgccggctatatcaacctagttccacgtttgtttccaaacgccaagatagttgtggatcggttccatatcgtccagatggtgtcgaccgccctcaacatggtccgtatccaagtaatgaagggtctatctaagcgtagcaaggaataccgattcatgaaacgcgagtggaaaatctttcttaaggacttcaacgaacttgaagcaataaaacccacgtatcacaccagcgtcggctattacgaaacaactgtaaatctggtcgccaagtgcttagacctgagcccggagttccgggcagcatatgaagtctaccaggagattataggagcggttagaaagcgtgatgcgtcagcactcgcagccgcactagagagctatcgatcattaggaaaccgaatggatcagtctatcaaaacgttaaagaagtacaagagacaagtcatcaatgcattacgctatgagtactcaaatggcttccttgagggtattaacggcatcatcaagaagattaagaacactgcgtacggctatacgaattggaacaatttcatcaatcgtatattcctggaacgggtttggttcagagctaagagcagcaaggcagcagcataataaaagcatctagaccaattaaggcctagatgcttcacaaaagatctatcaactctacttgacgctcgaagtcgcctaacaacatcagcgacaaagcccggtcgctgtgttgtttgcacagctgatccccatccggcctacgattgcttcgccttggcactgggatctttaaaaccccaataaatcatttatgagaaaataaaaaatgaacaacttccaattgcgaaaattgttcattcttatttgacgcttatgaatgatgtcctaaccttagtttggaaaattctacacgagcaaaattgttgcattgttgagcatatgcaacccaatcgaataacgcatgtttcttgttcgcaagtatgtccaagcaaggacgccgccaagcgcggcatagatgaagaagttataatccacttttccggccacatgtgcaaagccgaagactgcggcactgattagcacactcacccattgccaggatcgctgcttcaaagagccgaaactgttcatcaagaaaccccgaaatagatactcctcaacgattgggccaccaacaactgctaataacttgattgaccacggatagtttttaactaaatcaagcaggttactttggttggcagcttgaggcgcgtgcatgacttgcgtgagcgtcacgttgataagctgaatcaaaaatagcaattcgataccttgccagatcacgctagaaggatgagccaccgccagcgcaggttgttggcggtaaaaatgtcgatagcagaccatcaatgcagcaatcagtgcaccgaatacaaagaccaaggcaccaatggccccataggcaccccacgtggcctcactgcggatcaacgcaagttcggcagacgaataggcgataaaacctgcagcaacgccaacaagttggacaaatgagcgaagaattttcatgaaggcaatcctttcttggcatgtttgtctttaagggtaacattttagaagccagggtgcatggtgaaacatagccgtgaagaggcgtgtcatgcttagaaagtgaagcataaggtcccaccataacgcgcgaatcatcccaaaaacctacgcataaggagcttagtcgtaatgatcaaagcccgacctcacgtccaagaccacatactttccggtttctaaccgggttggttcgtgctcacaaaaaaacctgacagatttaatatctgtcaggcgcggtactatcagccgtctatcggattcgaaccgacgacctcatccttaccatggatgcgctctaccgactgagctaagacggcaaatggctgtgttgtttaaaaacaactgcctaattaatgtacactaaatccccatagctcgcaagtcctttttataaaaatgtagcgtagaaagcaaaaaaatgcgcattgccacagctgttttaactggccatgctgtcctttcataaaagagccgccttgccttaacgtctaccgtgccactcggccttgaactcggttagaaaatcttccataacctgttggcgatgcatcgccatttttttggccgcatcggtgttcaattgatctttgagtttcaacagtttttcataaaagtgattgatgacggtgccttctgttgtacgatactgagccgcggttaagtcagctcgtggtggtaaatctggatcatacatccgcccaccatgtgcaccgccatacataaaagcacgaccaatgccaatggcaccaatggcatcaagacgatcggcatcctgaaccagttgtccttccaccggcaacgattgatggtgttgtaagtttgctttaaacgacatgtgatcgataatcgtcaataccatttggacttggtcagcgcgcatgccagcgtcgaccattgcctgctgggcggcggctttggctattgacacatctggaaccaatttatcgtcataggtatcatgcatcgtggccaccgccaacacaacggctgtatcagcctctggtgtttgcgcagctagttgttttgctgtcgccacaacccgctgaatatggtcaaacccgtggccactgtgatcttgctcagataccttttttgcaaaggctgtcagctcttgccattcgatcatgaatcgttgctccttttcattgtccaccattcagtcacctgctatgtgattttgttaacaaattgagcttttttctgccgtatttattgcgtcaatcaacctcaatccttcatactaaaagtatacagaggttatgaaaaaaagggggagcacttttatgaaaaagcaatatttggcagccagtcagtcggtgaatcaattcaaccgactcttttcaccggtttcaacatcggagattccattgaatcaacaaaacctgcttttctggatggcgaccgatgccacgccaagaacaccaacgagcttggccaaagagatgcacgtcactaaggctgcgatcaccaaagccagcagcccgttgattgaccggggtttgcttgaaaaacaacccgatcctgaagattgtcgcagcttcaagctcgtgcttagcgaagaaggtgagcaagcaattgaggagctcgggcctgaatacttgggcaacttagaacgtctctatcatgaacttggcgagaaaaagtatctgaagttgatcaaacttctcagccaagcaactggcaccttggtcaccgaataaaccggtcatctcgtggcacaaacacctcatggagatcaccacaatcaagcctgacgctcagttgcgtgaggctttttcagttgactgggcgacacaattttgtcgccgactgttgccgtttttctaggagcgttacaatgacaatatcaggacgtagctagcccgattttgtcagtagccggctatgtctatctttttaaaggagtggtttgatggcaattcccgatcatatcagtgttcgcggcgcttacgttaacaacttgaagcatctcaatgttgatattccgcttaacaaactggtggcgatcactggtcggtctggttccggtaaaagttcattagccatgggcgtgttatacgctgaaggtatgcgccgctaaatgagtgctttgtccacctacacccgccggcgccttggccaaacaagtcctgctgctgctgactcagtacgccacattcctagtgctatcgctttgcggcagcggccaaccgttccaggcatccgctcaactgtcggtacggccacagaagcgctcaacgtcattcgcctcatgttttcccgtctcggctcgccggtttgtcctaatggtcaccgcgtgtcgccaactctcgatattgccaaggcaatggatctgcccaatgacggtgaaagtggtatgggcatgatcacttgtccgacctgtggcgtccgtttcatggcttttgctgctgaagatttcgccttcaattcaactggcgcctgcccgacatgcggcggtactggtcaagcgcgcacactggccgccaaccggctcatccctgatcaaacactgacaatccgtcaaggtgccgtggcctcgtggcgcttgcccggtcgcaattttatgccttttgtcgcacaagcaatcggcattgatattgatacgcctttccaggacctgccaaaagatcagcaagaacaggtttggcacggtgaacgtaaaaaatacgccatcaatatccccagcaaaaccggcaaaatttttcatatggaccatgcacagtacgagaatgccttcaatgcggtcgaagattctttagcgacgaccaaaaatgaacgcgccattcagcggctgaatcgcttctatgagtttggtatctgcccgacctgccacggcagccgatttgccccgaaattattgagccagcacctagtggatcaaaacattgctcaggttagtgatatgactttaacgcaattagccgcgttcattcccgaaatctatcactggttgccagaagatatgcagtcactggcgcacgatattatccaagaactgacgcaattgcttaagcccatcatggaccttggcctcagttacctgaccctgagtcgagccgcggcttccttatcgactggtgaattgcaacgtattcagctcagtcgcacgcttcggactgaaacgaccggcgtactttacgtccttgatgaaccgtccatcggtctgcatgctacaaacgtttctggattgctagaagtcatgcacggtttggtcaatcaaggcaactcgctggtcgttgtggatcacaacaccgccatcattgaggcagccgatcaagtgattgagattggtcccggtgcaggcgttgctggcggccgactcattgatcaaggtagccctgaagcgatcagtcatgatacccattcgttgattgcaccctttttaaccggagcggctcccttgattgttcgcccgcaagctggtgaacaagaaattaagcaaaccaaacaactgcaattaaccgtaactgatcgatttaaccttcatgacctgcatgtccattttccagttaactgcttctcagtggtatccggcttttctggtgctggcaagtcaactttgatttttgacgccctagtaccagcgctgtcagcaactgctgaccaaccagctccagcattcgttcgtgatcttgaccgcggcggcctgcgccatgtagttgcgattgatgccacgccggtcggtaaaaatgtccgctcaaccgtcgccacctacacagacattctcgaccatctgcgacaccttttcgccagtttgcctgatgccaaagccaagcactatacgagtagccatttctcttacaacgtcaaagccggcgcgtgcccgacatgcggcggtaccggcgtcattaacttagatatccagtatctgcctgacatgcagcaaacttgcccgacttgtcacggccgccgctacaaccccgaggttctgaaaatcaaatggcagcagcacagcatcgccgacttgctagatctggacgtggactccgccttgaccgttctgaaagacgaaccggctattactcacacattgcaaaccctgcatgacatgggcctcggttatttgcatttaggtgaaagtactccgacgctgtctggcggtgaagcgcagcgcctgaagctagttgcccacatgggacgctcccaaaaagacacgttttttgtcttcgatgaaccatcggtaggtctacaccccttggatgttcaaaccttgatcgctgtttttcaacggttgctcaaaaccggtgcaacggttattgccatcgaacacgatctagacgtcatcgctaacgctgattatgtcttggatctcggaccaaaaggcggtgcagaaggtggccgcatcatggctgctggcacaccgcaagcaatcgccaaacaagggaaaggtgaaactgccccttacttggcggcccatctggcggcctttcacgttaagtaggcttgacaaaaaagagatgcctcggaaagtgataaccgagacatctcctttttcatacatcaactttaaacgttcaagatcgaatcaatgtggctgatttcttccgcactgaaggtcagattttcggttaccttcaggttgtcttccaaatgatcaaccgaggtggtcccgatgatgacactggtgacaactggatcacgtaacagccatgccaatgccatttgcgttaacgtctggccacggtcatgtgctacttcgtttaactcgttcagcttcttcacaaccgcgtctttcccatgggcaaaagtggcttggttggtcggatgaattttgaacgtatccggaataccattcagataccgatccgacaacaagccttctgaaagcggcccataagcaattaggccagcaccatcggcttgaagagccttcgttaggccagaagtttcagcctcacgattaaacatgttgtaactgaactgattcagcacaaatggcgtatgcagatctttaaacatcgcaatcgcatctttggtttgctgggtatcaaaattcgagatcccgatgtaaagcgccttgccatcacgcaccgtctgatcaagcgcattgacagtttcttctaaatcaaccgtatcatcaaagcgatgcgcgtaataaatgtcgacatagtcaagctgcatgcgtttgagtgaatcattcaagccttgaatgaccgctttgcgcgaagtcccaacgccatatgggcccggatgaatttcataccccaccttggtgctgatcaccaattcatctcgataagccttcaaatccgttgctaaaatttgaccaagcaaactctcgctgctgccaaaaccaggttcatgatcaccattaccatagtgattcgccacgtcaaaatgaaagacaccatgatcaaaagcgtctaaaataaccgaacggcgtgggccaaatggatcaagattgccataatgctgccacaagccaagtgaaattgccggtagcatcaaaccggtttccccggcatgacgaacaggcatcttgtcataacgatcagttgctgcataatacatgacttttccccctctacacgttcacgagtgcagaaacctgcatacaagcgccttgaacgtttatacgccagtttcgaccgcaccagctcacgctttgacttaaacgcgctcaccgacccaggaatcatgtatacaagccctgacgctatggtcaaaattcaaccatcgtattcaagccaatttgcatacggatttctaaccgggctgtctcacgctcataaaaacgtttaccatcttctatggtggcaaacgttggcccaacaagcaacttaaaaagtcaattttttaatataaaactacttatttttcaaaaaaatcgttcaaaaagttagctacaccatcatccacattggcatctgtcatatagcgggcagtctgcttaacctgtggcacagcattttccatcgccacactaataccagcatccttcagcatgccaagatcgttgagaccatcgccaaaggcaatcgtttgctccggaccgattcctgtgagcgtctgcaactccttgacggccgtggccttatcaatatgtttaggaatgagttcaaggttagtatgttcagaggctgaaacatgtaaaacatcctgtgtttctaacgctgccttccccttagccaatgcttccgaatcatgcgggccaaaaatgatcccattcgtaattgcaggtgcatgtgctaacaaatcatcaactgaaggtaaggctacaacgtcaatgctcaccgagctgggggcaaacttgcgtgcagctgcttcaatggcaggcggcactttacctgtgtaataaacggtatcatcgctgaaatacaaggcgttcaggcccaactgatcggtcacagtttcaaccgccgtaagtgccgcttgccccaaaacatgatgcacccgctcgccggaaaaatcgtagacagcaccattcgatgcaataatcgaagcttctggttcgaattgtttggccacaacctgcgctaaagcgtgcatgcgcccggtggcaacataaaaagaagcgccgctagcaacggcagctgcgatggccgctgccgttttgggcgtaacgtcatgatgattggcggttagtgtgccgtcaatatcactaataattaagtatcgcggcataaccgttcctttctaccctaaggacacaaatggcgaccgatcaccatcggtcgccttatttgttaaagtccttgcggtaatccgtcaatttgatcagcgtaccaatcgttccatggtgtttcaggtgcgccttgcgcattaaaagttaccttaacttgcttcaaaaggtccaacaagttaccggatcggttagtcagaagaccggctgtcaattcctcgcgagtcagtggttgattatcaagcaagtaatgattaatatctgctagattcccctgcgtatcaatttgggaaaaaacatcgagaccggcgcctaagaagcgatccaagtagaactttgcaaaagtttccaatgctgtatgttgtgctgtttcatttaattgatcaatcgttgtgttgcttgctgccataactattttcgtcctttctgctttattccattataaccacttttggttgtgttttggaaaacatcgtcccacaacgatcacaagtttcacataaacttacacgttgccgtcgaccaccattttatgagtgctcctggtcatattcattaatgaaaagatagtgtttgatgacatttttataggaaatcaaaaatgccataaaatattcgtcttttttgaaattttacgactttggtctcttgctattatggaacggttgttatagtatgccaaatatgttggggatccgtgaaaggctggagattttatggaaaaagaaaaattacatctcggtgacgcggttgtttgtcatgtcaaagaagatatggaagcaccttttaccggaaaaatagaaaaggtttatgagaactcggcgctgttgagcattaccgattatgctgataaagaccggcagaatgccgcagagctcaactttaagattgtcgcaaatttccacgcgatgactcagaacctcggcggcggcactgtcttggcgttcccgccagaaccagccgaagagccaaaaaaataaacgttccaatcacattgtctcacaatatcactggcatctcgtgccagtgagtggttgttattatttacttagggatcttcaactcaaacaaacaaagtcaaaccggtcgacaggacagcctgctgatcggctttttttagttgatacccaagacaaatttcatggtcattcatgaaaatcagcgtaaaatgagtcgcaaacaatctatcgcaagagcgcaagccagttaggctcgaagtcttatatgcaggtttctggcctgtaaacgcctttaagggagcgaccaacatgaacaagaaaccctatccagtccacgaaagtcttttgatcggcacactgctcacagcagctgctggcagttttgatgctttcacctatctcttacacggtgaggtattcgctggcctgcaaaccgggaacgtcatcttgttggatattcatctcggtcaggcgcaatggactaccgctgtccgttacatggtaccgatcttcgctttcatgttcggcaccatggccgcccgcgcactgcaactgcaggctggcaaaaaatcacgacctttaaccgaacaacggtggctcattcaatacgaactcactttgattcttatcgtgacattgtttggccactggctgcctgatctagccgccagtgctttggtttcactcatcgccgccgcgcagctacaggaatttcgccgtttaaaaggcggcccttttacttcactgatgatgaccggcaacctccgcaccgcggcgcaaagcctttatgatggcttcatccgcgggcagcaaaaaggccgcaaagacgcggctacaattaggacgattattttatcatttgctaccggtgttgccgtgacaggtattttaacgaccctgatcggaacttatgctttagtaggcgccgctttgtgcctcgtctggattgatatcattttttggcgtgatcaggttgagcttcactaagccacttaattagcggcttgacctgcatgcaagaaactaaggtcattgaaatccgtcacagtaaatcgatcattttcccacatcagtttcgtcacgctagcattgtctagcatttcgcgaccatcaatgttgtagtgaacataattcaaccacatgagcgccgctgtcccgtgtgagacgaccaatactcgctcccagtctttggcgactgcctctacagcaatcgcacgcaaagttcgattcaagcgttcctgcaccatgcggttcgtttccgccttgttcgggtgctgatccatattcgccgtaaaagctgcatctgccgtctgggccaacgttatttcttgattggccaatgcatcgtgaaagttagcaatccccatggtcgctaaggaaaaatcatttgccagttgaccttcgaacttgccgtaattttcttcacgcaaccccatcaaggtcgtcaccggtatcggttcatccaaaccgctcaaaacaaaatgggcagtatctaccgcgcgggttaaatcgctggcaaaagccgcgtcaaagtgaatgtttttagtcttaaagccttgacccaaagctttagcgtccgcaatgccttttggcgtcagtgccgaatcggccatgccttgcactcgtttttgtacattgaattctgtttgcccatgacggacaagataaagcgttgtcatgtctagttgactcccataattttcatttttcctgcgacaaaggtttaagccagtttcaaataatctgccaaatagtttgccaccccatcatgctgattatcgttaggggtctgcgcatcggcgattgcaagaatcgcaggacgggcatttttcatcgcaacaccatgacccgcaaactgcaacatatcaagatcattcatgtcatcgccaaacgcaatgatatgcttttgatcgattccgtattggcccgccacgtaggcaagtgcccgtgacttgctggtattcttacttgtcacttcaagcgcagtgtattcaccactccaagcaccccacgttttggccgccaaatgcggatacaatgcgttgacttgttttgaaactggatcaaaagttttagccgtcataaacatcgtgaccgaaataggcggctgccgcaaaccttgctcatctaacagcgccttaggatgcggacgatctggcaaaaacggaatgttcgcgtatggtcgatcagccaccagcaactgtttaccttctgccaccataactttaaaggaaaagtcgcgttttagctgccgtaacgacagtgccaccggaatgggaatggttacctcttgctcataacgccagtgttggtgcgggatgtgaatcagcgcaccgttgaaattgatcatcgggccatgaagctgcaagtcgtcgtagaaatgttccgaaatcgaatccggacggccggttgtaatgacaacgagatgtcccgcggcttgtgcctcgcggaggacggcaatcgtgccagcgcttaattgtccatccgcattcaaagtcgtgccgtctagatccagtgcaataagatagcgttccatgcagcagcctcttttcaaaattttttcttagtgatgtgtctagccatctaaaacgcgttcccatacaatagatagcagttagaaagcgaggaaatcatggctgaatcaattgtactttatacagatggcggtaatcgcaatacaggaaatcaggcgggtggatcggttcgccccacggataaaagcgcgtgggccgcgttgctgatctacggagatcacgaaaaaatgctatctgacggcgactatggccgaacgaataattatatggaaattatggccgttattcaaggcttaaaagccctcaaacgcacagatattcccgtcgatgtttattccgactctgcttacgtcatcaacaccatgcagcaacgttggtgggtaaaatggcaacaaaacaattggcgcaaccatggcaaaccagttaaaaatgccgagctttggcaggccttgttgcaccaagtcaatcgctttgaaacgattacctttcacaaggtcaaaggccacgccaccaatcgcaataacaatcgcgtcgatgcggccttgaatcaaaccatggatcgacttgctgatcatgcttaactattttacccctgatgcccaagaaatgcttcaccataagtctcagctaagaaactatgaatcacctgctgcatgcgctgcacagaaggtgatttttttatggtcggattaatcacgagacacagcgtccgctcaaagggctcagaaaatggatacatattgacatcgccaactaacttctgcaccgctagtttcggcaaaatgcccatccccaaacctgattccaccatcgacagaatgctttggtcatcaatagaataattaattgcattgcttgacacatggtagcggtccaacgcatttttggtatctcgatcatagtcaatctgctgcaaaatgaagttctgcttatcgacatcggcctgtgtcactgtgcggccgtttttaggcttgaattgcttgggcgtgatgcagtagatgggatcctttaataacggctctaccacgacgcccgggccaactggtaaggaggaaaagccaatgtcggcagttcccagtcggaccgcctcaacgatccggttaaaagtgccttgcaccacgctaatttcaatgtgcggatagcgctttttgaagcgacggataattgttggcagccaattcgtcgaaaccgaagagaacgcaccaatgcggatacggccggtattaaccccattaatgttgtccgcaacctgagtcagctgctcctcgagattttggatgctttgaataatcggcagcacctgcgccccgtcttcagttagcgccactcccgttcgattacgaatcaagagtgggaaacccagttctgtttccagctgactgacactatgactcacggcactcggcgttacattcagctccgccgccgctttcgctaatgtgcctcgctccacaaccttgctaaaaacttcataagaaaagttagccatttgcccctccttgatgtgacaccaactgtcacttcgttgtgataaatccttttagactaggaataacagctgttcgttccttttaaggtgaataaaattcatcataaactgaaatagttgagctttactcaatcatacaagccgttttacactagtgtcaataagaaaacgttggtacttcaccaaagcatcaacgtcataaagacgtcggcacccgttttaatcgcaaacgtcaaagggggattcatcatgaaattcgcaacacgtactcaaaaaactggtcattcaggtttagaagatctatttgctgcttctggtccaaatgtcatttcatttgccggtggttatccagatcgcgatttattcccgacaaaacaacttaatcaggcatttagtcaaaactttacaagtggcgatagggaattgcttcaatatgccagcacagaaggttacgaaccattacgtgccaagattgcagctcgtctgcagacgactgggatgcaggtcgacgccgatgacatcatgatgacccaaggcgctcaacaaggcatcgatctagtggcgcggttaatgttggatccaggcgacggtttggttgttgaagccccaacttacttaggtgcacttgctgcttttaacgcctatcaacccacctattacgaagtaccgatgcaagctgatggcatggacatcaatgctttacaacgcattctaatgagtcgcaaagtcaagttcatctacaccgttcctgattttcaaaatcctactggggttgtgatgtccttggccaagcggcaggcaatcattcgcttcgccaaccagtatgatgtcatgattttggaagataatccgtatcgcgaccttcgttatactggcaaagccttgccgacgatcaagtcactcgacacagaaggacgcgttatctatcttggcagttttagtaaaattctttctccaagcctgcgcatgggctggttggtcgctgcgcccaatcttttaaaagagttgctggccttaaaaggcggcagtgatctggaatccagcaatctggtaatgcacgggatcaatacctatatggaaaataacgatcttgatgcacatatcagggaaattcaggattgctatcgtgagaaaaagaatgccatggtggcagcgatgaagcgctatttgccagaagaagcgcacttcactaatcctgacggcggcttctttatctggctcaccatgccagccggcttcgatatgggtgtgttcatgaaagaacacctattaccggaagccaatatctcctatgtgccatcaaccaatctatatgcgacagcggctttgtccaacggtgcccggttgaacttcactggtcctagtctggcgcaaattgataccggcatgaaagctttgggggcagcattaaaggttgctctgcaacacaatctggtagccgaacaagcctaggctataacgcgttcaaaaaaactcggttaaccttaacaaaatgacaacgtaacgatcacattttcgtcacactttgccggtagtattaacagcatagaagtgagccacccactcattcctaaaccccaacctaattttcatttttctcctccaaagaaaaatcggtgattggcccccatccgatcacccaataacaaaaacgcccgctgcaatggtagcgggcatttttgtgttttgaaggcaaaaaatcaccgcacgctttctcaaagtgtaaacggcgattaatcaaacatccatcagttgcttaaactaaccgatcaaccccgaagctggcagggtcatctttcttgtcggatttcttttcagtatcagtggtcgttgtcttttcggtctttttatcagcagatgcctgatcgtctttcttatcatcctgcttctcatcggcttcttcaggcttctttggcgcaacttgttcacgaatcttttcttcgatttccttagaaatttccagatgttcatccaagtagtgagatgcgttgacaagtccttggcccaaacgttccttgccatagttataccaagagccagacttggtgatgacgtcaatgtcattgtctttatcggttgccaagttaatcatatcggtattgtgttcaattccgtgaccaaatgacatcgtggtttcaaccgatttaaacggcggtgcgaccttattcttagtgactttcagtttgctagcgaagccgacaacatctttgccgtctttcacctgctgcccacgcttgacttcaatccgcacagacgcatagaatttcaaggcacgaccgcccggtgtcacttctgggttgccaaacatcacgccaactttttcacgcaattggttaatgaaaataaccagcgtattggtattattgatcgaaccggccatcttccgcagtgcctgcgacatcagccgggcttgcaagcccacatggctatccccgatggccccttcaatttcagccttgggaaccaaggctgcgacagagtcaatgacaacaatatcaacagccgctgattcaatcagcatttcagcaatttcaagcccctgttccccagagtttggctgagacaacagtaagtcgtcaatatttacgccaagttccgccgcatacttcgggtccatcgcattttcggcgtcaatgtaagccgccttgccgcctgatttctgcaattcggcaatagtctgcaacgcaatcgttgttttcccggtactttcaggaccataaacttcaacgattcggccacgcggtaacccgccgacaccgagtgcaagatccaaggataaaatgcctgttgagacgacatcaaccttcagttccggtcgatcgcccatcttcatgacggcaccttcaccaaaggctttcttgatcttctgaagggctttttctagttcggtatcgcgatctgtagcatcggatttagtattatcattctttgcggtcgttttcttagccatacttgtctccttaaatgcgctcactggcgcaaaagtctgtgtgtaagcaccttggtcacaatagctcaaccagaccacttatatcccagtctttaaccatgccagtgcacgctttgtcttctaaaaatgcgccagcagttccaaaaacctgtgcacgctattttaaacatatacatccgagtgtcaatttacgctgtctccattatcgaacatgcgtttgttttttgcaagcttttacgttaaaaaagtcatccccaaaaattgtttgcaggtgactgctttattttacctgatactgacacctttttggtaaaaatgacgcgttatttatggcacacaagcatggtatgatgaggcgattggcttgatacttcaaaaataggtaaacgaggaaaatgaaatgatgttcatgggttctattgtcaatgggttgacgattatcggtggcgggctcttaggcttgattctccacagtattagcgatcatgctaaagatactgtcaccaaaagtcttgggcttggtaccttcgcattgggcattcaaatggccttgcagacaaaaagttttattgttatggtcatcagcctttgccttggcggcttgatcggtgagtggttgcatattgaagatggcatgaaccacctcggtttgatgttggaacagcgctttgcccgcggcaatcagcatttcgcggaagggttcgtgaccgccaccctgattgctgtcatcggtgccatgggtattttaggcgcgattcaggcgggcgtttctggagacaataccacgctatatactaaatccgtcatggacgggttcatggcgattatgctgaccgcgtcactcggggttggcgtgatcttttccgcgttgccagtgatcatttatcaaggcacaatcacactcttcgccagttttttagtccaattcgttcccaaggcattgatgacgaacgcactccgcgaaattggtgcagtcggcggcttaatgatcttggggattgggttaaacttgatgggcattactaaaattcgtatttctaatctgctgcccggcttgctagtccttattgcgatcctaactggtcagtattttctatgattaatgattgaaccatttaggaggaggctattggcagatcataaactgaccggtttgaacggttgtggtgataaatcagagcagatttttaccaaaaaaacgaccccctgcttcactggcatgggtcgttttttttggtaaaagtgccgattatgattcagaacttcggaatgagccgctgcttttggcgatggaaacgatagtaaaccagtttgcaatgccaatcacgcacgacacccagcaagtgcgaattggcatcataataccagtagcgcagatcatcttttagatactgctgattcaaccatgcatgatcgtgccgcaagaaagtataactttcaagcatgtcctgctctcgccaaacatcaggtaataagaattggctacgggtaaaccgttttaaaaaccgatctgaataataaacccgctcaatgcgaccgacaaacaatgccgtctcgcctttacccacatatggcgccatgggcacaacaatcaaaccaccgcgtaaacgttcaaaccagtctgtttgctgactgacgttaatggcacgtgtgacatccttgggtaaccgaaaatccaatactaaaccatccgggcgtcgaacccgagcaacgatgtgtcgttttttcatatggtagattgcaaatttaatccgaatttttggacaaatttgtcagcataacctgtgtattggccttcctgaagatagttcttaaaagatactagacaggttctaatgaaatcgtcattggtggcgatgagcccgataatgctttaaaattgaagacgttatatcatgaatatgcgcatagtcagttacatgggttaaaatcagcctttaaagatcgcccgcgagcctatcaagaaacgcaagccgaagcggtcgcatatgttgccatgcaaaatattggcgttgataccagcaactactcactcggttacgtggccacctgggccaaagataaagccgtaatccatagcgctttaagtgagatccagcaagtgagcaacaaagtgattgagcttagcgatggcttaaccaaacaattaggcttacaagaagccccaaaagagcctgagcatgatctaaaaaagctatcagcccatgatcttaataagtcctatcaaggcttgcaacaacaagttcagcaagcaacgaatccacaacaaaaatcagaactacaaaataaattaaatgatgtacaccatgaaatcagtaatcgaacgcaaaaacaactgaaagcattttctgaacaaaacccggcaattaaacaaccagaacataatgcagctaaaacattgaaaagatagggggatttaacactatgaaaattgttcttttagatggatatgaactaaacaaagatttaaattggaaaagcttgcaagaattaggcgactgcactttatatgatcgtaccccagttaacgataacgctgaaatcataaaacgaattaaatatgctgatatcgtcattacacacaaaacaccgctagatcatgaagtgattagcaaaacatcacgattgaagtatatcggaatcatgggaaccggttatgatgtcgttgatattgagagcgcacaccagaacaaggttgtggtgactaacattcccacatatgcaagtgacgcagtggcacaatttactttctcgttattattagaagtgactagccaagttggattgcataatcagcttgttcatgaaaaccggtgggcacaggctcctgattttactttttgggaaaaaccgctattagaattaaaagggaaaactttaggaataatcggttatggccatattgcgcaaaaagttgctaaaataggacacgctttttctatgaaagttattttctataatcatcgtcctaaaaaggttcctgaatcatggattcagcaggtttcatttgatgaactattaaggcaatctgatgtgcttagtctgcatgtgatccaaacaccagaaacaattgatttaattaataatgatacgattgccaaaatgaaaactggggttattatattgaatacggcccgaggcaaattggctaatgaagcggacatcaagaatgccttgaatgaaggcaaaatttatgcctacgccactgatgttgttaaaggggagcccattgctagtgatagcccattattacaggccaaaaattgttatattaccccacatattgcttgggcaccatatgagacaagagaacggttgttgcatatgactgttgataatataaaagcatatttatcaggagatctgaaaaacgttatcaattaacggcaatggtctgtgaattcttttgcctccattatgtccgcccactagtgaagcccgcttgatagcggtgcctccctttaataaactggtcgcgtaaactagtttggtgaacccaaattgccggtgaatttcatcaatcacttggtttaaccggctatggcgaatttggttgcgcggggtttcaaataaattaagttgttggccggagttggcacttagtttactgctataaacaccaatattccggactgcttgaccgtcccagttctgacggaataaccacaataattgttgcgtcaaaacttgattgtcattagtcggtttaatttttaaagcttggtgaaagccaccgcggccatctgcttcggctgcggcataggaaaacccaatgcttagcgatagacaccccgccagtttatggtggtgccgaagccgcgccgccacctgttccccaacttctttaatgacggtttcaatttcgacttggttaaaataatctcgtggcaatacttgcgaattacccaggctagcttctaagatccccaggttttcaccaacgtcccagtggtgttttggctcaaagtcaaagtcgcggatcttaccgaccttgcggagttcaacagcaccctcctcggtcaggctgactggcactccatcgtgcgggatattcggcaagtgggccatcttgtcatgaagctgctcgtcattggcctcgatttgctggtcgagttccttaatcttatcaccaagctcccgggtctccttgatggctgcatcagcggattcaccattgcgcttagcttcaccaatctttttagaagcggcgttgcgttgagctttcatggtttcggtttgttgcaggagttcccgccgcttttggtcaagagtcaagacctcatcgatctcttcgcccatgcgattactaccgatgcatggcgtaacagcctagaccactatcaaaagaaaagagaattgtgatcaaatcagctttttcttgactaatggtagaaaaaaagccacctcataatgaagtggcaccccgcccgcactctgtcttgtaaaagtggtgcatttttggtgcattttctattcgctttggtgattctctatggagctgttaaagtttaaaaggttgatatatcagcgttcgaaggctggtatgaacttcagtgaatttcatagagttagcttaacagacttgaaccgtcgatctcctgcatgccatgcaggcgctctcccaactgagctaaagacccgccatgaaagctgatataaaatggatccaaacggacttgaaccgtcgacctcctacatgcgaagcaggcgctctcccaactgagctatggacccaaaacacaagattcattgtactgaacttccggtctgctgtaaagaggcatgcttgtgaatatcagagaagaaaagctgccgtgacggacatgcacaatgaatcgaaacgctttattccgaatagtcccggcgtgcgatgacggcagtaatgatgttttgcatgacaccgccaatgatgaaaatgagccaagagtatgcccatccgtggagtagaaagctgacaagaagatagatgataagcacggtcggccaatagacttggtgaaaaagtgctatatcttggcgtgctcgggtgttctgatgatgcttgtgtggctgttcccaataattagcggcatcgtcatcagtaccatggtaccaagcagttgagtttgccgcagttgtcgcgtaagcataacgttttagctgagaataattgatggagacatagatgatcaggtagctgcctaggccagcaattgctagaaatagcgctccgccagcattttcactgataaaaccaggaatgtaggcagaaatgatgggtgggatgagagagccgatgcagatcataataccagcaatcaacccggcggcaaattgacgggtgtattccccagtggtcttgttggctagctgtttggcactggctgtgatcggccggtcattaagctgctttttttgctggctgaagacggtgccgccccagatgaacagaccaactgcaagtgcagcaagcagaaacatgccaatcacaccgaatccttcccagcggcccccgcctgtgtaggcaggcaaggcgatactgatggcgcaaagcaaaacaccaagggcaatttgggtggcaaactgatcggccatgttccaaaagctgcgaagttcggtttcagtaatcgtgtcttcatcggcttcttcctcagcatcggtggggtccgactgtgttgttgtcgccgttgcttgtactggcattcccagatcagcacgtagctcgtcaattgagccaaatgcgctgatgacagcaccaatagcggcttcttcgcttttaccttcgcgcaacagatcacggtaataatcacgcatgttagcgagcatatcggctttggcttgtcgggttttgtcattatcaggtaaggaagcaaaaagactatctaggtaggtggtgatggtatccatgggcggttcctccaaggttaaagattcgttatcggctgttttaagaatggatcgacaacggttttgacacgttcccattcggctgctttaacagcaagaaaattacggccgcttggggtaatgcgataataagtgcggggcttgccattggtgacatcccctgggtaatcatcgatgtagccatttttgctaagtcggttaaagacggcgtaaagggttgtttctcgaatgaggtattgaccatctgtgcgctcacgaatttctttgccaattttatagccgtaggaatcgccttgctgtaaaatcgcaagaatgagcgcatcattatacccacgcatggcgtcactgctaatcacagcatgacctccctctatcgttatggattgatgcaaagcacgtttcaaagtgctttacatcagtactgcatctgttgaagtaatactagcacgattactctatcaggtaaagtaaaaaacaccctcatctaagatgaaggtgttgtcgaatagcggcttattagtagatgaaaactgtgatgaaagtcaccagcccgaacagaataccgggcatatttgagatgataatcggccagtctttgtatgttttagtccaaccatagaaggtccacaaagtggcattgatcatcgcaaccagtggttgaatcggattaaccggattctcggagaagttggcgatgatttcgggaatataagaaacatacattaaaatacaggtgaatgtcgcgactttactcaataacttgagtcgtttcactcgaacggggtcaaccccttcaggatactttccggtgtcaacgcgcattcataacgcctcctttttggataaaaataaccataacactaaattagtctaaacccaaggcatgtgtctgggtgtgatagaatcaagaaggcgacagaccgcggataagcggctctaaaaattttctgaaaacaagcagattaaggaggattacgatggcagaacaatcggagaacaccgtgacgcgaacacaaaagcaagaaggtgcggatgcgattatggataaggggtacgtcactgagcgggatattccggaaatgatgagcaaaacatggagcgaacaacttcttgatgctgttaatgatgagttgcgcttgcgcacggtgaccaatcgtaccgtgttacagcaatttcactattacatgggcaacggcacgatcatttatgatccgggtcagctgaactctgaaggtgccaagatcgccttacagcacgccttaggtttccgcaaataaagctaaactgcttgtgatggttatcggcagtttagcttttttgatggtcgtgagtggtattaagcaaacgggccagtcaaaacaaccttgcccacttcatggccaccttcaactagagcggtcgcagtcttaagggtgtcaaccgagatggtgtcaaaatgcttggtcactgatgccttgatttgatggtcctgatagagtgagactagacggctcagaatagcaccttgagaagccacgtgataatcaaagtcggttttggcaaacatgtactcataatcaaaactggcagctttatctttaacaacggccaaatccaaaccagtttgtgggccaacaatacagcctatgtggccaaaggcacgaatcagctgactggctgctgccaagtaaggttctggttgataaagcaacgtgataccgtcgactgtttgcaagccggcacgttggacttgggcaatcaaatcctgatggtaatccagcggtgttgcaacgccgtgatcaagcagccaaggatgattttttggactgctagttgctaggacggttaaaccgctccaacgagctaattgacaaagcatggagccaacgccgccagcaccgttgatgactaacaagtgttgtcctttattagcgttgaattcggggataaagcccattttttcgaagagtaattcccatgcggttaaaccgacaagtggcagcgcagcaagatcggcatctggggcatcagctggcgcggcagcgagtaagcgggcatcaactgcctgatattgctgattactgccgggacggcgtgttgttccggcatagatgacgcgatcaccgggcttgaagctggtgacattggcaccggtctgtgtaatcgtcccgactgcatcatagccttgaatttgcggtgtttgatgctttccagcaacttgtcggcgtttcgtatcaacaggattgacggagaccccggcaacagccacgatcacttcgcctggctggggctgcggcattggcagcttgaactgttgaagactgttgggtgccgtgattggcaacccttctgtaaagccaattgcaagattttgtgtcatcgaaatcgccctttctgtaaataaagacctactgtgattgtaaccttttttcacgaatagttggaagttccggttttttttggtaaaatgtgcaagatattgcaaggaacagtatggtgttggcacagttggcggttgatgaatctgcaggttatgaaccattgattgtcatactaccggttaccatgatgaagacagcgtgtgacgcggcagtgtttctaagtcgaagatcacatttaaggaggctgcatagtgaaaaaacttggtactaagcgcgaattgatcggtgttgtcattgtcttgctgttggcagcagtaggatttgcgctctttgcctggtatacgatgcggccaacagataccattggcacgattgccacgatttcttttggacttgttttgtcagcattgattggcattgtcctgattttagacacggcagcgaccacgcgctggcgccgattctgggtcgatctactttttgcggcattgatgttgaccctgattgattatttcttcttagataccacggcaccatggcagatgttggtggcaggagcagggggcgctctggcgattgtcgcattgctggccattagaaaaatcgatgagtaagttgctaaaagagtcagatgaatagggtataagcctagtgaaagtaaatgaaaactccctgaaaattttcagggagttttttgtcgatacttgctgatggtaacaacttgtggcaaatgatatttgttattgcttcgctagttcatgcgttggacagtcacaggcactgtttttggcaaaactttcgtgagttccgtcataaagttttgaagactagcttggaaagtcaggcgaaccatgcgccgtttgctaagagcgaaaacggcaacaacccattcctgaccattaggcaaactaaccggcgtcaacgtgatgctggacatgttcgcgtaaggaataacgcgcgccagaataccattcgcgattaagcgcgttggcgccaatccaccggtaccagccatgatcgacaaaaccaaaaagattgagatgaagacaatgtaaggcaaattgtcgacccgagtggtcataaaccaaaagcctaggaaaactgcccacatcagctgggtgacagcgtaacgagaagcaacttgaattttactttgccaataaagatagtaaccggcaagcgccatcaggatgacgtcaaggccgatcagaaaaacattaaaattattcatgaggaactcctttttgcttcgtgtcatctgtggcatgctcggcttcatagagcccggaaacctgttgataccaactgaagaagcgggtgaccacgatcttcaacacggcgaatcctggaatgccaagaataacgccgactaagccgaatagattacctgctgttaacaacacgacgacaatggtgatgggatgtaattcaagtttactccccatcacaagcggtgagatgacttgtgtttcgatgagccattcaatgaaaaagacgatgatgacagctaagatcattcgcggggaggttagggcacccatgatgagcggtggaatcatcgccaaggctgagccaaagtatgggatcaaattcagtgggcatgccaataagccgaagataaggccataacgtaaaccgatcactgaatagccgaccatgaacatcactgcaacgcataaggcaacggtgatttgaccttggacataagaaccgaccttttcattcatctcatgcaacatttgcttgactgatcggcgaagtttagttggcacgatatgaagtaccatcggcgtaaatttgtcgccgtcttttaacatgaagaaaagaatgattggcgctgttgaaatggtgatgacgacattaccaacaatgccaattaagttctgcagttgagaaattgtgccggttacgaaggcgccttgtttaccagtgaagaaactttgcacttctgctgcaatctcattgagatcatgctgtgagagaatattctgctggtcattcagattatccaaccatttgccaatttcatcaaagatttgcggcgctgaatggacaatactggtaatttgattgcttactgccggaatgaaacgtaacaatccccacgccaacaaaccgatcagcacaatgaataacaggccaattgcccagccacgatgaagtccgaatttttctaatcgattaataatcgggacagtaaggtagaagagaatgccggcaaagataaacggtggcgcgataatcccgagaaaatccagtactggctggaaaacccacgcaattttagtgaaaacgaaaatcacgagcaatgccagtaacaagtcaactagcaggatcataaacttgctattaagaaagcggcgatagagccacgattcggtatgtttcaagggggtaccctcctctacaattgtgatacctgttggatgtataagcttcatgacaataacaaacgatgagagtgactagccagatttgcggcagggccctgttcacgctcattaaaacgcgttcacaggcacagaaacctgcacataaggacctccaacctaaatgacccaagcccggccatttaggttggaggccacttatgctcctgtttctaaacgtgcctgttcacgctctgtaccattaatgatactcgactcatggtcatatttcgaggatagccgtgttaaaagcggattgatttgatgttaaaaaagattacataaaatttacaaacaacatggaataatcgttacaaatctttaaaaaacctaaataaaggcatcaaatgtaaattttatgtatacaaaggctttacaaaactcaaaaattgggtatgattagagtcacaatcaaaacggtgagtatatgtcggtttatccgatacggagaggagtgaccccacatgacaatcctacggggcgcaaaatggacattaattactctgaccctcgtggcaaccttgctgttattcagcaactttgcgacagccggcattttgttaatcgcgcttgatattttcttgagtttcttctacgcggtcatcaaaagcagatgtgatcggcgtcagatgcataagatgccattattgcataattaatttaaggatgaggtccacagatgctttttatctgtggacttttttgctatttaggcataaaatcattgcaaacgttcgttcgctttggtatgctttgtgtaatcaattagaactgaggcggtgagcggatgccaacacaagcaagtcagaaacgttggaaacaaattttacaatcaatctatgatgcaatcgaggatcatgggtacccgcccacggttcgcgaaatcggcaaatcagtcggtctaagttcgtcaagcacggtggcagcgtacttggagaaattgttggcggcgggacttattgctaaggatccagcgaagccgcggacgcttgaagtgacctcagccggacgtgacttcattggcgttcaggatcacggtattccgatcgtcggcacagttgctgcaggggtcccgattacggccatcgaaaatatcgatgattattttccggtaccagacgatcttccgtatgccgctgacgaattattcatgttgcgagttcaaggtaattcaatgatcaaaatcggcattttagatggtgaccagattattgtcaagaagcagaatgacgccgagaatgggcagattgttgttgcaatgactgaggaagatgaagccactgtcaagcgattttataaagaaaagaacggcattcggttacatcctgaaaatgacagtatggatgatatgtttttcccggatgtaacgattcttggcatcgttgtgagtttatatcggccggcattagtttaatcattagaagtggtgagtgactaggctggcaatttaaatccaattaaaaatgtatcatcaacaaaagagacatcagctgtgatcccacaaaatataggatcacagctgatgtctttttgctcagacactttattggttttgttgggcgaggcgatcgagatcgtcttgtggcacctttttataaacgggaccatcgggcaactgctttaagttaccggtttttgttaattgaaattgtatcgtattagcagaggcttgcggctgcgctttaccagtgaaggtgaagattcggcctttgagggtcaaatcagcagcaaaaataccactatcagtactttcaaagacaccatctcgattggctaatgtttcaagatagtagccgctggtggatgaggtgactcgaattgctttggtagcatcttttgtttggacgaacgcatggccaaccaatgtacctaaggtcactttcggaacagtttttttgaccgtgtgcgcttgtgatgttgcgctcgatgatgatgttgtctttttgggggttgaggtagtttgtgagcaacctgataagatcaagattgctgctagtagcagatagcgctttttcattcgacagcaactcctagtgaatgaactggatgcaagtcatcacgattgggatcacgatcatcgaaagcagcgttgtttcggtgaccatgatagcagcgtaatcggaatccgcatcgtatagtttggcaacaacgggcgcattggtcatgaccggcatgcaagattgcaaaataaagatttgtttcatcaaagttgggacaggggcgaaggcgacaagcgccgtcatgagtaacggtgcaaagaggaagcggccactgaaaatacccaaagcctctttgctgattcttaatttaccccagcctgcttgatgcaaagcaatgccaatgaagaacatggagccgggaacagttaaggcaccgatataagtcagatcggccatcaagaaagtcggcaatttgatttttaaaagcacaagcacaatccctaacataaaaccgagtaacggtggtgagaacactttcccaagtgcctttttcaaatcaaatttagctgggcgcgggccgtcaccttgaataaggtaaacgccgatggtccaaaaaatggtggtgttggccatgtagtagaccaacacatatggcagactacttggcccaaataaggctaagttgacaggcaagccgataaaaactgtgttggagttaaaaaacattgacttaaaggtacccttacgtgcatgtggcaccttcaataagtagcaaaccagaaatgataaggcaaataggatcatcatggaaaggactgggaaaaacaaatctggcaagagtcgcagcaacattggcgccgtgaattttgaagcaatcgtgacaatcatgtaggctggcaaagcaacttgggtgacaactttagcaatgattttacttgaatggtcattaaaccacccgcgtgctgtcagaaaatagccgatggcgattagaatcaaaatttcaagaacaccaaaaacactggaaataaacgcggtcaaatactgacactcctttataaaattattttggccgccgcagtgtaaaggtgcgtccaagctcggcgtatgtcggcccggcgaggcgggcaatcggcgccaaagcggtgggatcaatgtgaagcgttgtcggatcaagaaccgtatcggcaaaatggaatcgttgcacttctaaaatgaaaagatcagtcaaaatgtcaccatcagcgttacgaatcggcacgtattgataaagcttggtttcaaatcgaacacgcgctgcctgcaaccccggcacctgaatgtccgtacttgcaactaacggcaggtcaatcaacgacaactcgctttgatcaggtgctaagcgggcagctgtttgattcatggccttcgtgagatctgcactcacgatgtgaacaacggcctcgtggcgcgccaatagatttgcagcggtatcttttgcctgaccccgatcacgtaaaactgctactgacaacagtggcagttggtttgaaatcccggtcgtaaatgaaaaaggcgctaggttgatgaggccagtcgtgttttgcgtggtaatccaagcgattggccgcgggatgatactgccagccagcaatttatattgatcacgcgcggataagtcggcggcagcaaggttgaacatcgtggtcctccagaaagttggtaacgcggcaggtgcgttaaattgagtgggtcgcatttgggtgtggtcatcaacttgattttgcccactatggttgcaagtttagcgcaggcagttggcggcgtcaaagtggaaccatcatttggcatcgttggtgtcagtcatggcatgttttttaaagtcatcagaaggatgtcattgatcatataaaaactgacacctgaaaaatcgggtgtcagtaagattttttttaaggaaatcaattaactgggattactgtttgaagctgccgagctgctgtctggtgacggggatggttgttcactagatgcgtgcgaattgctgtcatcttggtgatcattttgaccgttattgttattctcattatgattgctaccgctattatcaaccgtgctctgttgactttccacactcggctgaacagaaggcgctggcgccgctgatgatggtggcttgcttggttggctaacgatgaccggtgcgctgctgacagtgcttgactgtgcgctggctgtttcttgcgtggttttgaatttagccagactggttagctttttcttcgatttgcttagtggcaagttggtctcaacatagcgataactgtgcggtgttttgtttttcagcgtaatcgtgttgttcaacacggatgtgagcgtcttggtgtagcttcgaacagtgccggtcgcgccatcgactgaatactggcgaacggcagtcggcttattgttcttgtacgtcgtcgcactggcatattcataaacattagcgtgttcggatgtcaatgttagtttgccatttttacgcttaaaactgccggtgtcgttgacgacaaatggatgcccatgaggatcgagaatgagcaggcgagtgtaggtttggtcatctgtcagcttaacatagacggttaagtcatgttgatcgcggtctagatcgatgaccgtgcccgaagccttataagtaccgctgttaaatgggtgcgtgacggcgaccgaagatgaaacactgctgctggaagatgtcaccgggccttgaactttagcaccgcgaagaacgagccacataaaaacagctacaaaaataaccgcggcaccaataccggtgagcgtgagataaagcgttcgacgattcttgcgaatacgttcacgtcgcatattgtgcctcctgaaataagatgaaaaaggtttattttaatataaggaatgtccagtagaaaggcaatcttttaccaaatgcttaacctaaccgttacacaatgacatccccattagcaagaatcaaggtttgaattggaacatcaaacggctccacaggccaagccacttgcggaaacgccatcacgggtggtaccagtgtgatcgtggtgccgcgataagttgtcaggaagcgatcataatagccgccaccaaaaccgatgcggtacttgtcagccagcgaaaagccaatgccaggcaccaaaatgagatcaggggcggcatgaatctgatcggcttgataaggcggctccgggataccaaaagcactggtgatcagcttgtctttgccaggatcaggtaggaaaaccatttgccgcttgggcatgacccgtggtaagtagacagctttattggagtcgtgggccgcctgaataattggctcggttgggacttcaaacggtccgcttacggtaacaccgatgctgtgagcacgttgccacataggtgtttgaactagtgcggccaaaagcgctgcactggcagcctgagtcgctttctgggcggctttcagacgttttaactgaagcgaacgaaattcggctttgcttggcatagtgacctcactttgttttgagtagttcgcttagaacaacggcttggttatgcgtttcgtccttggcaccatagagcataatgactggctcttgttcatgttgcttcaatgttttgatgaagtctggcaggtcaggattagctgctaactcagctaagtaccgcttcttgaattcagggtacttttcagggtcgtgaccaaaccacttccgcaactcagtggacggcgcaatggttttggcccataaatccaaagcagcgttaactttgctgatgccacgtggccaaactcggtcaacaaggacacggaatccggatgcttgcggtttttggtagatgcgttcaagtgttactttcaaaatcatcacctcactgactattctaccagccttggcaactagtggccgaaggggaggatagatacgttataataaaagagaacgtgaactggcgcgtgtagcaatccgcgtgtgagcattttggacgggattggcatcgcggacaagggtgcatacagaacggcctctgcgccagtaaacgcgctttaatacggccaagaggtgttgaaatgattacgcgttatcagatccagccacgaggaaatatgcaggtaaccacagacgatcaggccaactggattcgagtttcggcgccgttgcctcaagaactacagacgctggcgacgacatacgggctgccagcaacctatctggcggcagcaaccgatcaacatgaaaatgcacgagtggaaggcttaaatccggcagatcaggtaccagggttgattgttttgcgttacccggttgaaacgactagtgaaacggggtttgatcaatacaatacggtacctatgaccatgattctactgaatgatcgtgtgatcacgattacccacgatcccttacaagctttcgatgatttggctcaacaaaaactttctcctaagcctgaagagtttgcactggaagtcctgtggttggtgctgcatcaattcgtgattgcaatggacaagctgaatgatgaaaccaagcaaattgagcgcagcttaggtaaggcggccaaaaacacgcaactttatcagttgatggccatgcaaaaagggctggtgttctttgatgcggccttggatcattctggtacgctgcttaaagccttacgcgacggtgagcgcttttttaatacgaatgggtacttacggcggttgcatgatgttgaagttgaagtggtcgaggctcaaacgatggttcggatcaccgagaagttgctgacgcagtattcaactgccgtgagtgccattgtttcgaataatttaaatttgattatgaaggtgttaactagcatcacaattattttgacgattccaaccattgtgggtggtatatatggcatgaatgttcgcttaccgtttgccaacgcttactgggctttttggtggttaatcggcggcacagccatcttgtgcggcttggcggcatggtggttgtggcgtcaggattacttttagcattaggtactttgaaaatgggtgtacaaatccccgtgacgtatcgctatcgtcacggggattttgtgtgcgtccgtcagcctgagtagaaaccggcgcaagtacgaggaacgtgatggccggccttaatccttgcgacctagatccttatgcggagctttctgggttggtgaggcacgatgttgcagacgaattagtctgttttcacgactgacatgacagcgttagtttgccgcaaggatttgattaaagtgctgcattgccggtgtcaaaacacggtctttgcggtggacaatggaaatggtgaaaaccggctgttttggatcagtgagtttgacagccgcaagatggtcatcaggattgatggcgagatttgtcaaaaaaccgataccgacattttgcgccaccatttgcttaagaagttgcacatcaccggtttgatagaccacgttggggatgaatgccgactgttgttgaaaccatgtgaaggcgcgagtgtggacgaaggcttcactgagagtcacgaatttttgcatcgccagttccgcgaatcgaaccttgtctttttgggccaacggatctgattcaggggtaataatgacaaatggcgccgtgccgatttggctgatcgtcaaatctggctcctgtaatggtccactggcgccaagtaaggcaaaatcaagatcgccttgtttgatttggtttagtaaggcggcggatcctgcttcaactgtttgcaattgtggcattaagccggcggcaataagctgcggtgcaatttttggaaagaagtagttaccaataattggtggcaagccaaatcgaattttgttggtctgatcccacgcaatttcctgctgcgccaaggtcaactgctgaaggatcacttgggcgtgtgctgctaactgtttgccagctgacgtgacgccaatgtcgtgatgacgccgatcacgaataatgagttgcgcttgaaaactgtcttcgaggcgcttgatggcggtcgtaatcgttggttgactgacggcaaactgctctgctgtttgtgaaaagttgcgggtctgcgttagcgccagaaaatattcaaaatcgcgtgtgttcaaagtgttacctccatgaaacggttgatggggaatagaagaccaattctttgattaaagcatataaaaatattttatcactcctgctgggtttgactataagatttgtcggcgtgtaatgtgacttgctgtaaagaagaaagcccgagcaatggctggttgctaaccgcgctggctcgcgctcaccataacgcgctccccagcgcagcaacctgcgtgtaagaaccttggtcgcaatggtcaaagaacgaccatcacgcccaaggccgcttacattccggttgctaaccgcactggctcgcgctcaactataacgcgctcgcagtcgcagaagcttgcgcatatggaccttgagtcaaaatggccaagatcgagccattttgactcaagcccacttatgctccagcttctaagcgcttctgctcgcgctcacttagaaggagtgttgattttgaaatatacaccagagcaaattattaacgatccgtttttaaataagggtaccgcttttactcaagcagaacggaatcagtatggcttgaatggtttgttgccaccagctgtccagaccttggaccaacaagtcaagcaagcttatgctcagttaaagaccaagccgactgatctggctaagcgtcagttcttgatgacgctttttaatgagaaccatgtgctgttctataagcttttttccgagcatatcaatgaattcatgccgatcgtgtatgatccaacgattgccgatacgatcgaaaattacagtgcgctgtttgtcaatccgcaaaacgccacttatctgtcgattgacgatcctgatcatatcgaaagcgcgctgaagcatagtgccaatggccgtgatattcgcttgttagtcgttagtgatgctgaaggcatcttgggaatcggcgactggggcacccaaggcgtagatatttctgtcggcaagcttatggtttataccgctgctgctggcattgatccgagtcaagttctcccggttgtgctggatgttggcaccaataatgaagcactattgaatgatgatctttacttgggcaatcggcataagcgggtatatggcccgaagtatcgtagctttgttgatcaatttgtcaccacggcagagaagctattccctaatttgtatctgcattttgaagactttggtcgcagtaatgctgccgatattttaaatgaatacaaagaccagatcaccacgtttaacgacgatatccaaggaacagggatcattgtgttggctggtttgcttggtgcgatgaatatttctaaacagaagctgaccgatcaagtttatctgagctttggtgccggaacggccggtgccggcattacgtcgcgggtatatgaagcctttatcgaagaaggcttaagtcctgaagaagccaaaaagcatttctacttggttgacaaacaaggtttgctttttgatgacatgtctgacttgacaccagaacagaagccatttgctcgcaaacgcagcgaatttgcaaatgccgatgcgttgacgaatcttgaagctgttgtcaaggctgtccatccaactgtcttagttgggacatcaaccgtgcctggaacctttaccgaaagcattgttaaggaaatggctgcgcatacggaacgtccgattattttcccgttgtccaatccgaccaagcttgcggaagccaaggctgacgatttgatcaagtggacagatggccgtggtctgatcgcaactggtgtaccagcggctaatgttgactatcaaggtgtcagctatgcgattggtcaagcaaataatgctttggtttatccgggccttggcttaggcaccattgcttcaacagccaaattgttgacagattccatgatctcagcagcagcgcacagcttaggcggtattgttgaccctgatcaacctggtgcagcggtattgccgccagtttccaagctggatcagttcagtcagactgtggcaattgcggttgctgaagatgcagtgaagcatggtctgaaccaaaagccgatcaaagatgctaaacaagcggttgcaaatatgacatggcaaccagaataccggccactgccggattcactcgaaatggacttgggggaataaacgttgactgcattaagtacatccattcaaagtgttctgacgattgttttgctgatcgtcgtaggttatgtgttgcggcggcaaggacgctttgatgatcaatttggtaaaacaatttctgatttgttaatgaaaatcgccttgccagcatcgattttcatctcggtcttgcaacgcctaacgttggataagttggtgagtctgtcatcaggccttgtttatggctttggtgccgtcattttaggctacctaatcgctttcttactggtttggttattaaaagtgcgcccaggtcgacgcgggacgttcatcaacatgtttgtgaacgcgaacaccattttcatcggtctgccacttaacctcgccttgtttggcgataaggcggttccttattttctcatgtattatgtggtgaacaccgtgtcgacgtggactgtcggggccttcatcatggcgtgggacgatccaacccagaagaaatcagaaaaaagcagtactggcttcaactggaaaaagtttttgccagcaccgttagtcggattcttagtcgctttggttttcctgttgttgaagattccgtttattcacgtcggttggttaagctttgcagtgaatgctcttgattatgtgggcagtttggtcacaccgttgtcattgatttacatcgggattattttggccgatgccggtctgaaagcgatccgctttgaccgtgataccatcgtggctttgattggccgttttgtcattgcgcctgcattaatcgctggcttgattctgctggggatgcatgctgggttcaacgtaccaggtcttgaagcgcaaaccttgatcattcaagctgctgcgcctggattggctgtattgccaattcttgctactgaggcgcatgccgatgttgagtatgcgacaaacgtggtcacaacatctaccgtcttgtttgtggttgtcgtgccaattttgatgatgctcgttcagggcttagcttaaacgtacgaaaaaagaagccgattatggcttcttttttttgtgcgattaatgttgatgagcttctagataggctaaagcgcttgtgtaatcaggctcatgtgtttgttcggtgattagttcacgatatttgacagtgccggtgccgtccacgatccaaacgctgcgagcatcggtgtgattatcggccacaaacaagcccatagccttgccaaagtcgccattttgatcagacaacaactgcatttttttcacgccttcagcggcacaccacgactgttgttcttgtggggtattggttgaaattgtatagaagtcagtatgatcaaacgcatccatatcttcattgaaatgtttggttgagatactgcaaacgcgtgtgttgatgtctgggacaacgctgattaacgttaatcgcttgcttaaatcctgcgtagtaacgggttttgcctgtgcattagtaacggtgaacgtcggcaactgctcgccgagttcgattggtgtaccattcgttgttaatgcttcgccatgacgggttatttccaaaaggctcactccttatatcgttaatgtggaatcgttcaagttcagtatcagtgtaccacgattctgaatgccatcagtgtagcatgcatttggatgaaacgaaattcgaacaattaaatttgctaaaattcattagcatatatattgacgcgaatataattatttatgtacattaacaataagcaaaatcatgccagatttttacaattgacgtaatcgaaaatgttagcgagcaaataaccggcactgcaggtgcgagaaggaggtggtcgaatggaacaagcattggttgtttacgcttcggagacagggttcacgcaacggtttgcccttggcattgcccaagcactgcattgtgaattaattgatgtgcaatttgtcaccactggagacctgcaaaaacgcaaacttatcatctatggcggccatctcgtaggtgaaaaagtcttgggtctaaaggccttctaccgcgaatttcaccagtctttacctgatcagttgatagtctttggtagcgggattatccgacgggaacaagtggcaattaagcagatcaagctacagtatcagaaccgctgcgtcatgcctatcgatttttattacttacaaggccaacccaagctaagtcaaatgaacctttttcggcgtatccagacgagccttgctttaaaacaattaggcgccagtcattgcccggcaattcatgaaaccattcaacctcttttgagggcagtgatgcgcttgttggatcaggcaaatttatgatcgataaaatcgtaaaaaaagccgtcacttgggcggctttttttgctggggtacttaatcgatatagatgccaaagtatttgtaagcagatgtagccgactcatttaagatgattcgtcgagcgtaattaaaatagtcagcaagctttgacaacttgagtgtattggcaatttgcacggcttcgtttaacattgctgctcctgtatcccgctgaccataacgaacctgtaattccccagtgcgaaatttggcacgtaaggcgaattctgcatcttgctgctcaaccagttcgatctttaactggtttaaataagtcgcgaccatgtcataattttggcgcaggaattcaagcgttatctgattgtctagtaaatggaatatcaaccttggggcactgcggtagtgactgtagtggcggcttctttttaaggcgagcgtcaataatcgccgttgcgttacaggcggcatggcaatgctaaagatgatgaaaagataaatgtcgaattcaccccaattctcaatacgttgcaagtattgctcggtggcatgggttaaatcaggtctgatgggcaactgatgggctttatcaacgacgagtgattgaaaagttgcaagaatgacgacgcgcgcattgactgccaattgttgcttaagattagggtgtcggtcaaaagcggcttgagcacggctaatttcctccttcattacttgaatcgctttagggaagtcttttgggtcggcggacagttccaaagtctgaccaaaataagttcccagtaatctgtctcgggtggcatagtcgtgctctctcccagcagttaccaaaaatagaaactcttccggcgtggtgctaagtcgttcgagcaagtgagctaactttgtgactgtaatgtcactttggtcgcgttctatcttagaaagataggaactgctgatttgtgcatcggcgacttgtgcaagactcatacttttgttggtgcggatggtacgaagcaattgaccaatcttcatgacaggttgcctttcatatatgacatttattgtttctctcagcctatacctgactatattgaacagcaagtactaaagcgacttattggtcaacaccaagtcgccaaggttaggccaaagggggacatgtatgatgatgacatggcgatatgggcgcaaatggcaattgattctatttgttgggacgagtgttttgatgagtgcgatgaatgtgggggttgcagcaagcttaacagctatgatccaagcggcgacggcgaaatccgcaacgttattattacaaacattgctgccaagtttattggtctttttcggagctgctgtggcgacatgggccacaatgttgctacaagccgccattattcgccaagtgaacttgactatcaagaaagtgatgacgcggcaattgattgatcatccggatttatcaagttcgcaaggctcagatctgtcgtttatgaccaatgaccttaaaatgatcgaaaccaatggcgtgaccagtgaactgacagtggtcgggcaactcatcacgtttgttggggcaatgattggcgcgtttgcgtttgactggttgacggcattgatctttttcctagggaatctggtggcgttagttgcttcaaaagtcgcccaaggacgcttgcgcacagcagcgtcaaattggtctgaggctaatggtaactggacgtcagggcttaaaaattatttgagcgggcgcgatacaatcagcgtttatcaagcagaaggggttgttaaaggtcgcatccatcaactagccgatcagcttgaaaatagtctgcggttgttaaatattttgactagtagcatggattcgttggggatgttattagcactttgtttcggcgttttactgccatttggagttggtatttatcgcgtcattagcggcgcgtcaacattagcattgtttatgggcatcgtgcagctctcaaatgacatgcgcaatccgctcgttgtgatgattggtgctgtgaacaagtggcaaacagcacagccgcttatcgcaaaaataaatgcggcgaatcatgcaccaacagttgaatcctcattgctgatcaggactggggcgatgatgcttaagcatgcagatgtggcgattgacggtcacaagattctaaacggactcaatttgacgatcacaccaggccaaaaagttttagtgatggctccctcgggatatggcaagtcaacgctgctccggctgctcgctggggagttgccagtagcagccggtcagtattggatcggtaagaccctagtgaccgcaaaaaatacacatcaattgcggcaattgtttggcctcattaagcaaacaccgtttatgtttgatgacacgattcgctttaatctgacgcttggtgaacgtttttcgcaagaggctttggatcaggcagctactgactccggtttggcaccactcatcgcagaaaaagggtgggactatcaagttggcgatgaaggccacaatctgtcaggtggacaggcgcaacgattagagattgcccgcgccctgttacgtcaccggccatttctattggcagacgaagcgacatcagccttggatgagcatttaagcgatcaattacatactcatcttttgaaaagtcctgggacgctcattgaggtcgcacatcatattagcgaaacatggcaaaaacaatatgatcaggtgattcgacttgacgagcttgctagtcagcaataaacgcgaaaccgtttataacgaagaaaaagactgggaattagcgatcaaccgttcattgcgccggaatggcacaatttagcggtgatggcttttcctagcctttcatgatgaggtgctacttagaaattgtggtgctaaatgtctgaggcagtttttttgtcattagccattgatttcatgactcagtgaaataatctcatccactgttctaccgaggaaggcaatggtttgcttcaaggcggcatctgtggtgacatcgacaccggctacccgagcagcagcgactggattgagtgagtcgcctaagcttaagtaacgcaaccagcggtcaacggcaggttggccttgttgttcgatggcttggaatgcctgagtagcaaccgtgagaccagcggagtacgagtaggaatacaatcccatatagtaatggctttgtcgcatccatgtgagctcggcgccttcttctagttcaacagccggtccccagaaatcagtgagcacctgacgtttgatggcattcaacgccgctgcatcgaaactgtcgccggcgtcaatgcgttggtaaactttgcgctggaacgcagcttcaagtaagtgggtgacaaagttatggaagtaggtgtcgttgagtaggcgggacaaggcgaagcgtttcatctgcggatctttagccgtttgatcaagatagtgggttaataggagctcattgaaggtcgaagggctctccactaaatagtcattgaaatcagcatcgagaatattgtgtgctttttcagagcgaaccatttgtgccgtgtgcccaagttcatgaattaaggtgtaaaccgcaggcagggaattactccacgtcatttcaacataagggtgaacgccatagggacccgcggtgtaagcaccggagtccttgccttgattggcagggaaatcaatccagtgatcggtgaacgcctgcatcatttgcgcttgataatcatggcccatgatggcggtcgccttttcgatgtcttgcttggcctgatcaagcgtaatcgttggagagtaggcaggatcgatatcgatctgaaggtcggtataaccgatatgatcaagtccccacaattccttcacgtgggtgatatatttgcgcatgatcggtgccagatcgtgcataatcacgtcgatttggcggtcgaacatggcccgactgacttcctgatcggccagcaaataatcgatgacggaatcatagccgcgcatggtggcagtgattttttcacgagtgacttgtgctagataaccagccgccatcgtgttttgataccgacgcaatgtctggttgaactttgcataggctgcacgccgcacttcggtatcaggatgcttctgataattttcttcatacatcacgaatgacagcggataggttttaccgtgagccgtgaaggtgccaaaatccatatcgccgaaaatcgtttggtcgcgaatattgctaggcgcttggaaaacaggtgataactcggctaagaccttctcagcagcaggagccaaagcgccttttttagcaattttaatttggcggaaaaagccagcatagtcaggtgccttggcaacaacggcatcaaggacctcttcaggtaactgggttagttctgcttgaaagaagctcaattgaccaccaatttcaccatctaaagccgtggctttgatttggcgatcacggagtttaggatcagtggtatctgtcgaatacggcataaatgcccagtgtccaattttactatcaagttcgataatcgagccatagtcgcccagggcatcaacaatgatggccggttcggtcaactttccttgatatagatggacaaaatccttggtcaaagcgcgtacttgcttaatggcttcggtgtaagcaaactcatcagcaaaaatcggcgttaaatcccaagtcagttttggatcaacctcttgacgttttggcagtgcggtttcactcatcgaaaaaacctccttcgcttaatgggtaaagtatagcattggtctgcatgattttgttctgtggaatcgcatagggtagatggaaacgcatatccacaaaaagcgactcgtggtaaaatcattaaaaaggatgtgttatatatatgggaatcgacaataatcagctcgtggcgcgctattttgatcgcaaagctgatcatgcagcattcttcaaggcgttagaagcctatttggatgatcagattaatgaactgtatacaacgttgaatgatactttcgcagatacggtgacgctgtcattagatgtggccatcgctaaggcgcaccaagccggcgccaagattgacgatccagcggctgaagaaattgcggcaactaactatttattcaaagaactctcttctcgcggcttgtggctgcaatcacctgatcaaaccgaaccaaacaccatcatcgctaaattgaatttcggtaatcggcggacttactattaagcctagctgatcatcaaatgtgaggttgaggcaccattatagcaaccaaaaagaggcatgattttctgattagtggaaatcatgcctcttttattgagccttatggataactgatagcagctaaagatgccagtgttaaagcagagattgcaaagtctggcactgggaaaaacctttttacatcaccatggcaatttacccgcggtttctgtaaatgtcatattcaaatcagggctatcgtcagcggcgagtttgacgatttgagcagcaccttctgcaaccgtttgttcgccgctgcgattaccaccaaaatctgtgcgagtccacccaggattgactgagttgacactaatgtgatctggctgtaactctttggcaaaatcaatggtggcgaagttcaccgctgcttttgaggcttgatatccaagtgaattcacctgaaagaagcgactgtcaggatcgctagccaaaccgagtgaacccatgttgctgctaacgttgataattttagctggagcacccttttttaacaacgggatcatcgcctgtgtgacactgactaagccgaaaaagttgacgtcaaagtcttgacgcattgtcatcacaggcaattgtgaaggtggttgatgggcatctaaggcaataccagcattattgatcagaacattgagatagccatgtgaggcttcaatttgtttcgcggccgtcgcaatggtgccggcttgggtcacatctaagaacctgtctagtatcttttaagaactatcttcaggaaggccaatacaatactattctttgatgccaataaagcttgcagttatgctgctttcaccagccactagataacctgatggataaagcttatttgaaatcagagttattaaagcacatctccggtctcgatcagtcgcgagaagtagggtgacaagatggcgattcttctatatatcatcaataacgtgttgagtcagccgattttcattattgggttggttgtgattttagggatggccgtccagcataagtcttgggataaaatactgccgagcacgattaaagccattatcggcttcacgatgattaacgtaggcggtcaaacactcgggacggcgctcttgccgctgcagcaaatgatctcaaaaatcttcggcatcaaagcccctggcagtgataatattggcgcaacgcaggcggcaagtctagcaaaaattggcaccgaaatggcccttatttttgcactcggcttcttgattaatattctgatggcgcggtttacaaggttcaaatttgtccatctatctcctcatgtttctttcttttttgcaggcatgattgctgccttgctgaaatacaataccaatctgtcattcatccccttagtaatcatcggggcacttattttgggcatttatatgaccctgtcctgtgcctacgtgaattacttcatcaagcccgtcaaaggcgcagatggctctacgttagcccactcgagttcttctggattagtcgttgcctcagtgttggccaagctcttcggaaacaagcaaaatgatttggaacatttgaagatccccaaacaactcaactttttgcgagaaatgacaatttctttgacgatcgtgatgactgcactctttttcttcctaggattgtttgctggtaatagttggctcatgcaacacgtatctgctgggaaggatgtggtcgttttcgctgtcctcaaaggtgttgaattcgggatgtggatcacggtgatcatcacaggtgtgcgaatgatgttatcagagattatccctgcgttccatggccttgcagacaaatttattcctaacgccaagccagggctggatattccgctgctatttccaaactatccgacttcagtcatcgttggcttcctatgcagcttgaccacggggctgatcggcatgcttttgttaggtgcgacgaattacccgatcatcgtttttcctgccttgattccaactttcttcacgggagcggccacagcaatatttggtgatgcccacggtggtgttcgtggcgctattatcggttcctcagtgaatggctttcttttgattttcggccaggctttgcttttgcccctagtcggcacttatgcgccaattatgcgaattttgagcgaaactgattactgtgtgtatggtaccattcttggtttcttcctaaaaatgatcgggggtatctgagacacatgtcatttttcacgtttccactcaacatccccatcggctcgatacaagcaaaggtatgtgttttacaagatgaagcaccttttaaactgagcagttcctgcctgattacaggcggtgtcaaaaattcgaaggaaaacaaattaaaattgttgacattttctggagaagcttctaatattcaaatcaaccattaataattcatccatgaaaccgatgatgtggagatcaagatcattgtgcgcgcaaagagagttgccggtgctgcgtataaggacctcaagcacactggccaaagcccggccaatgcacttgaggccacttatactccggtttctaaccgggcaagctcacgctcagtcataacgcgttcgccagcgcagcgacctgcgtgtaaggaacctgaacgcaatggtcacaacccgaccatcacgttcaggcccgcttacactccggtcgctaagcgcgctggttcacgctcacacaaaaaaaggggcgatttgatgaagctgattcaaaatcccattcggcttaacgccagcttgcacaaaatgttaccgaacacaatgcggtatctttataatcgaaagccggttaagttttttgaattatatacgttaggatctgttcatgtttattacgttgaaggatttgaccaagtcgatgtcgtcttgacccatgacaaacgcaccattaaagatgctgagattgattttgtcttggaaaaactgttgcctgatacgcctaaagctgaccttaaaattgaccacgctgctaaaagcgagatcgagcacgaggttcatcgcaagttgaaggtccatgatgttgtgattatcgaaaaggcgtaacgaaaacgaccactttcccgggcatcaccgagaaggtggccgtttttgtttttttgcacatcatgctagttaggacgatattgttggggcttttcgtcagggaatctcaccaagttgtcatgttgcgttagataaggtaggcttgagcgtctatttaggttacactgatgattgtttgtgttttggttaaattttcctgatacattcggttcatataggagtaatgaaaatgatgcatttaaagcgcctgtttattgggcgaccactgaaatcttctgaggaaggcggtcaaaagcttaacattttcaaggcactggcgatgttatcgtcagatgcgctttcaagtgtggcttacgggactgaacaaattgtcttagttctgacgacattgtcagcggctgcgatttggtactcattgccgatcgctgcctttgttttagtgctcttgatttcattgacactatcctatcgccagattattcacgcctatcctagtggcggcggcgcgtatgttgtcgctagcgaaaatctaggtaaaaatgccggcctaaccgcaggcgcttcattactgattgattatatgctaacggtttcagtctcagtttccgcgggtgctgaagcgattaccagtgcaattcctgcgctttatggtaagcaggtgatcatttcactgatcatcattttcatcttgatgagcatgaatttacgtggcatgagtgaatcggccaattttttgatggtcccggtttacttattcgttgtcgtcatgacgggcatgatcatctggggactttaccaagtggcaacaggcgctattccgtacaaggcaacttcctttgtcggtgcagcgattccgggagtctcgatggccttgatcttccgggcattttccagtgggtccagttcactgactggggttgaagcaattagtaatgcggtgccgttctttaaaatgcctaaagaaaagaatgcggctaaaacgttggccatcatggctgccatccttggcttcttctttgctggtattacatttttgaactattggtacggtattgtgccggtggccaaagtgacggtgctttcgcaggtggccaaagagacctttggcggagcaggtatcatgtactacgttgttcaatttgcgaccgccttgatcttggctgtggcagctaataccggattttcagcttttccagttttggcttttaacttggccaaagataagtttatgccgcatatgtatctggatcgtggcgatcgcttgggttactctaacgggattttgacgctggcgttaggagccgcagcgctgattacgattttccaaggatcaactgaacggctgattccgttgtacgcggttggtgtgttcattccatttaccttgtcgcaaagtgggatgattatccattggttccgtcatcgcggaaaaggttggattggcaaaacgattgctaacttctctggcgcgttgatttcctttgcaattctcgtcatcctgtttgcttaccgattgcttgatatctggccattctttattgtgatgccactcgctattttcatgttttataaaattcgcgatcattatgacaaagttgctgagcaattacgcttgccggtcgaagtggcaaaacatgattacgatggcagcaccgtcattgttttggtcggtaatgtcactcgggttacgcgcgcggccttaaattatgctcagtcaattggcgactatgtcattgctatgcatgtttcgatggacgagaatcccaataaggaaaaagaaacccaaagcgaattccgcgcggattttccagaggtgcgatttgttgatatccactcatcataccgttccatcgaagccccaactattcgcttcgttgacatcgtcgcgcgcaacgccgccaaacggaactttacaaccacggtactcatttcgcagttcgtaccacgtaaaaaatggcagaatattctccataaccaaaccaacttccgcttgcgcgcagccttagcaagccgcgagaatgtcatcattgccacttacagttatcatttgaagaagtagtgagactacttgctaaacggttagatcatgatgatctgatcgttttttgatttgaacgtatacgcagccgcggaaatttgtacataagaaccttgaagttaaatggctcaaaaccagccatttaacttcaaggttaccgatgcttcgatttctaaccgcgacaactcactctttgcacttgccagggggtcgctcaaagttgacgcacctgttaaaatggttcatatagaacgtcaaagaaagtcaaaggacgaagggtgaatttcgtgccgcaaaaaaccagtgaaacgcctatgatgcagcagtacaacgaaatcaaggcgcaatatccggatgcgtttttgttttaccgcatcggagatttttatgaattattcaatgatgatgccatcaaaggtgctcagttgctcgaactaacattaactgcacgaaacaagagtgctgacgatcctatcccaatggctggtgtcccgcaccatgctgtccaaagttacgttgatattttaattgaccacggttacaaagttgcgatctgtgaacagatggaggaccctaaaaaagctgtcgggatggttaaacgagccgtcattcagttggtaacgccagggacaaatgttgacatcaaagccggtgcagccaagtcgaataactatattaccgctgtgatgccgcatgcagcaggttatgcgtttgcgtatgccgatgtatcgaccggtgagctcaaagtgacggatctaaaaagcaaatttgctctgcaaaacgaactgagtgcgctggccaccaaagaaatcgttgtgcctgaggaattgaccgatgacgacgcgggaatgctcaagcaaggggaacggcttctgtcagtccaacctgatgccgagccgacgagtgaaggcagttatgtgtcacaggagctaactgatcctgcagaggctgccgttgtgcagatgctaatggcctatttattgaacacgcagaaacgcagcttggcccatattcaaaaagcggttgcttatcaaccttccgcctatctggaaatggatcaggacgcccgtagtaacctcgacattttgcaaaacagcagaacgggacgcaaaggtgacaccttgttgtcgttgcttgattcgaccaaaacagcgatgggtggccgcttattgaaacaatggctggatcgaccattactggatattgatgcgatcagtgtgcggcaaaatcaggttcaggatttgttggatcacttttttgaacgcagtgagttgcaggaacgactaactaaagtctatgatcttgagcggttagctggccgagttgcttttggtaccgttaatggtcgtgatttaattcagttgcaaacctctttggatcagatcccggctattcaggatgtgctgggtaagcttgatgatggcagttttaaggcacttcgcagtaaaatggacccagtcagcgatgtcgccggattgattcgccgtgcgattgaacccgaaccgccgatttcagtgacagacggtggcttgatcctccgagggtacaatcaaaaactagacagctatcgtgatgccatgaagaattccaaacaatggatcgctgaactggaagcatcggaacgcaaagcaactggcattcacacacttaaaattcgttacaacaaggtttttggttactttatcgaagtgactaagtccaatttggacaaaataccggaagggcgctatgaacgcaaacagacactgacaaacgctgaacggtttatcaccccagagctgaaagaaaaggagaccttgattcttgaagcgcaggaaagctcaacagcgctcgagtatgatcttttccaagacattcgcgacaaggtcaaagcccagatcaaacgactacaagctttagccgcccaaatttcatctttggacgtgttgcaaagctttgcaacagtggctgaaaacagtcattatgtccgaccaacgatgcatgccgggactcatgatatcaatgttaagggtggtcgccacccagtcgtggaacatgtacttggccgagacagttatattcctaacgatgtcatcatgaatcacgacaccgatatgttgctgatcaccgggcctaacatgtcagggaaaagtacctacatgcgccaattagccttgattgttatcatggcgcaagcgggttcgtttgtcccggcagatgtagctgacttaccgatttttgatcagatctttacccgaatcggagcagctgatgatcttgccaatggcgaaagtactttcatggttgaaatgctggaggccaatgctgcattaagccacgcgacggcttccagcctgattctttttgatgagatcggccgcggcacggcaacgtatgatgggatggcgctggcacaggcaattattgagtttttgcatgatcatgtccacgccaaaacgctgttctcaacgcattatcatgagctaactagtttgtcagattccttggcgaagttaaagaatgtccatgttggtgccgttgaggagcatggcaatctggttttcttgcacaaaatgatgcctggccctgccgataagagttatgggattcacgttgccaagctcgccggcttaccggcagacttgttagcgcgtgctgatatgattttgaaacagcttgaagccgatgcacccaataaaacggcaccagcaccagcgccgcaagttgaagagcaacaattgtcgttgtttgaagaaccaaaaccgacgccaaagaatagtccgattctgacgaaacttgcgaaatttgacttgatggcggccacaccgatggacgcgatgaatttcatatttgacctgcagaagcatttaaagaagaagtgattttatgccaaagattcaccaactatcggcaacattaagcaaccagatcgctgctggggaggtcattgaacgccctgccagtgttgtcaaagaactggttgaaaatagtatcgatgcacaagcaacgcaaattgacgtcttgatttccgcggctggtttgcaggagattcgggttagcgataacggcatcgggattgccccggatgacgttgcaacagcgtttttgcggcacgccaccagtaaaattctgacgacgcgtgatttatttaatgtgcattcattgggcttccgtggcgaagcgttggcaagtattgccgcggttgccgacgtaaagttgacaacggcaacggattcagggattggcacccagattcacgtcaaaggcggtgaggttgaagcgcagtcgacagcggctcatcgacgcggtacggatgttgaagtgaatgatttgttcttcaacacaccggcgcggctgaagtatatgaagtcgcagcaaactgaactgggaaaaattgtggatatcgtcagccgattagcgatggcaaatcctgatattgccttcacggtttcacatgatggcaatatggtggtgcgcacagctggtcaaggtgatttgcgccagacactggccggaatttatggcttgtctgtggcgcgctcaatggttgatttcaaagcacaagatcttgattttcgggttagcgggttaacaagtttgcctgaaacgacccgagcttcgcgtaattacttgagtttagttgtcaatggccgttatattaagaacttccaactgacgaaggcggttattgccggttacggctcgaagttaatggtgggacgttatccaatgggcgtcatcaacattgagatggatgctgcgttggtcgatgtcaacgttcacccgacaaaggccgaggtgcgtctgagcaaggaagatcaactcagtcatttgctcagcgaggcgattcgaacacgattggcgaaggaaaacctgattcccgatgcgctcgataatctgccaaaaagagaacggtatgatctggatcaactggaactgacattgaataagatcagccccaagacgatgccctcagttcagccgcagcaagggcagcagttgcgcgaaaacacaactactaacttggcagacgcggctgctgaggagccgacaccggcaccaacttcaccagatcttgagattggcgatttggatgatcagccgatttttaacgaaccgcaacgtctggctgcatgggatcagcggtatcagcggctagcttcgaatgtggtcccaaccttggtggcagatgaaccggaacctgatatttctcatgttgaatcagctgagcgttttccaaatctcacgtacttggcgcaagtccacggcacttatttgctagcggaatcaggcgatgggttatatattttggaccagcatgctgcgcaagagcgggtgaactatgagtattatcggcaagctattggcgaagtcagcaacgaccaacaacatttactcgtaccgattgtgttagactattccgcggctgatgccattagcattcgtgatcatcgggacgtgcttgagtcggttggactatatctggaagactttggccaaaacagctttgttgttgaacatcatccgacttggtttaaagctgggcaggaagaagataccattaaagaaatggtggattgggttttgcgtgatggtcgcatgacagtcgcagcgtttcgggagaaaactgctatcatgatgagctgtaagcgtgccattaaagccaatcaccatttggacgacagacaggcgcgagcattattgcagaagttgccggaatgtgagaatcccttcaattgcccacatggtcggccggtcttggttcacttttcaaacaccgatcttgagaaaatgttcaaacggattcaagacagtcacgaaagcggggaaatgcaagcatgatcattttggccagtcattcaccacggcgacaggaattgttaaagcggattgtgcctgactttgaaagccatcctgccagtatcaatgaacgcgctttgccagtgttggatccgccagcatacgttcagagcttggcgacagctaagggacaatcacttgtaccaagtttccccggggcaacgattatcgccgccgataccatggtggcgtttcaaggtaagttattaggcaaaccacatgaccgcgccgaagccaaacagatgatcacggcattgggtggtcagacacatcaggtttataccggtttgtgggtgcgattggacaatggtagcgtacggcagcaggtcgtgacgactgatgttaccttctggccgctaagtgaagcggatgttgaatcgtatctggcggaagacgcctaccaagacaaagcaggcgcctatggcattcaggatgccggagcactactggtcaagtcaattcagggtgatttctacaatgtcatgggcctgcccatcagcaccttgtaccgcatgctgttggccgaaccgcaataaatacgggcaatcaaaaaagtctgacgatcctcagcgagatgaagtgtttcgctgaacgtcagactttttttagcgctaagtagtttgatagaaagcgcagggtgggctttaaagatttcagtgccaaagcgtagcaatcgtaggccagatggggctcagccgtgcaaacaacacagcgacgggctttggcgctgatgttgttaggcgacttcgagaccggtatttgggctcgaagcgccgtctccgctctagcttcgcgtcgctaccccatctggccggagattgcggagtttggcacggcaagaaactttttgccagacccattactcagatcaattgagatctaacaaatcataagtgtatggctcagcttcaaatttttgtgctggcgagtgcgtgatgacggaacgtgaatcagtttctgcgagtgcaagatggcgtttactgatcaacaatctgccaatttgctggcagtgtgaaggtgtaaattttgccaattgctttaccttgttcgcctgatccagcaaacaaaatagcggtcagcgcattgctataagtcagcttctgagttgtcactgcaacttgcggaatggtgccatgttcgatgcgagttgagaccgtggtactaggtgtagcggtatgaacggttgcatcggaaatgataaggtaacgatagctgaaatgcttttttgctgtgccaatgggccgccgcgagatttgcaactggtcgtccatcggtgctaatggctgcagttcagtggtttcgtcaatgttgaagccaacgtgataaaggtcattcacgcttaacaataggatgggggccaagacaagtcccgcgcttacccagatcgttaattgacggcgccgacttggttgcattaacacaacagcccagaaaagggcaagcgcaccgacgatcaataacaagataatcatgaggcgtccctccgatcaatgacgtctgttttcaaaaataagctgagaacgagaccaagcgctgccatgactagtgagacggcaaaagccgcgcgataaccggcaatgactgcattgttcatagcgttggtgtaatggatcgggtaaagcagtcgaccactagcggctggcgttgcatctttagtgactactgataatactgacaccagtattgcggtgccaattgaggcggcgacttgccgaaccgtgttattgaccgccgtcccgtgattgatcaggtgtgttggcaaggcgttcataccagcagtggtgaccggcatcgtgaccatggtaatgccgaacatgcgcactgtgtaaatggtcgtaatatagataatcggcgtgttagcagttaaggtgaccagcggcagcgatccggcaactagcaggaacagaccggcaacagccagccgctttgccccaattttgtcgaaaatccggccggtaattggactcataatccccatcatgatggctccgggaaaaaggatcatcccagagtgaaaggcagattcaccacggatcgtttggatgtacattggcaagaccatttctacaccaaccatcgacataaacgccaccgctgttaaaatgacgctcaatgtatacgtgcgcgatttgaaaacccgcaattctagcagaggcgtttcgaggcgtaactggcgcacgcagaataaggcaacgaaaataatgccgatggctaagctaatcagtacttgggaatcggtccaaccagcatcaccaactgtggagaagccataaagcaagcccccaaaacccaaagtcgaagcaataatggaaggaatatcaatttttggattcgaggtcggcaaaacttttcgcatgctatagatggccagcagcacgaccccagcagcaattggcataataacggcaaataaagcccgccaagtatgattaagcagaatccaaccagaaagcgtcgggccgatggcaggagctagaccgataacaatcccagctaggcccatggcactaccacgtttgccaggtgggaaaatcgtgaacatgactgtttggaaagtcggcattgacataccaacgccaatcgcctgcgtgagccgaccagccagcagaacttgaaaatctggtgctaaccaacaaatcaaggaaccaagaaaaaagattgtcatagctgttaagtagagatacttaacattgaatttatccagcagccatgcggaaactgggatcataatacccataatcagcatgaagccagtggtcagccattggactgcactcgcgctgatgtgaaaatccgccatcagcgtcgggtaagccgtggtcaaaatcgtttgcgtcaagaatgttgtaaaagtaccgatcaacaaggtaatcacaagcagcaagcgattatatggatgaccattaacgtctgttgttgtcaacaatatcgtgtcctttcttaaaatcgttataatccagtctagcacgtcctcaacggctttgggtaaataatgaaatcgttgctgtcattagggtttagtttatcggctggtagttgcgcctagcggtattgcacaaaaatagattacgataaaaaaacgtgatcccctcaacgagtaccacgtttttgaaagtttagcttgatcctgattaatgcttgttatcgtcgtttttagcttctttaacctcttcagcaaccgtttgtttaactggttttggatcttgtgtgacatcaaaccagttagcaaagccacgggaaaaatctgcaacggtgaagttgaaatgatcaatcttgaccttatcgtgcagtttcaaatcgggatgatcttccatgataaagccagcaatggtgatgatttctgaatcagtgaaggctttaatattggtgtggaagtaacgttcaaaatcccacaaggttgttttgccactgactcggaagacctttggatcatccgtttgccgaatgtattcatcagagacatcatcaatttcatccttgacggtaccaaatagttcttcgtaaatatccttatcggtgacaatcccactagtaccaccatattcgtcaacgacaacaacaattggcgtctgtttcttgatcatttgtgccagaatactatgaatcggtgttacttcaggcacattaatgatggaacgtaacagcttagagaccttcacagacgggtcgacttgaccttgcttgaccaagtcatagatgtaaacatacccgagaatcttatccttatcgccattcgcaacaaccgggaatcggctgtaaccttgcgttaagtaatcccgcaaagcttctttgacggtggtggtgatatcaatgacaaacaagctggttcgatccaccatgatgtctttggcggtcttgtcattcagttcaaatgcccgctgcatgtagataacatcattttgttccatgtcaccagttgtgacggcatttttactcagactcagaatctcagcttgcgaaaaggcttcgttgccttcgtctgcgggcttcatccccatcattttgacaatcccggtggcactgacattcagcagccaaacaaaaggatagaacaaaatatggaaataatgtagcggtgttacaaccaacatcaaggttttgatcggataatcaatcgagatgttttttggaacaatttcggttaacacgacttctaaataggttaaaataatcacgcctaaaatcgcgccaactgcgtgcagactaccattaggcaagctcaggtgggtcaagccaaaaagatcaaccaacaaaaactcaacggttgtttccccgatccaaccaaggataatgccagcaagcgaaacaccaacctgtgtcgttgagagatactcgtttagattatgcaccattcgtaaagcccgctcgactttggctttacggccagtaccattatcaatcatttcttccaaggcacttggacgactttgcaccagagcaaattcacacgcgacaaaaaatgccgcgaataaaaaggtgacgagcatcaccaataaattggggacgatttggccactttccatgtattccattcctcatttcatgtatcgtacaaagttaattttaacattgaatgacaaagatgaccgataattccatcactttgcttctatgttatgcttgggtcaatcgaaaatatttaattgaaggtggcaggaatggaacaagtcaagatgtaccaagagacaatggcagcatttaaggcacgaccagaaatgcccaaaacacaggtcattagcgaaccattgccgcaaacgccagcgaaagggacagaaccgccgcaaattgccttgcgtaatgttgatgttttccaattgatgagtgaactgacgggcaaaatcggcgtcatgaattttgcaagtccggtcgatccaggcggcggggttgcagttggcgtacgtgcgcaggaagaagccattgccaaggggacttatttggttccagcccttgagcagcacatggcagattattatgagcttaatcgtcgcaagccaaatcgcgggctttttagtcagaagttgatctatgcagaacatgttcgccagcttttcgatgatcaagggcggcgattaacagacaaatatgtcgacattgtcaccgtcgcagcacctaatcgccgaattgatgcaacgctagatgatgccactgccatgaacgatatcgcgtttaaaattctgcagacgcttcgggcgtttaaggcgcatgatgtcgatcaggtcattttaggcgcgtttggaaccggcgtatttggcaatccagttgcaccagtcgccaagttgtttcgaaaagcgttattgttgcccgaatttgaaggggcgtttaagcgggtttactttgcgatttatgatcccgcaatgaccacaatcaagccatttgcagcagcgttgaaaggccaagattaagcggccacgagaggagcacgacagcatgaagctgacagtcatgcagcatactgatacagaggatcttggcacgattaaagactgggccgcagacaagcaagttgacatggtcacttaccgccctgatcaaggggatccaattgcacaactgaacccagcagagatggatgggttgattttgctaggtggacccatgagcgtcaatgatgactttgattggctcgccgcagaacgaattttgatccgcagcctcaataaattgggccgcccggtgttggggatttgtctaggtgcccagcagattaccaaagcatttggtgccaatgtttatcggatgccgcaaccagaagaaggcatcggcaccgtgcgcggtaccgatggctcgttactcaatgttttccactggcatggggaagcgatgagccgcttaccaggaagtacattactttacgaaaatgagcatgcgctgcaaggcttcgcttatcatgaccatatcgttggcttccagttccatctggaagtgaccccagacatgattgctgaaattggtgcggcagcaggcaaaccgcaaggccccgtcaatccggggatactggatcacggacatcaggttttggcagcaacattggatcgactcttcctatagaagtgaaacggcatctgtttgacagagatgccgttttagtttggtttaacaaaaagacagtgtcagtttgttaaggatgtcatctaatgtaatcttttgtcatagaacttaacccaatcgcaacacacagaatacatgttcgtaacactggatagctatactaagtctcagttagttaaatcaccacacaaacccaggaggaatacgaacatgaaaaagcttttaagtacagtattattctcagcagttgcactgtctgccgtggcattgtccaagccaagtcacgtcagcgctgctacgaagaatactgaaaccgcgaccgtcagtgcaccagctagcgacaaaaccgaagctgatgttacctacaacggtggtgctacgactgtttggacctcaccgacagcgggtcaacaagttaagcgttatgtgacaactggtgaacacgttaaatttgtgaatagtaaaaaagtcttcgcagaaatttggtatgaaactgaagaccacggctggattccagaacgctatctgagtattaatactttgcagcagttggcaccattgacgaaaaaggctgatgcggctgccgcaccgactcagacaacgtcaccagctgaacaagctgctcaggccgcaactgcgtcagctaatgcgcaagcagcatcaagcgctgctgctcagagtgccgctgcgtccgcagcagcgcaaagcgccgctgaaagtgctgctgcgcaaagtgctgccgctgaatcagctgcgtcagttcaagctgctgctgaatcggccgctaaccagcaagcacaacaacaggctgctgaacaggctcaacaagctcagcaagcacaacagcaacaagttcaacagcaacaggctcagcaggcagctgcgcaacaaaagcagcaacaacaagtacaacagcaggcggttagccaaccagttgctcagacaactcagacgtcacaaccaacccaaagtgcaactaacaaaggcaccttcaagatcagcttctatgatccggctgttctaggtagcaacatgggctacagtggcgttgctgctaatttgagcgtcttccctaaaggcaccgtattacgtatcaccatgtccaatggtcaaacattgactcggacagttaatgatactggtagttttgctgcaggcaatcctaatcagttagatgttgcaatgccgagtggccagattcctgcagcagggatcttgtccgcaaccgttgaagtacttcagtaattaaatgaatgcatcaaaaaagtcggagcaagtgcttcggctttttttgtgctcattttaattgtagtggtcaatgaccgttgctcaccttgagatgtcagtgcgaaacccgcgagctaagcaacagatataattgttccgtttgggtgagccgcttatccgtcacttggtaccaacgattgatcacaagttgtgagctgatcagttcatcaactgcgagatcatcgctaatgggctgctttgatggtgcaacagcggcgataagttggcctttaggactaagcagcgcacttaaaacatgagtcatggcacgtagctcctctggtgattgatcaaatgagccgacgatgagatcatatggtccagttaacagttttagccatttatccggcatgatgcgataacgtaagcgatcggagctggcaacagcgcgggcatcttgaatggcaaccgcatcggtgtcaataccgagaaccgcggtggcaccgccgttgagggcatgacgacaaaaccaaccatcgccgcaatgaatgacgagaacacggcgatcggcaactgagggtatttttttggcaagtgcttgccatattggttgatcgttgccggattcagacggcaaatcaggcagatcttgcatattcgggtaaggagcatccataggttcacgacctttcacctttattatagatgaaactgcttgtcagcgtgcggccatttcacgggcactatgcaggttcatcgagcgataaccaaagactgtcagtgtttttgtggtcatactgcgcacgtcaaaactatttttaaatttttaaagggaaatggcaaaaaagaaagacgaaaaatattgcatttttctaagaaacatgagaatatactatacatactcattgcccagtagttcagtggtagaatgcttgactgttaatcaaagggtcgctggttcgaatccagcctgggcagtcgaaagctgtgaacgaaatttcgttcacagctatttttttgcaaattttcataaagtgccatgttgtttcatgctgattttggaaagaaaatcaatagaaggctggccaataagattgacagcaccattgcggctgggaaaatggtcacagaaataaggagaccgactagcttgagcaataaatcaagggcgacgattacggtaggtgtggcatacaacaggccaaagttagcctctggattgagtttgcgtaaattgagcgacaacaacacattcattagcgaaacaatgatgacgattgtggttgcattggagtgcacacaaaggtttaatatagcctttgttcgtaagaagtaaggtttagataacgcaacttggccacgatcatggcatctttattgattcagccataaacgaattagatacagataacgtttttcttgactggggtgatccccctatagctgattcagcagtgatgactgcgatatcagtttacggggaaaactcaagcaagcgatgcacatctacatggaggcgatgttttgataaagaatattttgataatggctgcaaacggccagatttcacgactgattgaaaatcaaattctcaacgatgatcaattcgccaatgtacatttaaccttgttcttacgccatcaatcacgcttggcgcagttggcgaaaaatccgcgggtcacactggttgagggcagtcttgatcggttggatgatgtcaaaaaagcaatggttgaccaggatcttgtatttgtcggcgtggttgatcatagcaaaggcagccaacaaacccaaaatgtcattgcggggatgaaggctggtcacgtgcagcgggtgatttatacgaatgttctcgggatctatgacgaagttccaggcacctttggcaagtggaacaaggcgactatcggcaatgggttaccatcagctctgaagtcagatcaacttcttgaacagtcgggtctcgactacacaaccttacgcctaccttggctaaatgatcgtgacgttaagtatcaactgacgcatagagatgaaacttatgtcggagtttcgggctcacgcaagagtgtggccgacgtggtgcttaagatcattgcggatcctgattatttgaaaaacgacagtgtcgggattgccgatcctgatacggccggatcagatcgaccggtttattaactggggaaaagcgctcacgataacgcgctcgccagcgcagcaatctgcgtgtaaggaccttggttgtaatggtcaaagtgcgaccatcgcgcccaaggtcacttacacgccggttgctaatcgtgctggctcgtgctcacatttaggaggtatttcaaatgaaagcagctgtttttttaggaccaggtaaagtcgaaacacaggatgtaccaaaaccgcagcttcaaaagccaactgatgcaatcatcaagattgttcgagccagtgtgtgcggatcagacttatggtggttccgcggcatctcacatcgagacgctaatagtcttgttggtcatgaggcgattggcattgtggaagaagttggtgctgaagttcatgatattcatgtcggtgattttgtcattgcgccgtttacacatggttgcggtcactgtgcggcttgtcttgccggttttgatggtgattgcatgaatcaggaagcaggcggcaatggtggctatcaggggcagtatttacgtttcacgaatgcaaactgggccttggttaaaattccgggtcagccgagcgattattcagatgagatgttgaattcatttgtcacactggctgatgtcatggcgacaggttatcatgctgctgcaagcgccgaggttaaacaaggcgatacagttgttgtcatgggcgacggggcagttggcctttgcggcgtcattgctgccaagttacgcggtgctaagcgcatcattgcgatgagtcggcatgaagaccggcaaaaaatggcgattgcttttggcgcaactgatattgtacccgaacgtggggatgaagcggttcagaaagtcttagcaatgacgaacggcgcaggtgctgatgctgtgcttgaatgtgttggcactgaacagtcagtggatactgccactaaagtaggtcgtccaggcgcagttgtgggtcgtgtcggcgtacctcaaaagccagagatgaacacgaataatctgttctggcgaaatattggtctgcgtggggggatcgcttcggtcacgacagatgacaaacaattgctactcaaagccgtcttgaatggcgagattcacccaggcaaagtcttcacgcaacgctttgatcttgaacatattcaagatgcttatgatgcgatggatcagcggaaggccattaagtcactaatcgtggttgaaggttaaaggagactgtcatggcaagtaaagtactgattgtgtattattcatggtcagggcatactgctacattggcgaaatatttacaacaggcgacagatgcagacctgttagctctacatgttcctgagcaaactttttcgtcagatatgtatgacacctctggtcgggcaaaataccaagtagtgtccggaaatttaccgcatctgacaacggttattcctgatctgaccggttatgaaacgatcttggttggtggtccggtttggtcggcagcgccatcaacaccagttttgagttttctaaaacaggtgcaaggcagtcgagctgtattcaggcctttttataccgatgctggcacacccggtgcctgtgaacaggcgtttaaacaggcagctgggcaactgcaagtcaaacaaggatttggtatggcgggtgacaatgtcgcccaaaagaaggccgaaatctctgcatggctgacaacgttgtagaaacgtcttggtgtgctaaaaattttgagatgcttggacaaaggtttatcaggtattaattggagctcatggtgagtcacatcatgcaaaggatcatttgactatctgagtcaaaaatccgttgtgatcggtattagaccactgaacttagtttgcgggtgaatgccagataatcatgtcgttgatctgctgagaccgttgaaggagcgataagcgtgacaattgatgaagttagtaaaaagtttaatctgacaaaggatacattgcgttactgggaaagaattgggttattgcctgaaattcaacggaatcagagtggctatcgtgactacgatgaacatgcggtcaactgggtttattacatcatggttctccgtaaggctgggatgtcgattgaatcgctttccgagtttgttaagcttttacgggaaggcgatcaaacaattgcagcccgaaagtctttgtttattgaacaacgtgatgctttgattgaacggcgcgataatattaacaagacccttcgctacctagactataaaattgatcattttgaagatcacatgctgggctacgaaaacgagaaactggcttatgaaggtaaattgaccgaagaaaagtaacaatcgggtattttagccacaaaaaggcgatttttcggcaaaagaacacaaaagagacatgccctgaacgatttttggtactgcatggcgtcacgatatggtatcctaagtgaaacataagatgggaatggtgacttcatgcaaacaaaaactttgacacggatgggactattgttggcagttttgattggcttggcctttgcgccaccgatcactgttggctttcttggtgtgccgattgtcttgcagaacatgggtgttatgttggttgcaatgttgttaccaacgcggccagcaacgatcacaattggcatgttattggcattggcagcattaggcttgccagtattgacaggcggtcgaggcggtattgctattttcttaggaccgactgctggtttcatgtacggctggttgttgacaccgatagcatatgcggccataacgcactatctgaaacctgatttttggttaaccaaagtactgggtatgacatttggtggggttcttttgacggaatttctgggtgccgcgtggttagctgcgactaccagtttgggctttgtcccagcgcttgcgagtgttttgatttatattcctggtgacttgctcaagatggcgctcagtgtgttggttgttcaacaattgacagctgtgatcccggccttgcgctagatagcagattcctgcttaaattgaaagtacaaaaaaaccgttgtcggggaaaacttcccgaacaacggtttttattttttcttaatcaacgaataaaagttcaaacgtatgattttttgtattcagattgacgctgacgtgacgattgagatcactgacaaggttgcgagcaaatgccattttttcttcaaaatcctttagcttagcagtgtaagggattgagttgaaatcaaaattttcgccgatgaaggcagcatccgtgacatacttcagattattctgatcgtgccggctaccgggttttaagaccgcatccaagtagtggtaaagttccgatggtgagtagtgcaacggtttggttagatcggtggtaatggtgaagtcaggtgtatcatcggccatttcttcattgacctgcacctgagtgagtccttgatatagtttcaatataggcacctcgtattcttaagagtcattataacatgctcaatgttgggttaggtgatcaagtgcatcctgaaaggcgacttgcgcttctggcgtcgtttcttttgccaaggccgttttaagaaaagtctcgatttcaggattagacgatgactgtaattcaccaacggcccaagctgcagttgctcgaatcattggtcgcggatcatgctcaatgacctcgagcaagtgaggaatggcgctgcggtcatgcaggttgaccagtgcgataatggcattacgttgcagtggttttttgccgcgccaagcaccagccagtttgccaaagcgcgttttaaagtccttgttggtcagcgttaacattggaatcagttccggtaataccgtttccgggtcgggttccatttctggatggatatgaaaatccttgcctttattaaacggacaaacctgctggcagatatcgcagccgtataggacgttgcgaatcatgggccgaaattctggatccatgtagcctttagtctgggtttgataggaaagacagcgttgaccattcatgcgaccgtcaccaagcaaggcttttggcgggcaaaaatcaatacagcgagtacaatcaccgcactgtgaggtcatcggttcgtcaggggcaaacttaatattggtaatgatctcaccgaggtacacatacgaaccaaattcaggggtgatgagtagaccgtttttgccgataaagccgaggccggcgcgttgcgcaacgacaacatcgattaattcacctgtatcgaccatgggtttgaaacgcaaggtaggatcattttccgccgttcgtttgataaacttgataagtgacgccatttttcgatcaagcacagtgtgataatcaatgccccagctggcccgcgcaaatcggccacgtttgggtcctgttcgcggcggtcgctcatggattttagccggatacgctagcgcaattgcgattatactttgtggctggtcaaaaattttatcaggatataggcgttcatcgatattttgatgttcaaagccagtcgtgtgaccggccgctttttgtgcgagcaagctaggtttgagcgcggcaaaattatcagcggtcgtaaagccaattttgtcgattcccaactctttagcatgggctttaatcatcatttttaaatccatcccggtcacctcttaacgtcattgatgtcattattctagccaagttagagtaggaacgcaaagatgccgattaaatttagctattttttgttgttatcagtatcgttaagaacgcagaaagtgatcacgcataattaaaaaagaaaccggagctgaaacaacgcctgtcaaagaacaccgcgcttgcgggactcaacagaggtgttttcccagtttcttgatagatgtgctcaaagatattgtctgattgaaccatcaactgttgtaactcattcgtgtagctttttactgtagataaagttcgcggagatcccgtttttcagcgggggtcagctttaattcgtcttgcaaatagtcgcgcatgctaccatattcagcatcgatcgtggctaaggcgctgtcaagaaaggcacccgaaaccgtgccgagatcttgaatgttggcaagaagagcatcagttgcgccatgcttacgagcagctgccaaattcttttcgaccatcggctgaatgagatcgtttgtcgcgaggtagtcttggcgaatggtatgaccatcaacaccgagggctgaaagtagatataccgcgcccatcccggttcgatctttaccggctgtgcaatggaaaagaacagcaccattttcgtcatcgttacttaagaggatgtcgaagaattgacgataagccttttgtgcagaaggcattttgacgatgtcggcgtaggttttaaccatgttttcaaaacctgcgtgcggatcacgtgagaagctcttttgcaaggcatccgcctgttcactactcttggtttcgtctgttgggaaaaccggcacaaaatggtaggtcgcgtgttctgggtatcgatcgggctcagctgcttgttcttcgggtgagcgaaagtcgacatcggcgatgagcccgtaatcggaaaggtattgcaaatcctggtcagataactcgctcaacttagcagagcgaatgactttctgaggtttgactaattgaccggattttgtcttatagccgccgaggtcgcgaaagttaagtccatttttaatgtcaagaacattgggttccaaatttaattcctccatcgtgaaaacgtttgactccagtatacgcgaaagttgttggtaccggcaatgcatccttaagttttccagctagttgggcattaggctgtgcttttatgagtgagcgagaatgcattgttttcaagggttatacgtgtacaaggcatgtcgactgagcgtatcagaagggacaaaaaaagccgtcaaatgacggctttccttgaagaataactttactcaggctgagcgataattaatccggcaatgaaagccgctaccagcgacttggtgcccgccgcaagcggaacaccattgtatgtcagaactgagttgttgcctaacaagtcctcaacacggattgatggaccatcaccgaccggttgttcgttttcttgcttctgagcatatttatccggataagccacactcaataattcgagcggatctgtattatagtattctgcaagtttgcgaatactccgttcactcggaattgtttgatcgttttcccacttagtaaaactagctggggaagtatgggttgcttttgcaacttcgacgattgattcgccgcgaccctttcggatctgtcgcagcacgctgccaacaccatttgtaatcatatttccaccacatttctttcaattttttttggcgccgaatccttaaattcaagaatgcaagctcactaactttaatatagcattaatgcgtattaaatcaatcataaacccacggaaataaaacatattttaataaataataaccgggttcgatcagattcagtacgcgcatcagtaaagcctgccgttgagtcttattttacagggtcttgcgatagattactatgttaagtgttcaaatttatttcttgtattcgtttcctcggcgttctatgcttaagttaatcagaaagtaaggatgtgagcggaatggatcaagaatatgatcgcttgctcgtaccggtggatggctcgaaggaagcagaattagcttttaacaaggccattaaggttgcactggccaaccgagcccacttggatgttttgaatgtgcttgataccaaacagtttattggcagttacggcggcatgatttccggggatgcggtttatcagttgacgcaagatgcacaggaatacttagataatttgaaagatcaagccaaaagtgcaggtctggatgatcttgatattcacattcggtttggcaatcccaagacggtaattgcaactgattttccgcacgaccatcacaatgatctcattgtgatcggtgcaactggcttgaacgctgtagaacgcgtccttgtcggatctgtcacggaatatgtcaatcgcacggcaccttgcgatgtcctgatcgttaaaactaaataggtaagtgattgtttgtgagccgatgacaaaacttgttatcggtttttttgttaagcgcgaacaggagcggctagaaaacagagtgtaagtgaccagttcggttcaaggtccttatatgtaggcatctgtggctgcgaacgcgttaaaatgaatgccatcctgtccagcgttgcactggtgaacgcatgatctctccttgcaagcatcttcactggcaatccctgccagcgcggcgtaatgtatccgtaaaagagaagcctatgaaagtttatggaggtgctggacaatggtaaaaccaaatgatcacgctgaagaggccaagacagaagcagcattgcagcggtatcaggaacgtaagcgttatacggattgggttgccaaaatgtcaccagctatgcgcgcgtaccacgatcatgaatggggcgtgccggttcatgatgatcaaaagttatttgagttgttatcccttgagattttccaagctgggttgaattgggaactagtcattggcaagcgcgctgcttttaacgatgcttttcataattttgcgattaaacaagtagctgctatggatgaagaagacgtcgagcagttattgcagcggcaagacatcattcgcaatcgtaagaaacttgaggcaacaattaccaatgccagagctgtgttaaaaattcaggcaaagtatggcagccttgatcactatttatggcattttgtgaacggcaagccgttggtcaatcgacctaagtcgcgtgcggaaattccgaccaaaagtgccttatcggtcaaaatcgccaaggatttgaaaaataacggctttgcgttcgtagggccggtaatcgtgtataattatttgcaaggcgccggattaattgatgatcatgttgtgatgcaggactgatccgaatcggcccaagagggagcaagactggtgaagcgcgtccgactgtggggaatttttctagcaattttagggtcaagcttttggggaatctctggcccaattagcgaggccttatttgatcaaggcattaaagtttcatggctgattagttcgaagatgattatcgccggaattgttttgatgcttgtggctttttggaaagagcgtaaagcgattctagcaccttggcggaatactcgtgatgccttgcagctaattctatttattctgtttggcatgatcgggatgcagtatatttactttaaggcagttgcagtagccaatgctgcaactgccacgattttgcaatatctgtcaccagtggttgtgttgatattcttagcgctgcgtttgcgcgaaaagccgcgccgaattgatatcgtgacgatttgctttgccatgatggggacggctttggttgttaccaaagggcattttactcatctggccatttcgccgaatgcttttttctggggtatcatggcagcattggcggcagcggcgtataccttattgcctgcaggcttgttgcaccgccactcgccgattgtcgtcacggcatgggcgcaactgattggtggtttgttgattgacgtatttgatcctttttggaaggaaataccgcatttagatcacgcaggttgggctggttactggttcattgtgatttttggcaccatcattgcttattcggtttaccttgcgagcttgcagttcatttctccgacggcagccacgttgctagacgcctttgagccgttgggtgcaacggttgtttcagtcgttttcttacacatgcatatggggtttgcggaaatcttgggtggcgttattattattttgacagtcgccatgatggcaatggcgacgccgcatggaccgaagctggaagatcgctccccggactgagcgatcatgccgcatctggcgccatcaaaaaaggatggtgcattgatacacaccatcctagccaattagtaaccgttcatcagtggctgttgcagcaaccgaatcagctcgcattcttggccatgaggttcgggatcacttgctgatgttgatttcggcgcagtgcaaggatatagccgtttttaatgcgtaattgataggtcacaaacagtgacagcttgataggtcggcctaaataatcgataattggatatggctcgcgattgctcagcatcatcctcatctcccactactattatataacagtatgtgtaacaagtttatgacaatcccgcttcgccagacttgaagtccatgctatactggcgtaagaattagcaacgaatatggaggcacaacatggatcaatttagtatcagtaatttagcagactggcttgaggcgcataatgatgacctgatggccaagaaaacccagcttgaccccaacaaagtatacgcaattgtggattatttgaaggtgctcaagaagccagctgagaaatacttgcatatgaagcaggccgattattatacaactgaatctgatcacaagttaaacttgccagatgacaatgcgccattgaccgccacccatgaccgtatcatggtcaaccatgtggatggctcaatcaaaaatgatcagttgaattttacatacaatcatgaacctgtttttgacggtgggtataccccgcagcgtgacttgaatattgttaagtacgggcttgaagtgattggcgcagtcgcaaccagcggccatattgagacagtcagtgcggcactttcaccagatgctgtgttgaccttggtgcttgctgcgacggccttttcaagttatcaagcttagttatggcatttctggtgtcgccagccagtcatggtcggttaattcatggtacttctttgaaacgggtacccataaacgagctttcaggatagcgctgatgctctgccaaaaggcggggtcatcgcgctgtttttgattggttgtaattgtgatcgggacgccggtttcagtaatggcgttaatatacgggtaagcaatttgttgtaattgggttgcgatgacatcagtttgattaatcaacatatgcatcatccttctttcgtttgttgataaaatcagcataacaaggggctgtggcgttggcgggatgaatgtgcggtgaatttgggctttattcgtgacgaagttgtggcgctttcattaagcaatgattaagtgcctgatcagcaaagccttggttaactgcagtaaaaaagacaagcaatagtcgtgatcatggcttgtcttttaattgggggaaattaacaataagttgcgtaatcttgatgtaactggtcgcgtaatgatttcttatcgacatcaggaatgaaagctgcatcaatggcgtttaaattgaatgctaaaaagtcagctgctgttgtaccaaaagcttgctgataacgctgatattcctgggttaacgtggtattcgagactgttcgattatcagtgttaatggtgattttagcaccagcttttttaagcgcctgatacggaaactcagcaagtgtacgagcggctttcgtttggaggttgctcgtgaggcaaagttcaactgtggtgccagtttcaacaattttctcaatgagtgccggttgatcaaaacaagcggtggcatggccaatccgcggaatgccgagtcgtaccgcttcagcaatgttttgcgggcaatgacattcgccggcatgaaacgtaagcagcacgccaagtgattgagcagttttaatggccggcgcgcacacgttcgttggaaaatcagcctcgttgccggcaaagtcaccgccgacgagtgttgaaccaagtagcggggcggtggttttaaacattgtttggttatcggtgttgggcaactgtcgcatgccacagactaaggctttcgccatgatgtcatatgttgccatgccttggtgtaagccttcgatgacggcttgcgttgcttcgaccagcgataatccgcctgctagggaaaatacgggcgcaaagcgaatttcgatatagcggacgttttcttcagccgcttgttgaacgacatcgtaggcggcgagttgcaaggcctttttggtttgcagcaagggggccacgaagtcgaaggctttgagataatcacctaaattctcggaatctgctggtgcctgaaccagtcgtcgcagctcgtcgtcagtcgccggtaattttcggtcgatcattttcgcgagctgacgaatgcaacttaacgacaatgagccgtctaaatgacaatgtagttcggttttgcttagttgatgtaatgtttgaaagtccatcgagttttcctcctaaacaagttcgcaggcaataaagagtggtcggcatgaccgaggggtgattggttcgcgtctttttaaacccgtttaccagcccagagacctgcgtataaggaccctgaacgcaatgacccaaacccggtcatcacgttcaggcccgcttacactccggtttctgaccgggctggttcacgctctgattgtttagagtttaacataggcggcgcgtgacgcggtacaatggaatgaataactgggaaaagggtgatgagagatgcgcatggtcgatttaatcacgaaaaaacgtgatcacaaagctttaaccaatgaagagctcacttggatgattgaacagtatacggcaaaagcaattccggattatcagatgagtgcttttctgatggcggtttattttaatggtatgacgccagaggaacgcagccattttgcttttgcaatgctgcattccggtgacgtacttgatttgagcgatattccgggtattaaagtcgataaacacagtactggcggtgtcggtgacaaaattagtattcctttggcgccgctggttgcgtgtctaggtgtgccggtgccgatgatttccgggcgcggtcttggtcacacgggcggtacattggacaaacttgagagcattcctggctttaatgttgcggaaagcgaaacccaattcaagcagcaggtacagcaaatcaatgaagccattatcagtgcgagcggcgaggttgcgccagcagatcgacggatttacgctttgcgcgatgtcacaggtacggttgaatcgattccgttgattgcggggtcgatcatgagtaaaaagttagccagtggtacgaatgccttggtctttgatgtaaaagtcggcaatggcgcatttatgaagaccaccgaagatgcgcgggcgttggccaaagccttggtgggtatcagcaaaacagctggggttaaaagtgtggctttgttgacagacatgagccagccgctgggcattacgattggtaatagtctggaaattgcggaatctattgccattcttaaaaatcgtggtccgaaagatgtccatgatcttaccgtcgcgttggcagcacagatgctggtgcttggcggcaaggcggcaagtctagagattgccagcggcttagccgaagatgcgctgcgtgacgggcgtgcgttgaatgccttcaagcaattgatcacagcacaaggcggggatgcttcagtagtggatgatccacgcaaactgccacaagctaagtatcgaattgctgtgaaagctgccgaatctggcattgttgaccaaattgacacaaatgctcttggtttggcagcgatgcaacttggtggcggtcgagcgaaaaaagatgatattttagacttggcagtagggcttgttctgcataaaaaactggggacacctgtgaccaaaggcgatacgttggttacgctgcatgccgacaccgagaacgttgacgctatcagcaacatggtcagaagcgcttatcatattggcgataaagcgccgaaaaaaacgccgctgattcaagaagtgattcgcccctaaatacgttttcattcttccatcgttttcaaaggtgttttcaaaatggttttagctaatatttgtttggtggccgaaacgccgtcaattaagcatacagctgcatatcataacagttttgacttgatgttgatgctgaaaagcattatttcaatgctattttttgggtttttggtttttaaaaaataaaactcaggggtatacttagattggaatcaatctagtaagggaggaaaaacatatgctattggcaatggacgtattatcgctagctcgttttcagttcgcgatgacgaccgttttccatttcttctttgtgccgttttcaattggtatggggcttgttaccgccattatggaaacgatgtatgtgcgcaaaaagaatgaaacatataagaagatggccaagttctggggcaagatcttcttactcagctttgcggttggggtcgttacaggtattattcaagaatttcagtttggtatgaactggtctaattattcacggttcatgggtgacatctttggggtgccactggcgattgaagcgttactggcattcttcatggaatcgactttcattggtctgtggatgttcacatgggatcgtttcaaaccggctgttcacgctatctttatttggatgacatggctaggtaccacgctatcagccatttggattctgtcggcgaatgccttcatgcagcatccaaccggttttgcgattaatcaagcaacgggtcgggttaaactagtcgactttggtgccgtgatcacgaatccgcaactgtgggttgaatttccgcatgttattttcggtgcctttacgacggctggctttgctgtagccggcatggccgcatggcgtttgcttaaaaaagatcaagttgacttttacaagaaatctcttagagttggcttgattgttggcaccatcgcttctgcatgcgcaatcggttttggtgatttgcagacacaattcatcattaaagatcagccgatgaagtttgcggcaactgaaggaatttataaagataccagtgatccagcaccgtggacgcttgtcgaattaatcaatactaaagatcatacgaccactggcaacattgaagtaccatatctattaagtttgctgtcgtatcataaaatgaacggcgcagtcaaaggcatggagacagctaataaggagcttcaagctaaatatggcaaagacagggactattatgtgccggttaaaaccttgttctggagcttccgggtcatggctggcggtggcgttcttctgttcctgctcggcgttctaggtctctggtttagccggaagaagaaagataccttgcttaatcagcgttggctattgtatattctcggctttgcgctgtggctcccattcatcattaatacggctggttggtttatcactgaacttggccggtatccatgggttgtttacggcctgtattcaattgccgatgcggtttcgccgacaacgacagctggacatttactgttcactaacatttgctacttcttgatcttcaccttgctcggcggtgtcatgatttattactcacatcgcgtgcttaagaagggtcctgaaggcgatctgaacactgactacggggtcaacagtgatccgtttgctaaggaggcgttcgcaaaatgagctggttacagattttgtggttcttcttattgtttgtccttttcagcggcttcttcgtccttgaaggctttgacttcggggttggtatgtcaaccaagctattggcgcgtaactctgacgaagaagatcaactcgttgccacaatcggcccacattgggatgggaacgaagtttggctgattacagctggtggcgcgatgtttgcctcttatccaatgtggtatgccagcctcttctcggggttttacatcatgttcttccttgtgttgttcggtttgattgttcgcggcgtgtcgtttgaatttgctgcacatgccgagaccaaaagaggtcggaatatctggcgttgggctttggcttgcggcagtttaatcccaccgttcatcttagggatgatttttaccgcgatcattcaaccgttaccaattaccaaggctggtgatgtttatcctactttaggtaatcaaatcaaccttttgacaattgtcggcggagttgcggtcactttgatgatgctcatgcacggtttaaactttattcgtctgaaaacgactggcgacttgcgcaagcgtgcgcgtgactggaacagcaagttgtactacttgttgtatgctggtgaagttgtcttcgctgtccttctattctttatgaccgacttcttcaaagaacgcccaatcagcactttgttgattttggttgtgattgtcggctcgacagttgccgctcatgttggcgtgcttaaagataatgaagtgttgtcatttgttggcagtgccctagggcttgtcggggttgtcggtgtgattttcaacggcttgttcccacgcgttatgattggccaagatgcggctatgtccattttggcaaaagacgccagtgctagtccgttgacgctgaccattatgacgattgtcgctgtgattctgctgccaattgccttggcatacttcatctggagctatgtggtcttccacaagcggattcaagcaaaaggagcggttagtgaatgatcgataagacgctcatgcgcctttcgggaatgaaacgaattatgacaatgcttgccgggtttgcgctcgtgcaagcttttgttattttattacaaggaaaatttcttgctgaagggatcgttcattcttggaaccggcaaagtttagctggcttatggcttccgttaggactttttgcgactgcctttgtgattcgtcagctcattgtttgggtgcgcaatcgcatcggggcacgatttgccatgactagttcggcctggctacaagcccaattgctcaagcacttgtatgcgttggggccggctgccgttgccaaggaaggaaccggtaatttggtcacgatggcgctggatggcattcccgaagccgaaaattatattgaactgattttgaacaaaatactgaacatgagtattattccgtgggttttagttgcctatatttggtacgaaaactggctaactggcttcaccttgctgatcatgtttccaattatcattttgttcatggtgattcttggcttggcagcacaggataaatctgaaagccaatatgctgggtttcaaaagatgagcaatcatttcattgactccttgcgtggtttaaaaactttgcagttgatggggattagtcggcaatacgcgaataatgtgtacgatgtgtcggaagactatcgaaaacaaaccatgggcgtcttgcgcatcgcgatgctctcaacgtttgcgctagacttcttcaccaccttgtcgattgcagttgttgcggttttcctcgggatcaaattgatggatggcgcgatcccactctatccagcaatggttgcgctgatcttggcaccggaatatttcatgccgattcgtgattttgggactgactaccatgccaccttgaatggcaaaaatgcgatgaaggcgatttggcaagtgattgatcagccattacctactgataccaatgtgttaccggctttttcaaggtggcaggctcaggatacggtaaccattaaccacctcgatttcacctatccaaatgaacgcgcgggcattcaagatgctaatctgcagtttaccggcacggaaaaagtggcgattatcggtgctagcgggtcaggtaaatcaacattactcaatttgattggcggtttcttgcagccgcaaaaagctgccatgacggttcgaggaacgaaggtaccgcatatgacccaagcagcttggcaagatcatttgagttatatcccacaagatccgtatctatttgcggatacgatcgctgccaatatccggttttatcggccggatgcgtcagatgaagatgtgaaacaggcagctgaggcggcggggttgagtcattggatcgaaactttggcagacggctatgcaacgagaatcggggaaggcggtcgtggtatttccggcggtcaggcccagcgaattgcattggcgcggactttgattgatacgaatcgctcgatttggttgtttgacgaaccaactgcccatttggatattgaaactgaagccgagttaaaagaaacgcttgtgccgctgttcaaaaatcggctcgtgatttttgcgacccatcggctacactggctcaatcaaatggatcgcgtgattgtggttgatggcggcaagatcattgctgaagggaccccaagtgagctggcggcacattctaagccgtatcaggcccttgtgcacgaaatgcgaggtgaattcaatgcattggttgaaaaatgagcactgggttcgcccagacttgaaacgctatcgcggcttactcttctggtcgttaattctgggggttatgacctttgtctttgctggtgccttgatgttcacgtcaggttttctgattgataaaagtgccacgaagccattgtttgcagctatttatgtcacggttgtcttgacccgcgcttttgggattgggcgaccggtgtttcaatacattgaacggttgaccagtcataactgggtgttgcgcattactagccacatgcggcgaaaattgtacaaagtgttggaaactgatgctgcctttgtgtccgaacatcatcaaaccggtgatattctaggcttgctcgccgatgacatcggtcacattcagaatctatacttgcgaatgatttttccaactgtggttggcgctggtctaacggttattgccaccttgttgctaggctggttcaactggggctttgcactatggattatgttgttgctgttgtttcaagtattgattctgccttggtggggactggtagttgagcgttttcgaaaggcagaacaaaagcaattgaatcatgatgcctatgtctcattgacggattcagtgctcggtttgtccgattgggtcattactcatcgcgaaaaggattttatgtctcaaagtctggcggcgcctaaaaaattggccgcatcgacggtgaagtccaagcggtttcaatggcgccgagactttgtcggccaactgctgtttgtcttaattgtcattagtatgttgatctggacaaaccttgagtggaccggtaatcaagcgagtgctaactgggttggggcgtttgtactggttgttttcccactcgatcaggcgttttccggcatcgcacaaggggttggcgaatggccgacataccgagatgcgattcgtcatctcaacgatttgcagccggtcacgcgacaattaccgcaacaacaagcagtaccgactcagttcaaagagatgacattgcagcatctcagttttcaatacacgccaaaagatcctgaattgattaccgatattgatctaaccgttcacagcggcgagaaaattgcgattctcggacccagtggcatgggcaaaaccacgttgttacaactggtacttggtgacctaacgccgacaactggcaacgtgttggtcgacggtcaagatgtcctgacttatcagcagcatcgcaccaatctttttgcggtgttggatcaaagtccgtttttattcaacacgtcgattgtcaacaatgtccgcttaggcaatgagcaggccagcgatgctgatgttgccgctgctcttaaggcagtcaagctagaccagctcgtagcccaattgccgaatggtattaacagcagtgtcgaggaagcaggtttcggcttttcaggtggtgaacggcaacgtttgtcgctagctcgaattcttttacaggatgcgccgattgtgctgttggatgaaccgacagtcggccttgatccaattacggaacaggctttgctggagacgatgttcacagtattgcaaggcaaaaccattctttgggtgacgcatcatttgcaaggcgtcaatcaaactgatcgcgtcatttttcttgaagatggccgtttgacgatgaatgatacccctagtcacttggctaagaacgacgagcggtatcagaacttgtatgctttggatgcggggctacggtgaaattttgataaaccaaaaagggtgcttctcatgacgagaggcgcccttttttggcgatattgagtggttaatcaggaggtgataattttaatgcctgtgtagatgttgtagaccacaatcccaatgtcaacgaccatggcaacaagtagcaagataagtgaaacggcggatgttgcattgatgctgttcgtgaagaaaccgacaccggcaatgatcataaagataaaaatgctcaatagggtgggaataatatgcagccaaagtgcgtgtttagctgtgtcccgtgtgacggaaccttgcggggtgaaaatccaaacgagaattggaaagagaatgggggcaaaaatgaccgagatataagacaacccgcgtaaaactttgtgttcattcgtcataatagacatctccttgtaaatgtgttcgctggcgcagaaatctgcacataagggccacaagcccaatgaccaaaatcgggtcatcgtacttgtgccagcttatgcttcggtttctaaccgctccagctcatactctgtttgtaaacgtgttcgtcggcgcaggtttctgaccgcgccagcgcaccttttttaattagcgatttaattttgctaaagctgctttaggaaccttttcctttggtacggcttcccaactaatcacttggtttcgacgtgtgctgtaatcgaggcggagataagcttgcattttcaaaggccgagatttgtgaccgttgaaatcaacctctgtaccgtggcctttttcatcataggccatctgagtataggcataatcaatatcccgcgcagcaccggtctcatcatcgataacatcaaacttcttgcctgtcgtcgtaatctgggtgtaataaggggtgctttgagtataccaagcgtaaaaccctgcaccgccaagaatgacgaggccaatgaagatgccaataccaatcaagatttttttcatattcatatcccctcccaaacggtgtatatgcaacttattgtataaattataacaataatatcattcattcgaacattaaaatgactcgattaccttataagaaacccttgttaaacaaaaggtcacgtgatgcggatcagaagcaaggtttgctataatgatgacattgatataacgattatagaacgtgaagggtgaacgtattttgaatagggatgggaagaaaaaattgaatcgccaaaatctcatgattttgattgtcgatttggtactcattatcatttttattggcggctttggctgggggattgggacggttaaacgttaccaagttgagccgaacacgtcacggacagagaccaacactgacagcttatattcagaaagtcgcttcgaaaaaacgctgcaaaagtttaaacgcttggatttaatggttcgattaggccctgttaaagacgctaaaacatttaactatacgccagacgaattcaatgttaaatatagcagtcagccgatagtacctggtctaaaggcaacgaaaacactcaatgctgaaaccggcgaagttgaagtttgtacaaccatgaccccacaaggcgttacggtggccggtgattacttattaaccacagcatatgatcatgacggttttcataactcagtgatgtatattcaggatttgaaaactggtaagttgcttaacacagtggtattgaatggccgtccccatgttggtgggttaacttatgatgccaagaacgataacatttggatctgcggacgccggaacaatgcggctgaagtttttgcaatcaagctaaaaacagccttgacttacaatgttgataagaaagccaaggctgtggcttattcgcagcgcgcccaacttggcaatattagccgagcttcttttgtcacttattacgaaaatgcgctgttcgtcggcttctttaatccaactggaaaaggtaacattcaacgctatcctttaaatgataaggggcaggttgttgggaaaagcctcacctccagcatctcgaatcaatttgacgtgttaacacaatccgttttgcatcaagacattttatcgaaaatccaagggatggccttttatggggattatacgattctgtcgcagtcttatggtggtggcaactcgacgttatatatctttaaaaccgatcctaagaagaccatcttccgcgctagtgatgcgattgacacgtttgatatgccttcgcacttagaacagatcagcacgcatgatgggcggatgtacatgatgtttgaatcggcggcgtatgcttatcggcatcgcagtaccaatcaattagaccgggtcctctcaatgaacttggaaggcttcgttcaacttgtgttaaaggaggagaaataattggacgcaacaaaattagctaaacgcaaacaatggccagttccttttagtcaaactgaaccgcattttacgttcaataactggctgaagttcttctcggttgttttgtttacctatctgctcttttatacacgcaatccgattggcggatttttcaacatgtccggcaccacttttctgaatgttgctaatggctggactcgagccgttgtcgtgttcggcggcgttctttactgtgccatcatttttgctggcgctgtatgggcagccggctgggatggcttgaagcagctttttgcaagttttcgttggcgggatatctggtatgttttcgtttatggcattttgtacctggttgcgaccacacttggcgggattcttggcgacttggtgccaattcggtttggcgttgattttgtcaatacgctggaggccgcccagtttggtaacttaggtccttttagcctcattagtttccgcgcctttttcatgacgcttgcaacgcaattaactgcggtgatgattttcctagctagtcaacagttatttagtcgattggcgattaaacatcggcgttgggcattgtttttaacttatctcttggcgctggccgtaacggcggttgtgacaactacaccgcttgcaccgcatgtctttgtcaatatcgccagcgggttggtcgcacagctgccactatactgggtctatcgacgttcgcgtaacattttggtggtgacgctgagtgcatttattttgatgcacgtcatgatagggctggcagtgatgctagggtagtgatgttatcgaccggtatcgactggtgatgacggtttttttgactgatttttatgataaataggtgattattagaacttatgaattgaaaacgattacaacaatcgccatactaaagatgtttcaactattgactggaggtctaagcatgacaaagttaggtaaaccatatggcattggagtcgatatcggctcaaactcgattggatttgcggctgtggatgagaacagtcatctgattcgattgaagggaaaaacggttattggggcaagactgtttgaagaaggaaaagcagcagcggatcgccgagcaagccgtaccactcgccgtcgtttgagtcgaaatcgttggcggctcagttttttgcgtgatttttttgaatcgcatatcacgcctactgacccgaatttcttcatgcggcaaaagtactcggaaatctcgccgaaggacaagaaccgttacaagtatgagaagcggctttttaatgatcggacggatgctgagttttaccaacagtatccaacgatgtaccatttacgcaatcggcttttgacagatccaagcaaagccgatgttcgcgagatttattttgccattcatcatattttgaaaagtcgcgggcactttttgacgcctggggatgccaaagattttaatacaaacaaggtcgcgttaaacgagattttccctgcattgcaggatgcctacgctcaagtttatccggatctggacatcacttttgatgagaacaagatgaatgagtttaaaacagttctgttgaatgagaaagcgacgccaagtgacacgcaacgagctttagtcaatcttttgttggctgaagatggcgacaaggatatattgaagcagcagaagcaggttttaactgagtttgctaaagcagtggtcggactgaaaacgaagctcaatgtggcgctagggaccgaagttgataattctgaggccactgcttggaacttttcattagggcagcttgacgataaatgggcaggcattgagtcagccatgactgatgaaggtaccgaaattctggaccagattcgtgatctttatcgagctcggctccttaatggtattgtgcccgcaggaaagacgctttctcaggctaaggttgatgattaagcacaacatcatgaagacctcgaattgttcaaagactatctaaaacaacttgaagatgatggaacggctaaagcaatccgacagctctacgatcgctatatagacggtgacgatgctaagccatttgtacgtgaagattttgttaaagcgttaactaaagaagtgacggctcatccaaacgccaagtctcctgaactgcttgaacgtttggcgcaaccggacttcatgcttaagcaacgcaacaaagcaaacggggctattccagtccaaatgcagcagcgggaattggatcagatcatcaaaaatcagtctgtttattatgactggctggctgcgccaaatccggtggaaaagcatcggaaaagtatgccttatcagttggatgaattgcttaattttcgaattccgtattacgttggaccattggtaacggctaaagagcaaaaggcagcacgaggcggggtttttgcttggatggttcggaaagatcctgatggtaatatcacgccttacaattttgacgaaaaggtagatcgcgaagcttcggctaatacctttattcagcggatgaagacgaccgacacttacttgattggtgaagacgtgttgcctaagcaaagtttgctgtatcagagttatgaagtgcttaatgagttgaacaatgttcgggttaatgacaataaattaagctcctcaattttcaagtcaagtgcaacgatgataacgaattcttgatagtggtcgaagtaccaaggaccctgcacatttaaacgaaactttgttcagttttcaaaggaccactttgtcgccaagcgacaactcattaagaatatcaaattggcaactcgttgtcaacatctttttttaaatcgctgtgcggtttaaactgtttttatgactgacaactcgtactataatacgcagtttactcactcaagtcaaccactttttaaaaaaagtttttcaagaaaggaaaagcacgcactatgacagaggatcaagctttttggaacgcatttgcgcctgattatgccgcggcagagcaggcgtcgcgtttgcctatcgcacacgatgtcatcgcatggctgcgttcaacgcaattgctgcctgcgcattcggcagtcgacttagccgccggaactggccgctacgctgttcaaatgatgccatgggttcaggaactgacgctcattgattggtcgtctgccatgctcgcctttgcaaaagagcgcatgcatcaacaagccgatactaaagctcaatttatcgtggctgactggcgcaaattacacaagccgcttaatgccgatatgttgtttgtcagccagttgccgacacttaaacctcaagacctaaaaatgctgatgaactgggctagccaaaccgtggtgcttaactttcaaactgcacagtctgacgctttgcttgaacaagcggcctcgcttttaggattgcagctacaaccagtttatcaggcggaccccgcccggatgacgagcttcaaggtttggctgacagcgcaacggataccttttcaaagtcattctttgacatacgaaattgaagagcaaacaactttaagcgacttgttaccggatctggcgacaccaattggtcttaaaactgctgccagccttgccaagaccatcaccggccatgagaatacgcatgttcaggtgactgatcggttgacttatacttatacccaactggtctggcatgtttaatcaccacccattcagtatgctcgaaacacaaaccgaattatccaaatttcgactaaaaaagacttgctgccagtatgaacgttcatacagcagcaagtctttttatagataacagcataaacatcattgatggtcatgcccgtcgattttttcgaaactttaagctttaacttgcaactgttcaacgttcacaactgtgtcaacccaggaactatcatagaagccggcttcatgggaaactagtaaaactgcgctaggatattgttgcaagccttcacgcaaagcgtttttggtgtcgtcgtccaaatgattcgtcggctcgtccatcactagaatattagtcgtttggagcattaggtcagccaacttgaccttagcctgttcgccccctgacaacatcgtcagaggattgttcgcctcttcactggtcagtgcagtgcgtgataagacctgtcgaacggttttctgcgttagcgctgggaaccgttgctccaaatactgcactgggctttgtttaggttgatcccagtgcaactcttgttcatagtagccaaaaacaacattgtcggctatttcaacgttgccactgatcgccggtaaaaggccgagcaatgtttttaacaacgtcgattttccgacaccattgaagccttcgaaagcaatgatctgatcttttgcaaccgaaaagttcattggttgtaataatggcttgtcatagccaacaaccaaatcgttaacatccagcaagatttgtcgattaacaggcgcatacggaaacgccaaatgcgccttggatcgcgtcccaggaggcgtcaatttgtccattcgcgccagctgcttttcacggcttttagccatcgtagcgcgcgtgcctgccttaaacttccgaataaacgcctcagttttcttaatcgtctcttgctgcttggcaaaagccttcaaataagtctcatgatcggcctctttttggcgcatggcttgttttaacgttccggtgtattttgtgatttgcccgaactcaatatctaagacagcattggttacattttctagaaaatcataatcatgtgagatcacgataaacgcgccctcataattttggagccagtccgttagccaggcaatatgcgacacatcaagatagtttgtcggttcgtccaggagcaacatatccggcttttcaagtaacaattttgccaagattaacttcgatcgctggccgccagacaatgcttcaacaggatgatccatccccattgctgtaatcccaaggccttcagcaacagtttgaatcgttgtttccagatcataaaaatcgcccgcttcaagctcttgttgcagctcgcctgctttggccagtaaatcgtcatcgggatggttagcataatcggcataaatctgattcatttttgcttctttacggtagagatcactaaacgcggtccgcaaaaattcaataactgtttggccgggtacaagattcgcatactgatccaaatagccaacatgtaagtgcttctgccagacgattttacctgcatcaggcgtcagtgcccctgtcagaatcttaatgagggtactcttgccgaccccattttgcccgatcacgccaaggtggtcttcgatatttacttgaaaactggcatcttggtacaacactttgtctaaaaagcgctgtgacaggccggttacggtaagaacactcatgattcctcctatactaaaacgtataaaaaacgacagctgattggttgcttagagcgtttgctgaaaccacttcgcaagctgtgacagtttgcatgcgggtggcctcaatgccaattgacacaatgatgacactggctctggctcccttattcacgctctttctgaaaatagtcactgcttgctaggctatcacagcatggttattttcacaacggggcaaattttttgcaattttatgcgttctagcgaaataatagctccatagtaatatcaaagaatttatatgtggtctgccctttgacaaggttaagtgtgcttcggatgacctgagaaaatgtcaaaatcacgacacgacatatatagagggggaactaaatgggtatcatggaatcacgcttgattcacggcaccgttggttttgcgatcggtgatgcgttgggattgccagttaagggacaaaatgcggctgaattagccgcagcaccggtgaccaccatgaagggttatggcacctttagccaacctgctggcacctactctgacgaaactggactcgcgttagccggattagatgccttgcagcacggttttgataaacaagccttaatcaaggcttaccaagcttggttcaccgcgggtaagtatgctccttatggcaaacgcagtccggatatctggccaagcattgaaacagcacttaaaactggccaatcagttgccgcccccaaagaacccggggcactcattcgaatcttgccattcgcctttttcgcctatcaaacttttgacacgagtcttttccaaaaagctgaaggtgttaaggtgcttgaaacttttgttcatattactaaccaagacgctgaaaacttggttgctgctggcatttacatgcaaattgccgttgaattacttggcgcgacgccagatttaccgagtgccattgccactggtatcgacaaagcaggtagttattttggaaccacgcagccttaccagccaatttttgaagcttttcaagcagccttggcagatgataaatggcctgatgggaatgctaccgatccgatcagtttgttagcacgcacacttaaggcactgcaaagtaaaccggactatcacgatgccgtcttacaaaccgtgaaccaaggtggcgctaccgatacaactggcgcgcttgttggcggtttagctggacttgcctacgggtatacaagtttgccgcatcgttggtgcctgatgttagccgaatatgcgcaaattgtcgatttatgccggcaagctgaaaatagcggctttttcccaaaatacgattaaattgaccggtgatcttcctagtcgcgagcgttcggcttgtggtagactgaagttattctgttccggaaggtgtcattgtgaaaaataacagtcattccaccttaaaaacggtgctcgaattccttgtcctttttgccgttctcttctttgccagtcaactactgatgcgctatgtgttgagcaaagatgtggtgcaaggaacttcgatgcaaccgactttggaaaacggcgatcgtttgtattctatccgcgtcaaaaagcctaagcgaaacgatatcgtggttattaatgcccctgatcgtcctggttctctctatattaaacgtgtcattggcatgcctggtgacaccgttagttcaaaagataatcaattgtcagtgaacggcaagaagattgccgaaccatacttgaacaaaaagtttgccaccgacgagattaataaatgggccagtcagcagggacttgatgcttcaacgattaaattcaccaatgacttcaacatcaaaaccctttcctcaacgaaatccgctaaggtaccagccggcaaatacttcgtgatgggtgataatcggctagtatcccatgacagccgcgattttggatttgttgataagtcaaaaattcaatcagttgttgtttggcgctattggccattgaatcagatgaaactttactagtctgacaaagcactcaaaagcaccgccagtcgttaaccttttaatggttagcgactggcggtgcttttggttgtcactaccggagctcatacataagtgaccgagcctaaacgagcttgattgatctgcggtcgttttcgcttttaggcttgcttcttgatggttggcttgctttctataatgcgctcgccgtcgcagaagcctacacataagaacctcgaacctaaccggccatttaggttcgaggccacctatgttccggtttctaaacgcgctggctcgcgctcactgcgattttaaaacctgccgatcgatcaacctgcgtagtttggtttgaatggccatcatcgtcatgcgatcactgtctttaaatgcttcgacgtaacttggcgcatcggtgcttatgctggcggctgggtggccatctaaatcggtaatgttgatagtatcaccgtcaatcttagccgtgaagtaactgccctcgaaaccttcatcaagcaaccactgagcccagttttgaatattttcagcaatagcctgatctagcggtactttatcttttaaggcggcttgccgagctttcacttcggcaagtgtcatataggcttcagtttccatcgtcttttgcctcaccttcaaaatgctaataccgatatacaattcattttgttgagatcgcgctcagtataccccgtctcgcagctggcgacaacgattcagctttagtcatgattgagccgcttgagccgcgatcttgtaagcgcgccgattttcataatagttagcgtgaaccaattgcaagtatggattgatcgcccagtcaaataaatggaccgtgatgttttccagaagataccaaccgatcatggaaacatacaggcctaataaatcgcctttgaagccgcgcatcagtcgccaagaaccgatcaacgccgatatcgaggaaaagcgctgattggtttcatgaccatctttaaagacccaaaaggcctgacgccagcccaatgcaagtagtattccaggaatcaagaaaaatgacagccccatcaacgtcaagaaatacataaagatccataatgagatggcaccccagaaccactgaccgttaaataggcctagcagcgcatgcagtggttgaactcgctctttacggcgtacaagatctagcacgccaaaattgaccccttgaatcagcatcgtattgaccaagctttgaatcgtattcatacttccggtacgattgccactttgcagataattctggaatccatctggatcagtcaaagctttgtcaatgccgaatttttgaattaaggcgaagaccatcaagtacgtgatgatagcgacagctgcctgaattaaactcggtaacaaataagccagcatcaaatcgcgccgattcgtgccttcttttaattgcccttttgctttttgcttaagctggcgataagtcattaaatgttctgtcaacgcccgcgcctccaatgatcagtgttcaatcttaattgcctctttcttagtgatcttttctgttcgtcgtgcgactcgtaaaacttgatgaatccgccaaagcgcatatagctgctgcggaaccgcaccgatgatccccaacgattgggtcgctgagtctcgacgaacaacatgatgataagctggatgcccggtgtaaagaaaccggtgagtggccatcacgtaagtcgccgtgaacagttcatcttccataattgtcatgctttcatcaaaacgtagccttacttgctcgatgacatcacgtcgaaaaactttattccataaataaccgcgaatataaccaattggatgaagcatttgccgaattaagccttcccgcgtgagctgcttaggcttgcgtaaagcctcatgcactggtcgcgggtcaggatcatcccgataaaacggcatcgcaatgagatcccaaccacgcgccatcatgtcaacggcgtgagcaataaagtccggctcgtaccagtcatcgccatccatgaaagctactaaatcgcctttggctagagccaagccgctgttgcgtgcagccgaaaccccatgattcacctgcttcagaatcggttgaatacgcgaatccagttctgcgaaatgcgcaatgatctgcggagaatgatcttttgaggcatcatcgatcacaatgatttgcaaatgagaataagtttgttcaattaagcttttcaagccgtgagccacataggcttcaagattataaaccggcacaatgatggtgacgagtggctttaccatgaacgcacctcctcactcgtgcgaatccccggatcatttattagctgttgaataggtatcaatccctttttagtcaagcagttgttagtcgccgagcagaaactgtgtctgtggggcaaaccattgcttgtgcgtctgcgataattttttatccgtaataagcgtggtaatctggccgagttccagcccgcgataaggcgcttcaatctgaaacttttcggtttcagaaaccacgaccacccggcgtgctgataacgccgctgcctgcttcacctgagcatcttccatataggaaaagtaaaccccatcttcggcaatagccgttgcaccgataaatgccgcatcaaaggcgattcggcgaagtgtttcaagcatcgttggttcaaagaagaaccgggcgtgatgatccagtttgccaccaaaaagatgtaaattaacacgttcttcaactgagagtgcgatcgcattgtctaaactgtgcgtgtaaactgtcaccggttgtcgaatggactgcgacaattttaataaggttgtcgaatcatcaatgaaataaacgccgccaggtttgattaacgtcaatgctgacttagccatctttgttttctgagttgaaaatcgtttcagccgcgcggagtagctgggaatcgtgtgaccaaagctaagagacaccaacccgccacgagttcgtctcgcaacgccttgcgcatcaagcgcaacaatatctcggcgtgcggtatctcgtgaaacaccaaccgccttcataatatcctcgatactcaactcgctgcgtgctgccaacagtttttttatctcttcaaaacgtttttcccgatacattgccacgaattcggcctccttgacagttcagcttcattatacctgattctcaaaaccaccgtttaggccagtcattgaattgtatcatgaacgatcagagttaaagtttaggctcccataaatttccaaaaaattcacaaattgtggtagaaaattggccaatatcatagtaacttcaaggtctcaacccactttttcgagaaaagttcactgattgttacgaaaaattttaacattccgtttgttacacgaacgtaacaatattactgaattgagtatatttgtaatgatgttggtattttactgacataccacccctatatacttcgccttgtgttctcgggggaacaaaacgacgactattcaaaatattaggagtgaatatttatctttactaagcaaattaaattatctatcatcgcgttactcagtgtcgcaccattattagggatggcaagtaaccattcacaaaaggtcgaagcgattgccgatcacgccgatgcagataacgatagtagtcacgtaaacgcaaagtcaattgtgttaagcaatgaggctaaatttgaacaggcgaatgcacattcactgatcaatcctaaaaaagaaatcaccttcacagtcggcacgaatgatattgccgaagcagcacatcagattgctgatcaaaaagctgccgctgctaaagctgccgaagaacaagcagctgctgaaaaggctgcagcagaacaagcggctgctgaaaaggcggctgctgaaaaagcacaacaggaagtacaacaagcagctcaaaatgctgcggcagcatctgccgcttcagccgcttctgcttcatcaagcgctgctacaacagcttcgacggaaacaaccaccaacaaaggtactttcaagttaagtttctatgatccgtccgtgcttgggtctggtttgggttacggcggcgttgctgctaacctctccgtattcccgaaaggtacccgtctgaagattacattatctgatggcactgtttggtatcggactgttaatgatactggtagttttgcagctggcaaccctaatcaattggatgttgcaatgccgaattcacagattccttcagctggagttttgactgcgacggttgaagtcgtaggttaatagattgctttaacccttcgcatcagtgcggagggtttttgtttgcgcaaattttgcttagaaccgtgttgactactaagggactacttgatctcggaggtttcaaaacgcgcaaacatgcgcagaagcctgctcataaggacccccaagtctaaatggccaaggcccggccatttaggcttgaggccgcttatgctccggtttctaaacgcgcctgtttgcgctctgaactttttagttgacatctgtcgtttttttcgtaaaataaacaacaattcaacaaacgactaaaaacgatgagtagaagagtacctgagttgtcggtgtcagcgagtctcggttggtgggaagagacctctggtagctttgggaaagtagtctacgagttgccgaggtgactttggaagcttcggttgggattgcgcccattatagcaatcgtgtatcgctaggcaactggccgtacacggtaaggccgcttacggtgacgtagcggtaaattaaggtggtacagcgtgattcgcgcccttaacagtctcgactgttaagggcttttcttttggttaattagccaactcctttgaaaaccttcttacagtcaagacgctgtcggcaatcgttttgattaaatggagggatatcaatgtcaccacaacccacactcacaaagcgccagtatttgacactagggtcacttttgttcggtatgttttttggcgctggcaatctgatttttccgatccacatgggtcaactggccggttcagcttggctaccagcggcaattggctttttgctatctgctgtgttgttgccgctgctgtcaatcatggcgatcagtctaacccgtgcgagtagtatgtacgatcttgctcggccggcgggacatggcttcgcgttgttctttctgctggccactcatgcgagtctaggcttgctgatcgcatccccgcgtaccgctactgtcacatactcaattggcattgcgccgttcttaggaaaaggtcaacaacaaatcggccttttgattttctcgtttattttctttttaacaaccttcttgcttgctcgcaacgaaagtaaaattacgacttatattggcaagctgctgaatccgctgttgttgattttgctagcagtgatcttcttttgggcactggtcatcaaaggtgatattcgtgcgataagttttaccagcagccctaagctcatgagcagcaacttgattaacggctttttgcaagggtacaacacaatggacgcgctggccgggttaggctttggcgtgacgatcatcacagccttgaaactcatgggcttgcaccaggcatccactcgcgccaaggctgttgcgaaagtaggctccttggcaatgggcttggaagctttgatctacatgctcctgatcttgctaggagcaatcagtcttggcttctctaagctcacagcaaacggtgggacggcgtttaaccagatcatgacacattataccggtttgattggcacggccttgttaggcgcgatgacgctgcttgcctgcttaaccaccgcaatcggtcttgtgacatccttctcgcaagatctcggtcatcgttttccaaaacttggttatcactttttcctgccaatgacgacaattggtgctttcctgattgccaatttcgggttggatcagatcattgcttattcaacgccaattttaatgctgctctatccgctagcaattgccttaatcatgctcggcctcatgcatccttggattgggaaaaatacccgaatctataaaactacggttgccttcacgatgatccctgcgcttttagatgccatccatgccttacctgctgggctagcacaactaccgattttcagtagcattcaacaattcgctacaacctatattccttggttcggcatcgggatggattttgtgccatttctgctcatcggctttcttaccgggttcatcgccgctaaacttagcggtcacaaattggcaccggatctgcctgatccagattaaattgcgcttatttaagagatggctatttaggaatccttccagtatcatatttcaccataaagcattccccagcctagaaatctccctggaaaagcttcaactgcacagactcaagcccagccatcataatcagcgctacttataccgaaactttcaagtggactggctcgcgcgcgcaaaaaaacagcagctctggcaattaagtcagtgctgctgtttttagatcatggcccggttgttgcaccatcaatcgagacggtatatgccggattgttggctgtccaatcaaaaccaattgaattattgatttcattttgtttgacattaaagttattcagagttttgttttctaatcctaattgcccgcgtagctcatcggacatcttttgaagcgtcttggttgtcatcacttggtaggcagcgttatcaatgtatacgccaatgcccttaagctgttggcgcttaacagtggtcgctgaagctcgataattctgcgcgattgctaccatatcgtcaaacgtcaagttggttcgcatgcttgaagacaaggaatccatgactttttggtaatttgtcaacgatttgaccgacaagagatgcttaacaatttgattgataacttcctgctggcgtttctgtcggccatagtcaccttcaggatcttcatcacgcattcgggcatacgctaaggccagttctccattaagatgagctttaccttttttgaatgtctgtccaccggtattggcatctgtccaagtaaatggaacattgacatcgacaccgccaacagcgtcaacaatcttctgcaggccctccatattaaccgtcacataataatcaatggggacatttaacaacttctcaacagtcttaatggctgcactggattgcccatatgcgtaagcggagttgattttttcataagtgggcgaatcatttcctgtaccgaccatctctgccagcgtgtcacgaggaatgctggtcatcgttgttttcttctctttaggattgattgtgaccagcatcatggtgtcagatcgaccggtatctttccgaccaaaggctccggtatcggttcctaatagaagaatactgatcggttttttgccatcgagatctgagctgactgccttagtactaactggatcatacgtttttgcaactgcttttttggcttgagaataaaatcgagcggcatatccaccagcgagaaaaaaggcaacgagagctatgacagccaacgcacgaagaatcggatgacgtcgttttggtttgcgttttaatgttcgttgatctaaatctggttgcttgtccattcgagcttcactccacttttagtttccagagtagtttagcagataattatgaagaaaaaagggatttacctcaaatgccgcctcaatatggtaacattaaagaaatattagaaattggagctgattagatgcaacatttaccggcacgcgcagaagtccctaccgaattgacatgggatctcacgactatttatccagatgacaaggcttggcaagttgactttgaagccgttcgtcagcaagcaaaggaagcggcagcacttaagggtacattgggcaagtcacctgaagcacttgtcgcaggtatcaaagccgttctcgcggtgttcagacgctttgaaaaggtttatgtctattccagcttgaaaagtgatcaagacactggcaatgcagcgtatcaagccatgaatgccaaagcagaaagtctggcagctgatcttgccagccaattagccttcatggatccggaaattctggcgattccagccgatcagctgaccgcttggcgcgataccgaaagcctcaaaccctatggccactttatcgatgccatcactgtgaatcgccaacacgtcctgaccacagcggctgagtcattaattgccagtgctggggatgcgctgaatgccagtcatgcaacctttaatgtgttgaacaactccgacctgcaatttggctttgttgaaaatgaagacggtgagaccgtgcaactcagcaatggtttgtatggccaactcattcggtcaacaaatcgcaagctgcgtaaagacgcgtttgaggctttgctgcgagcatatgaaagtcttaagaatacctttgctcaaacattgagtggccagatcaaagctcataacttcaatgctttagcgcatcattatcccgatgctcgcgctgctgcaatggcaagtaaccacatccccgaaagtgtctacacaacactgcttgatcaagtcaacgctcacttgccattactacatcgctatattgccttacgtaaaaagattctgaatgtcgatcaactgcatatgtatgatatctacacaccgctgaccggacgtccgccattgagtttcaccctcgatcaggcaaaagacgaagccttaaaggcattggctccgctgggaaatgattatttagatcatatgcgggaaatctttaataatcgttacattgatgtcgtcgaaaataagggcaaacggtccggcgcttattccggtggcgcgtatgacaccaatccgttcattttactgaactggcacgatgccgttgatgaattgtacactttggttcacgaaactggtcacagtgtgcacagctggtacactcgtcatcaccagccttacgtttatggcgactacccaatcttcgtcgcagaaattgcctcaacaaccaatgaaaatttattgacggactacttcctaaaaaacaccaatgatcctaaagttcgggcgtacattttgaattactatctagacggcttcaaaggaacggtcttccgtcaggctcaatttgccgactttgaacattggattcatcaacaagaccagcatggtgaaccattgacggctaccagcatgtcctcctattatgcggatctcaatgcccgttattacggaccagatgttgcacgtgatcctgaaatcgcctttgaatgggctcgtattccacatttctattacaattattatgtttaccagtacgcaactggttttgccgctgcctcgactctggccgccggcatcagcggtggcgaaccagaggcggtttcccgctatatcggctacttgaaatctggcagttccaagtatgcgattgatacaatgaaagcggccggcgttgatatgaccaagccagattatttagaagccgccttctcactatttgaacaacgactcgctgaattagaagaaattttgcagaaaggatgagcagtgtgaaacttgggtttattggcaccggtgtgatgggcaccggtattatcaagaactttttaaagaatggccaagaagtggtcgtctttaaccgaacgcaggcccatgcacagccagtcattgaggctggagctacttgggccgaatcgccgcacgctgttgctgcgcagtgcgacattgttctctcaatggtcggatttccgcaagacgtcgaaaccatttattttggtagcgatggcattttagctggggcaagaaaaggcgcactgctcattgacatgacaaccagtacccccactctggcgaagaaaattgctgctaaggctgccgagaaaggcctgcaagccgttgatgcgccggtttctggtggtgatatcggcgccaaaaatggcacgctaaccatcatggtcggtggtgacaagactttgttatcgcgattgcagcaacttttcacgcccatcgccgcctcagtcaattattttggcccggccggctcagggcaacatgccaaaatggccaatcaaatcatgatcgctggcaccatgaccggtcttaccgaaatgcttgtctatgctaaggctgctggcctggatcttgacgaaacgcttaaagtggttggcggtggcgcaggtgccaactggagtctcagcaactacggaccacgtatcctgcaaggcgactatacgccgggattctttgcaaaacattttctaaaagatctgcgcattgctctggatgaagccgataacatgcacttacaactgccagccacgcaattggccaaacagctgtatgaacaaatggttaatactggtaagggcaacctcggaacgcaagggttgattacgatgaacgacaggtgggatcaagcatgacgacaatcgccattttatcggatattcacggcaatatgacggccttttcagcggtcattcaggatgcgaaggcgcatcaggcggatgaatactggtttctaggcgatttgtttttacccggtccaggttctgataagttatgggcgacgctgcacggactcaaacccacacatattgttaaaggcaactgggatgacgatttattctgggtgctggatggaccagttgatctgtcacagccaacagatgtttactttagtcgactggttgcctatctgtggccgcacctcacggctgaaaatctggcaacaattcgaagttggccgctgcatgaagttttcgagcaagatggtttgatcgtcagtctagcacacaaccttcctgacaaaaatcatggacatgccttatatcctgatcaaccacaactcaactttgaccaaattgcccccgattcgcaaattgatctagctgtttatgggcatacccaccaacagctactgcgctacaccagtaacggtcaagtcatcctcaatccaggttctattggccaagcctattcaccccggccacacctgcaaacaaccacttacgccgactatgcattgctgcaactcaatgatggtgccatcaccgatcttgatctgcggcaggtgccttacgacgtgtccgcagagttatcactggccaagcaacagcagttaccttatcctgaggtttacacgaagttacgccacactggcgccaccagcactcacaatgctgcttacctcaaacaattcgaacagcgccacgattaccaacaggaggttgctgaatttctgcacaaatatcgccatcaacactaactacgtcaaaaaggactcacaacacaaccgctactcaatacggtttgtgttgcgagtcctttttcaattgcttagtttgttcggtgatggtaccacaatgccaagaaataaaaaagaaattcaatggcagcgatgaaaaacgtcaccggccagttcgtcaaaaagcctaaatacaagccgctccaaaccccgattaaagcggtaatgacggaaatcacaatcatctgcggtaaagttcgccccagatacttagcgacattgggcggtaaggtcagtaagataaagaccaacaaacttccgacaatttgcgctccaatcgaaaccgaaacagcaagaatgagcagaaagtaaattgaaatatatttacttttcaatccctgcgccgccgaaccaaccggatcgaacgaatcaaacgcgagtcgccgatagccaaaatacaacgtcaccagcacgccagccgccaatgctaccagttgccagacatcggcgcgggagattccgatgatgctcccaaacaaaatggtggttgcataactagcattagcgctggaaagtgacagaaacaaaatgcctaaaccaataaacaaactagaaaccgcactgatcgaggcctctcgccgcgatgcttgaacggacatgcggccaacactgatactactgatcgctgtgaacaacaacatcccgtctaacggtctgatgccagcaaacaccgcaaacgcagcgcctgcaaacccaacttcagaaagtgtgtgggctaagaacgacatgttccgcgcaacgacgaacacaccgacaatgcctgtggtaatggcaataaacgtacttgccatgaatgcattttgcatgaatgcataagcaaataaattcatgcgatcaccccacgattctcggcatcattgcgtaattcttctggcattgctttcaaatccatttgcgctgttggcttcatctcataacttgacccggtcagtagtaagtattgttgggtgtactttttggctaagctcagatcatgcgtcacaaatagcaccgttaattgccgcgtttgattcaactcctgcaccagatccatcaactcctgcttcgtgttgacatctaagctggccgttgattcatccagaatcagaaagttaggatcatctaaaagagcttgtgccagataagccttttgtttttcgccgccactcgccattccaagccgcgtgtcagcaattttaccaaggtgagtcgctttaatcacggcatccaaggcagccttctccttacccgtatgccagaaaaagagatgatccaactgccggagttgaatgaaactgcggatcgacaacggaaattccgtatcaacattccggaactggggcacataacccaatcgaaccggtggctgttgccgaaagcgaatggttccggcctgcggttttagttgcgccattagtaaccgaattaaggttgttttgccgaccccgttcggaccaacaagacttgtcattgagcccacattcaactgaaaactcagatcctgataaagctgttgatcccgaaaaccaaagctgagatgatccacggtcaaaatcggttcgctcatagctgcctcccaatagtaaacggtaacgattacggtttactattgtatcgaacttttcatgaaaaggccagttttatttggattcttctgccttaaacggattagccgtactgaaatccagccgaattgttttcggcttatctttgaccacaaggatatacccatgacccaaaaatggcttttcgccagcataggtaagcggaaactcttgtgctggtgcaagattgccttgaatgatcatggcatacatttcatcatcggtataatcatccgaaaatgcaatggcgactggtgctgtcacaatttgcttagccttattcatcacagcgatcacatcaaaaatctgattggtgacttctttagggaaaaccttggccacgtcttcggcaacgcggcgttttttagttggttcgtacatgtgtaaacgatctccatttctgtattagcgaatggcgtaagtttatcatattgtggtcagtcgggcgaatcgagatcattttaaccttcgtgaatgctggccggtttgacaggaaaacggtgaccgcggtctactaagttgggtcggatagtgccaaaccatcagtatctctaagaacttcctagattgcataattaaagttaccacccagaaaatgtgaaaaaagacctgtcc
